United States Patent 11,001,841 (CCCTC-BINDING FACTOR (CTCF) RNA INTERACTOME) - sequence listing, part 51

SEQ ID NO: 120598 - DNA, 1207 bp, Homo sapiens
gtctctgactcctggcttgaaagcagtccttctgcctcagcctcctgagtagctgggattacaggtgtgagccactgcacctggccctttgactctttatacccactctgtttcccaccccattagtcaccaaattgattttcttggttttatctgtcttgtctctccctccttgccatcactgtcaccctaattcagtgagcctctgcttcctgcttggcctcttgcctcttttttttttttttcttttttgagacagtgtctcgcactgtcacccaggctggagtgcagcggtgtgacaggcacatgccaccatgcctgactaattttatcgttttcttttttttttttcaggtagagatggggtttcaccttgttgtccaggctggtctcgaactcctgacctcaggtgatccacctgccttggcctccttacgtgctgggattacaggtgtgagtcaccacgcccagccattgatctgttgcctcttactagagcttcttgttggattccagttttttcccactctattttattcatttgtggcctttggaaaatagatctgttcatttcatttacccaccaaaaaaggataagttcttactctttgaaataaaaatcaaactccttagtctgcctcctgaaataaaaatcaaattccttagtctgcctccaaactatcttgtttagcccagtctcccaccctttcccacatatactgtatttgagctacgtaaaactaattgttgttccctacttacagtattctctgaagatctcaaagtgttgttgcacagttatgaatggatttcataatgaccctgaatcctaaaatagaattatttttaaaatttttgttcaagaatgaaaggcagtatatgtatagaagtaaagatttctgtccaagagagttaaaattggaaaaaaataccttatatctaaggggacagattttcagccattaggaaaaattggctacttagagaagatactcaggtgcacagaaatttgaccagctattatagtgtaagttgcacattgcctgtttgagctccctcagtagctcaatttctgttgttgtttttgttaattaaagattgattctttaaaggcacagaaacaatagctgatacattgcagtaaagtgttcatcttaggcatataaaaataattttgatctaacttctaaagaattgttgttagcca

SEQ ID NO: 120599 - DNA, 1104 bp, Homo sapiens
gatcgtgccactgcactcctgcctgggcgacagagctaggctgtgtctcaaaaaataaaaataaaaaaatagcatgatgaaagtaaacagtttgatttcaaagatgagaaaggctatcatagtgttgtagataaagtgggtatcaagagtgactagaaaaggacactgaagaaatgatgtggtctaggtagacaggagcggggaggaaaaggacaggcattccaggctgaggggacaacatgataaaaaagacgagtaggaaattagtgtaatttattaagggtacagtgaaaaaagaactgtttcaggggctttacgtacttacttgatttgatcccagcattaatcttctggtgtggtatgagtgtctacatttcacaggtgaagaaagtaagacttacaggggttaaaactattatgaaatattatgaaagaattatgaaacttctaggttttcatcctccatatatctggctgcaaataagtctgtgctcctctagcaataacttcagagagagttggttagtaccacagagccttatgtattatgatgtgtggttttcacactccaaaatttacttagaaatacttctttttaagcattacatatggataactggagctttattctaatatttcactgtttttagagccttgtaagcttattgaactatttcaagtagaaatagaaaatatgttgtatgtgttttgctgctctgcatcataagcattttcttataatctttcccagtgttgtcactgatgcaaatggaataattgattcataacattctttcttattaagttgggctatgacttcagaattattttttaaaaatgtgctcaaagaggaaatagcctaagaaaattttattttttaagttatgttttgatttctgtttacttttttatatgtttactttttattgaattttttaatgttaaaaaatttaatttttaagttatattttgatttttgttgttttttaaccatatgtttactttttattgaatttattaatattgcaaagttcttgcactgccaaaccatgcctaagaattcaaagaaagaaatggtacagtagacggcctcattcacccatc

SEQ ID NO: 120600 - DNA, 1016 bp, Homo sapiens
accttcctaggagtctgattcctgcgctgacactttgatcaagactgaactccaataggagaatgctcccacatcaggataagtttattcacctatttgctttatttactcttgccagaggcaagtctgcaactccctgcatttggcaaagggatttattagaaggaaacccacattccacatcaagtggtcacataccactttgaaatatttctattgaatcagatacaaaactagtaaattgccagactgtctcattaggtggaaagaaacttctgtaatcctgggtaggttcctcaagtcccttttaaggaccaaaaaccgcaattacttttgcaccaacctacaggtagtttaaactgtaattattaaaaacagaagtgctacatcacttgtctttcaccctgactcttcaaatgacaataaagacacaccaaaaggttgataatagaactagtgatttctttgatttttaatgatgacctgttttagtgttattgcttaacagttttaggtttcacaggtttttttttttttctttttcagtttaaccaaaatggtttctgaaacatattttcaaatgggtaagcagtcatggctttgattatagtatccacttaattaggaccaggcagtcagtcatctgttctgggagacaaaccagtccaggacaagtagcgtttggacaatatgccaaatcctgtcacatcacattgttgctctaaaatgggtggatggattgggttgatggcatacgctaagctccatgagggcagggattgtggctggactaagtctagtggcaattaaatagagctcaaattaaatagagcttttgctttgaggtctgaatccatctccatgatttgtcactagactagtgacaaacagtggctgggatagcatatgttgtttagacagcttttgcttgttctaaaagtttgaatgtgaattggggtttgcaactcaaaatttgtgtttaatatttgcaccttatgtttaatgaacataaagtt

SEQ ID NO: 120601 - DNA, 1958 bp, Homo sapiens
acacgctcagtacaggtgcaatttctttttccgaatattttcaatctacagttggttgaatccatggatgcagaacccacattaaacagagagctgactgtatgtaaaatatggcacacacagatacacacgcacacacttgtctcttgaaattatgccttttaaactcagatcaaacaatatctgtcattgtacttaagccttatctctgaagaatttcccttttttgatgaaaagttagaaactacatattttacatgcattgcaacatctgtgactttgggttggggatgtggtttgaacagtttgggtggacaaaataaattgacttcagagttaagttgtagactcaggacacgaaggacagttgtgttatagcgtcacaggtgcagaggaagtcagaggcaagggagttgccatttggaatggagagctgggttaaataggagtaggtcacaaagagtgtggtccgtaggtaggttgcaagtcgaacggtaggtgcaaaagtgcaaaaacttctcttttccaactatgaaactaggagtggggctttcacccttcagtcttcctgcatctttagctgctttacttaatttctggtctgtgtgccctaatgccatatctctggtggcaactcctatctttttgcccctcactgctgtagagatggaggtctcactatattgtcccggctggtctcaaattcttggccttaaactatccttctgcctcctcctccgcctcccaaactgctagatgtgagctgccccaggctctgtagtggcaactcctaccttaacctggagatagtaggagctctgtttgtcccaggtggatagtaggagagttgattggaattgttcagctaaagggaagctttttaaaaaaagtatgttagaatgggattaggtgagattatcattcttttattttccagtcttttttgtttcttcctgaaattagatttgagggtggtattgtgaagttaggtggtttggtctatatatagtttgcccaatgttgttatatgatgtggtatttgagagaactctaaattatcttgataacccccacttctttttttcttagatgattaataagaatagaattaaattaaaagacagctttttaattttaaagacattattagactgtccaaacatgtctgaattcttagaattaaagggaagtttgaaattaaaatattggcttatccagaaagtagtcatgttaaggctgttttgttgactgcttgattaaaaattaggttacccagtggttttcacaggacactcccaaagattgttgaaaaagacattttgagtgtagaagtatctgagatactggtgcactgtacttggtgtagtgtattatccagtgacctttgaattttctgtgtcacttaaagaaaagaggttcttatttttacttcaatcactgtaaatgtcagtgagagatagctctgtggtcactgactttcaacagtggtaaggtcaggtaagaacttcacgaagccttttaggaatttgtctgtaaagggcactgtgttgtcatgaaacatacggactgctttactaaggacctgggatgctcacacagaaggcaactccatttgtggagaaggcttattttgtctgaattgtttaatgtcttgtctcagacagatgatgactcaaagtcaaatgttcacctttaggggacccaaaaggatacaaaagagaatgcatagtaatgattggcctataggcggttgagtggcaaagctagtttaaagaagaaaaatccttcctatctttttttgtagttctgtaagcattatttgaagaaacttggatttccctgtgtgctttaaagtgaagtgcatgttgtgcagtaaagaagcagatctaacctcattgtggaacttgcttgctgtggtgaatcacagaaggaatgatgtgaaggcaacatttatattt

SEQ ID NO: 120602 - DNA, 1045 bp, Homo sapiens
gaccatcttggctaacacggtgaaacaccttctctacttaaaaacaaaaaaaaccccccaaaaaattagccaggcgcggtggcgggtgcctgtagtaccagctacttgggaggctgaggcaggagaatggtgtgaacccgggaggcgaagcttgcggtgagccgagatcacgccactgcattcagcctgggtgacagagcgagactccgtctcaaaaaaaaagaaagaaaattggaacctaaggagttaatgcagacacaattaatcattctttctgtgtgctaccccctagggtttggtcaataaatcggtatttttataatagaaggtaaacacagccctaattcatacataatcacttgtttgcttgcttgctagagcctgtcgaattttattgggatcatttatgcggttgtgattcttggatctatcgttgagagttgtatgaggtattttatatagttttatccgtcacataagttcttgctgacagtagtggacttaacagattgatggtccagggatatgtaaattgtctgttgacctaatttttagaagaaaagcagaatagtgaaggtcagctggaagatggaaaatgataacaaattgatcttcttagggagcatgtacaatataaggtgtgatgttttgtaacacagtagtttttctcagattggcacacttttctggaaagtgctatattttagcctttgtgggccacaagctctctgttgcagctactcacccctacattgtgaacacaaaagcagtttgtcataggtaatacataaacgaataaggaataaatgtgactgtgtcccagaaaaactttacactgaaattcgaatttcgtataattttcacgtctcagaataacatattttttttaaccacttgaaaatgtggaaaccatttgtattcatctgccagggctactgtaacaaagtgttgcaaactagatgtcttaagcaacagaaatttattgtctcatgattctttctgaaggctgtaagtctgaaatcaaggtttgttggcagggtttgtt

SEQ ID NO: 120603 - DNA, 1145 bp, Homo sapiens
ttaattcttttgaactgaatactgcattattttcaggatagcatgaagatgttggcttggaacttttgaaggggctgcgttatagactctgcatggagacaaaccattagtactaaccacctggctgtattctaaggcttaaaagcaaaatctttatgtgtgatgttttgtatatttggcttaaaaaattcaccagcttttagaggttgtgagatatgggtcatttttgttcagataagagaggtcaataaagcatttactaacatgaaatgtttttcttttctcctttctcagtattaaaagaaaggtgaatggacaaaaagccaataaagggcttaattttaaaaatgtagcaacaaaaactcacactctggctgtcatggtacttgaagcttcatatttcaaaactgtattaacagctttagaaataaactttacagtagctgcatggtgtcaaccagtgcttttctcctttgctttatcctattgtgtcagcagggatgttgcagcaattctttttgatctaaaaattactttgttctggagctgaaaaagaaaaatgttctaatctcccactaaaattttacctgacagtgaggtcagtcaaacaatggaataacttgctaagggagttcagtgagaatctttcaccagagatgtcctgaagttgactagaatgagccagttggaatctgaagatcaagttggaaaagtcctccaggatgagataccccctctgaaccaaatttttaaaaaggagttaaaaagtgtgtattacaaggtttgagaaaacagtgcctatttattcagaacttagtttcaggtctgttttgtactttacaaaacatctttcatgaaggatatatttgataatggaaagtattttttttttaaagctgtatagttctgaatcacaaatgattgtgctatcgtgtatattctgaaaagttcgtgattaaatcacctactgttgtgtgctagcacctcataaaaaatactcttcaatgagatcacatggacacaggaaggggaatatcacactctggggactgtggtggggtcgggggaggggggagggatagcattgggagatatacctaatgatagatgacacgttggtgggtgcagcgcaccagcatggcaca

SEQ ID NO: 120604 - DNA, 1309 bp, Homo sapiens
gaaactctaatacgtggaaattacagcatactcttaaacaattagctggtcaaagaaatcagaaaatactttcagatgaattcaaatgaagacatagcatgtgaaaatgtataggatgagcagggtgtggtagcacgtgcctgtagtcccagctacttgggaaactgaggtggaaggatcccttgagcccaggaatttgaggccagcctggggaagcaacatagtgagatgctcttaaacattttttaaaaaatgtattggatggagcttaagtagtgcttacagagaaatttacagctgtcaatgcctatgttaagagggaagaaagatctcaaatcaataccctgtccttctaccttcactagaaaaagaagagcaagtgaaatctgaagcaaacagaaagaagaacaaaaataaagattagagcagaaattaatagagaatagaaaaataacagtaaatcaatgaaatcaaaagctggttcttaggaaagagcaacaaaattgacaaacatttatatagattgaacaagatacaaagcgagactcaattagcagaattaaaaatgaaagaggagacactactgttgaccttacagaaatacaaaggattataaaagaatactgtgaacaaattgtacaccagcagattatataacttagaggaaatgcatcagttcttagactctgaacttctgaaacagactcagaaagtagaagaaaattagaataggcctgtaacaagtgcagagattgattcagtaattaaaaagctacctcttaagaaaaacttagctctagatggaattctgagggattctaccaaacatttaaagaattaataccagttctacacacacacacacgcatgcacacacacacgtttaggaggaagcacttcccaactcatgaggccattaatacccaaataccaagaccaaaagtaaagtatcataatcacattccaatatctcttatgaatatgtatgccaaaatccttaacaaaatgctagtaaaccaaatcagagatgcataaaaagaattgtatcccatgactaagtgagataatctcaggagtataaggttggtttaacatctgaaaatcaattaatgtaatacatcaacagaatgaaaaacaaattatatcatcatctcaatagaggcagaaaaagcattttatgaaacaacacttttgataaaaacattcaacaaactatgaatcgagtggaacttcctcaatctgataaaaggcttctagctattactttttaactgtgttattttagtggttacttttatctttaacgtat

SEQ ID NO: 120605 - DNA, 1034 bp, Homo sapiens
ttgttagcctttaacaatagtggctgagtagccactattattgttaaaatgtgcccagcctgttcatttttgtgttgtgactttttctgaggtttcatgaatgctttaatgatccgaagttattgttcatttgtccaatttagatgtatatttgtatttaaattgtagatgtaaactaatacttgaaataagcactgtttaaataggattgatctaattttagcccttatgttttagacgttagagatgcccgttattatctttgcatatttcaaataaaatttctttacaattctttaattgccctgttttgaagaaataatacaactaatgcacatggtaaaaatttaaacagttcaaaatggtttacagtgaaaagtaaatatttttacttccgttcacagttccattaccccgagggcaacctatgtaaccatggtgttttttgatggggagtatccttctactttgtactgtgcttaaccattatacatttaaacagtatatgtttgggcatgtactatacatactattcagcttcttatgatgtgttttattgattgttttataacagtgtatgtagaattacgtcattcttttgggtaagattgttttatatcagtatatgtagaattattcttttgggtagtgtcatattatactcaatagattcagcatactttagtctctttttatggacatttaggttattaccaatcttgttttaactgtttaactgtgatttagttatgtaactattttaaacaatactgcagaaacccttgcaatacaagtttttctgcgtatgtgtgggaatttcttcccatattatcttaatgtttttatttataacttcttttatactgtgttctgagaacattacatagcaaagtactctttcagtactcttgagaattagaaattactattcaaaattttactctcttggaataggcttgcagaagacatctctttttcaagaggagaaactcatcttacaaatggtgtttgagcaaacttccttttgtgtagaa

SEQ ID NO: 120606 - DNA, 1577 bp, Homo sapiens
gtgccactgaagcaaatcaatgttttcttactaccaattcattggaacttccaggtcataaagtatcattattaggcatattggaaagtctcagcccaatgaaaatgtggattctgggattttccagttgctttgaaatagtgacagaggctgcctggctgtacattttccccatgtataatgaaaactggaatttaaagggattgatacgacaaagcaagaattatataatgacctagggaaggatgaagcagaatgttcacttctaaaagcaaaataaggaaaatgatgaagaggggtgattatttccatagtagcctgcttagtgactcatgtccctgctaataataagtattgtgagaatgtgtcttattcttggctatattcacagcgcctagaacagtgcctggcacataatgtggatgtcagtcaatgttggatttacttgtgcttgtttatttaaaaactatttggggttagattgtcaggaaccctgctacatgttgtgtaaggcttctagtgtgtacgtgtgtgtatttcatataatacatttatgtgtatgagcagttggaattgatcactaaaatatttcttaaaggtaatataagtacaatttggtatgttgagtatcatgaatgaatcaatgcaaagattcaagtatctttgggtagaatcatgtcctttgaaatgtcagtgtacagtaaaaaggtctgacatcataactagattataaatcctatactcttgtactccaaagtcagtatagttggactggcttgtatgtcctgtttgacaaaatataaattttactttcctgtggcaattcccaaactgggctgaccacttggacttttaagaaaatgtaagcactcttgggcattgacccaacgattttcattcactagatcctggggtggggcctaggaatctgtgttttttaataatttcctttctgtaggtgtttacatatagtcagtttctctgctacccacctttcatgatatactttgaaatttggtgacaatcaccttggaccttttgggttctctggaaatggtaaccagtaaggtaattaataattaatatcttatactggtagagggaaagaaatgctaacatgtgtcatactaaagatcttttaggactagtgctgactttctgttcatatatttcactggaaagctattgtcaggacattttgcggaaggtgttttttaaaatgtggcatattcatagagttgtattgctggaagttaccttagaaatcatttagcttattcccttttatatttgagttaatcttaaaaatgttagggttagggtgtaccacttattagttaagttgcctcatttctcttagccatggtttcttaagcataagatgggaatgataatacctacctaccttatagttttttttaaggatttaactgaaattcaaaaaaagttgctagcatacatcttgtttgtagcagtgtagcaagtgttcagtaaatgtttaatattttgacatacctataatatgatctatggtatacataaaagccaaaagaggtagaaaaagttatagtaattaa

SEQ ID NO: 120607 - DNA, 1001 bp, Homo sapiens
aaaaatgtgttaaagcatggaatcttaaaaagcaacttgaatgtttagtttaatttaaaacataaatttacatgatttgcgtttttaaatgtaggtctaaggcttgttctttgcatgtcatcaactgatttgagagccatacacttgtttctgcataagccacacaaataatacatagtctgtgataatttagcatagtagaatgtggcctctgagaccaggcctcctgggctgcaacccttattctcttttcttactagcatatgaaccaaggcaagttacttgacagttccttgcctcagtttccccatttgtaaaatgcagataataccagtgagtcagtaattgtcaaacacatactagtttaaaatgattaactcatttaatcctgttggtaactggcatgtaagtgcctaagtaattgttaattaagtaatgtccagttttggtttcattaagtgacatgagagtctaaatacatttgtgaagcaatctgaaggtactctttctagatttaaaaaaaatattttaattaagactttttaaatcttgcaaatataaattgtgtatgtttatggtgtacagcttggtgttttgatatatgtatacattgtaatggctaaatcaagctaattaacacctcacacacctatcatttttggggggtgggaacatttaaaatctcttagcaattttcaagtatacaataaattgttactaagtataatcaccatacaattgatttattcctcctaactgaaattttatgtcctttgatgaacatatccccaaccccccattctactctctgcttctgtgagttggactcttttacattctgcacataaatgagatcatgtggtatttgtcattcggtgtctggcttatttcacttaacatgatgtcctccaggttcatccaggtttttacaaatgaaagaatttccttctcttttaaggcttaatagtattccgttgtgtttatatgtcacattttatcca

SEQ ID NO: 120608 - DNA, 1975 bp, Homo sapiens
gataactttagggaagaaaaccttatcttatgtttggggatatatagtgggacagttgcaatcattgtatatattgggtgtgttagagttgatagcctcattaagtttctcttatgtggaaaaattatttggcattttaattcacttcattgtttttttttttctccttttctacaggggctttcattcatatattttaatttttcttgttcttcttttgactagtttattgatggccatgcctcatcttgtctgtaattgttagatggtgctggactaaactttcagtaatatatacagggccacagatgataatgggactagttttacatctatacactataacttttagtgcaagtacttgaaacacacaaaaatcgaggcattttgctctgctgtccttgaatttgggcataaaatgctaaaaccactgctaattacagtaacccacttggaatctaaattgttacattaaaattagtttttaaagtgagcaggatccatattgctacattatagaaactaatacccttattaacagctccatcttctccattgtaatatttccttaaaaagaaaatttgcagacatggtctgaatgatttagagtgatgtgtaacagtttggacaggctggttgcacccctgaaagcctcctttgtcattgccagctaggatgtcatctgtttgaactggtctttttcgtgtttgcctagggtgagtagagagtggtgatttagtagagctgttggctgcttcctggctgctgtaggaagttagtttttctggctatatgtgtatgaggcgggaagcagattgttaggagtctttaatattctaattttacctctgagaaaactgggatgacttagagtgtagtaggtattgtggtttgtttttcccttcctttcctttaccaccccactcctcgccgccttctccttctctttgtcctcttacccatccctcccctttcctcctttgtctggattattagaagaggttgaattcagaaatgtgactaatttttacagattgtgtttttacagactagtttttagaaatgtgacagtttttacagattgactcccttcactgaagaaggaactttctttgtagtctagatttttttagttttatgatacatgtctagtgtagagaagttcagggaccataggactggaagagcttggtatacttacgtgctggtactgtttttttttatacttttctctatttttcttgtgccctaggtttttccttccagttgggttaaaaaaaaaaagttgttgaggaacattgatatggtgaaagagttgttttttatttccatatttatattaaaatagttttttgcatgtgtatgtttctctgagtggggagagatagtagtcttgtgtatgtgtcaggaaaatattataagatgtttccagaattcccagaaattaggactgttactagaattccccaagatgaattagcatgaaggctaatttgtcattaaaacattgatatccttcaaaattgaaaaaaaaatttagaagaaacatttaacaacataatcatttctgccatcaagtaaaaattaaaaagtacaacagtgttggccaggtgcagtggctcatacctgtaatcgcagcactttgggtggctgaggcaggtagattgcttgagctcactagtcagagacctgcctgggcaacatggcaaaaccccatctctgcaaaaaaaaaaaaaaaacaaacccacacaaaaattagctgagtgtggtggcatgtacctgtagtcccagttactttggaggctaaggtgggaggatggcttgtgcccaggaggcggaggtcacagtgagccgagatcacaccactgcactccagcctgggcaatagagccaggccttgtctcataaatgaaatataaaatataaaataaaataaaataaaacgttgttggcaaagatgtattcaaaatagtat

SEQ ID NO: 120609 - DNA, 1546 bp, Homo sapiens
gttctggactggtatatgcccctcagcttctatattggggcagaggccgaagtttggcatgatgaatagaatacaggtgttggaattagaccagattaattcacttactagttctgtaatcttcggcaagttacataccctcttgggacctctgttttctcaatggtaaaatggggttgaaggtatctggtattgtgcctgccacattataggcatgtaataaatgttagatgctaccattaacacatctctttatctttttactcatcttattcacttgttgatactcaattttcctcattgctgttgtgtttatattaagcaggattctaaaggaatatctacttgttgacagcatcttttttgggaaagaaataatgaccccctttcccccatcttgtgacaattgctgttaggtctttggttccagcacatggggcaaacaatcagcatcagagaatacttcctgagggaggcttgctttaattgtaaaacatagtaaagagggcaaaagaaggttggcttattctatttttaggggcagttctggtcaaaggctcaaatcttgggaatggagttgctgaggaatgaagttttaaataggtcagcttgcctaacgtagagcactccaggaggtctttggaaggaagagctgttaagaatgagtccgcttgggagaggatcaggaagggaagcagcggtgagatgaatgtaacagaaaagtcattattatttattattactattttttggagacagagtcttgctctgttgcccaggctggagtgcagtggtgtgatctcagctcactgcaacctccgcttcctgggttcaagcgattcttgtgtctcagcctcccaagtagctacagacgtgtgccacctctcccagctaattttttctatttttagtagacatggggttttgtcatgttgcccaggctggtcttgaactcctgagctcaggcattccgcccacccctcagccttctgtagtgttaggataacaggcgtgagccaccgtgcctggccagaaaagtcattattgattgcccaccatgtagtccctagggtgctgtgctgtcaggtgctgtgttgtgaacaaaggatgttgggttggcctttggagatagcttacacccaaggtcagatatttttctgtagttcctagctttgtgacctagaacagtctgcccacctatgtaatggggatgagactgtatgtctttgatttctaagacccccttctaagttgaataatgccttggcagaggaaggggtaacatagtgttccattattggaacactaagcatgtgggaattatttatatcctgctcaaggtcattgccctggtctcactgcaaaaattcaaaaaattccaacctctggcataaacgggttaaattattcatcgcttgtaaccaattctaaggtatttccttgttacagaaatgctaatgtgatttttttaaaagtgcgttttaaaagcaaaacaatatggtaatacccatcttagtgatgttgggacgattaataagataatgta

SEQ ID NO: 120610 - DNA, 1031 bp, Homo sapiens
aggatttatgcatggggttttgttttcttagcttgtgtgagaaagcagtttcaccttaccaaggtgcttcatatatttgcctaggacggttgaaacagttttccttgaatgaaatcctatctcctatgtacttgcaccaaacaaactttccttggtttactgttgttggtatacagtagaactgtaaaaaatgcgtgctcatcttgacttgaatgattattggttaatgttgctctatcaatgagaatgtaacagaatattttcatgttggagtcaggaagagaatcaagctgagttagcccatcatcagatccatcatagaggctgccatggtgtctcacgcctataatcccagcactttgggaggcagagacaggaggattgcttgaggccaggagtttgagaccagcctgggcaacatagtgagaccttgtctctataaaaacaaaaagcctcctgcagatccctcattcaaatcacctcgggtaagtcacgtaatctctttggaccttggattcatcattataaaatgaaggacttgggcttgacatgtgccaaggtccttttctagccccagaggtaattggttaacttctggaattatgactccttcatgaagttgaaacttttaggtctttttatttttactttttaaaaaactttctatctagcgatcctatataaataagtctttgctaattaggatatgtttaactttccttctttattcattttgtcaaaggtaaacaaagctgcatactagctaaagttctaaggacaggttttagtcagtaatacacttttgcaatagggaagagagtccagtatgaaatgaagtcaatgttgatttgcagagatgactgggagttttaaagggagaatggcaggggacttggcagggtggataaacggaatctgtagactcaaagaagtgaagaatttaaaaagattggtaaaatatggtgattaggccagctgtgcctgttagctgacactgtgactggggaatagataccctatttttcctgatg

SEQ ID NO: 120611 - DNA, 1897 bp, Homo sapiens
gttcccaagattaaataaattttaaagaactgagatttgatcaatggaagtttagacttggatctaatctccactgtttgatgttattaggatgaaagtagtagacttagatggaattgtactgtgaaaaccaaagctaaatagattagtcgggattgtactgtgaggatgtaacagtaacattgttttgcatttgtgtgtaggagtattctcttttcttctgctcttttcttttagttcagttgtagtttgcctctagatcccctcataatcagagaaacagtgctgaaagcttcacaagagtagctaatttaggaaaaggtgtgcatatgtggtggggggagtgtttttgtctaacacattttctgttttggtggtgagatcttcatttcttaacatctttcttgttcttgttcatatgacttttagctcattaaccttgctctctgtgctgcgtagtgaagcaccatttctatttagtctcctgtgtttagcttctcagaagaatttttttgaaaatgtttggaagtgtgatttaattgcaaggctgtttgcacattgtcagtgtgaaagcaaagatgaatttcgtatttagactgtgcaacctgcagatttcatttgttaaaccttccagttggtactcccgttctctcatacatgtgtgcataataatagtatggaaaaaaactcctgttttgttgtatccatatttatcagtttggttgagttatggaaaagcctgtcctttgctttgtgtatttgctcatttggaaaccttgtatagtttatagagacactagtgatttgttccccagcttccctgtgggttttgttccatattacaatctaattccacctctctgtcccatactcctgagctgttaatttgtacatttcgatgccgtttgtttcatcctgtgttttttaatccaaactgaatgtaatgggctgtgtgctttagggacctggctttgccttgccaattagaacaaagtggttactgagtaagagtatgttttaaataaaacatggcacctctgaatggtgctgatactcatttgggaataaaagagatggttttaaccctttgactcacaaagaagagccattataaaagatcatatatatatatttttttttctttgaaaagaagggtaaagtttacctccataaaatgtggttttacaagtttcttaaggtaactaaataaatttaaaagtttgtcattaaaaatgtacttttttccttcatgatcatttgagacatgttagcaaaattctgtaaatttatgaatattgaaccaatggctgctgctgaattttgaatttgttcatgtttaggaaggtgagggtatatgaaaccaatagatatgtcagcctctttttatttttataatatatcaagccaagttttcaatttagtggtgacactccttcccccagagatacttaaaaattatgaaggtgaatgtaagcttctacaatcttgtgggaatattattttcagataattgaattttgagccatcaatgacttaaggctatttggaagtttagctgcactttcaccaaatatttatagcacagatgtttctgaatagaccataggctaatagtttactaattcacgtcatagagagacacttcatcagttacttctgttattgtatttgcatctaccctaaaaatagagttctctttttagctgatatagcagataaactgtaattcatcattggaataaggaaaacataaaacttactttgaagaaaaagtgggactgtatcaaaaactttgaaataaagacatccaagggaaagctagacgtagaaagacttggtgacaggtttagacaacattatagcatgtattaacctatgcaaacaagagagaacaaaa

SEQ ID NO: 120612 - DNA, 1421 bp, Homo sapiens
gaagagaacggtgggtacaattttttggctgcaagtgccaaagtagtaagttctgctatgacccagtaactattataaaccacttaggctctgaaatagggaattaaatgatgccagtgctttggtgtactccaaggaatcagtgtagcttaatgagtgagagcttgagctctggaggcaaatagcctcttcctggctctgccactttacctcagggcaaatcaccagtataaagtcccagatcagcgcagtagtatgggaataggagcaagggtgaaatctaaattacattgggataaaagaatccatgggttcttgatgggaatcatatgtaaggaaagaggaagaaataaatgtgactataaggttttcagtcactgaacagaataagaaaattggttgcctgtgcttgtgggtgtggggagggtggtttagagtcggggtggagggttgttgatgaactgggttttggacgcagcttgagataatttgggaagtgcatatgctgtgtagggtactcagaatttggaactctgtgaaacatctaaaatcaattttgaaaaattgccacgttaagatgaggtccttgcacatagctagtattcattaaatgtttgaaaaacaaaataatagagttgaagcttactgtgctcagggcaatatttctaaaacttgagcatatacctagaggggctgttaaaactcacattgctgggccacactctacagagtttctgatttaggaggcatgaggtggggctggaaccatttgtgtgtcttaaaagttcccaggtgctgcagtggtctgtggatgacactttgagaaccagtggcttatggaagtaaatagaacacaaaggaatgctcagatccttggaggaggaagcagaaaaggagataaatgaagtcacagaggtcacaaccatcagtcagagttagatgacactagtgacatagattatagaaaggggatattttaggatttcaactttgggtaacaaatggcatcaagtgaggtagggagattaaaatgaatgagaaatgattattggatttaatgaatactgttatttgtgatcttggagagcagtgtttatctttttggggtcacggaactttgaaaactgatgaaagctgtggatcccttcagaaaaatgtgcaagtgctcatagttttgcatatatttctaaggaggttcatgaattttattgaggcacttgcatctgaagtaattgaggcacttacatctgctttagtatggatggtctcattaagagtgctaagtgtggaagccagatatgaagagagggaaagcgtgggaagaaggaagtaattgtggatatgaacagtccttcgggattgcaaagccttttgggagtggactgataattgtccagtttccttacttggaggtctaagcc

SEQ ID NO: 120613 - DNA, 1101 bp, Homo sapiens
aataaaataaaataaaaatctttgctttcaaaaaggtttttggttgcataggagggaaagaaaaaaaatggaatatcgaaattagttgtgtatgctgagtttttctaccacttccttcctttgggttaaacagcctctctcctatttattttaacttgtttgcaatttattaggcttggtaggacccagctgttatacctcactcagcacattacccattttgcttttttaaagtgactgaggcagcagctgttctccagctgcacacagaaggcccacataaagctgggtttagcacataagccccactctaagagcattaattcaccaacccagtctttctattttgtcagccactcaaagtttatacttgcctctgtgaggcttcagaaataatggataaatcttctgttaatgaaaatacacctccagatataatattcacactaagtgtggtgttagaataacagatatggctcctcagtagtttttggactcttgtaggtatatggaattgtgagactgttcattttgaggatctgtaaagagttaggacttaccaggtatgatttgaaacactcaagattgtctcttggagtctcacacaacagctattattttatttgaatgagattattagcagattgatagttggaccaggtgctatactttatgccctctcttccctttgtaaggttttcaggcctattaattttttttttttttttacaccattggggtaagattttattttggctgaaggtacttaaaatgggtgggtgagtgatagataatatttgtcttcactattggctgtaaactgggattagagtagatttatttatttattaagcagtcaactagaaacaagtgctgtgaagtcaataatatatggctttagtgaagattccacttaactgaaagtagacctgaattattcatgcaatttgccaacatttatatccattaataaagtggtagtttattttgaaaaaaactttgcacttactgagtttttgttggcatttccctccctcgagttcatttgtcaaagtcatcatgaatatactgttagtatattcatggcttttgattgtttca

SEQ ID NO: 120614 - DNA, 1075 bp, Homo sapiens
gatgattgatggtgctttgcaagtagttaaatacacccaaggtaaaggaaattttatgggattaaaaaaattctatgctccattctaggttgatagtatttgaagcaaatttcatttcattggtgggtggcctcagtacctaaactttaaaaagcatggattcataaaactgttacaacaccacttatgaaagtttctgaagaactaaagagttgttaaaaagctactgtctttctctaaacttggttactgtggagtagcactgtctgatgcaactttttgtaatgatagaaatgttctctatctgtgctatccaacatggtagctacatgtggttattgaacacttcaggtgtggctagtgtgacttaggaactgcattttccattttatttaattgtagttaatttaaatagccacatgtgtctattgctttctgtattagatagcacagctctgaagcattacactgagtacttaagctaagctagtgtttctgagagaaagtgatcctttgtgattttcctgaagctgaagaaggcctgtgtatggcctggagtcagaaattgttgtgacttttcttgattttttcatgaaataatttaaggactgtcttttctttcaaatctgggaaaattctgaaatgttctttctcatctacttagaaagcatttactatcacctttgacgagcaatacagtggccagtatattgtgttgtaggtttgattagttctctatctcagagagacagctttagtgaccgagagtttattgcctatctgcaggaaaataataaagttttcctgtactcaaaattgccagacttggaagtagaaatagcagcttttgcctttctacaacaaataattattcttttggctaattcccatacctgccacctttaccttcattattttctctgaaaaagaaatctgggctcattgcaacctctgcctctcccctaggttcaagcgattctcatgtctcaggctgccgagtagctgggattgcaggcgcctgccatgacacctggctaatttttgtattttttagtagagacggagtttgaccatg

SEQ ID NO: 120615 - DNA, 1653 bp, Homo sapiens
ttagcagggcccagtgtaaaatgaaaatgtgagcctttgttaaaaaattatttagtttcttaaaattctaattttaatcagatcattaaaccaagcactgcacccttcggagctgcagctgcacaggttacatgcctaccaagccagggctactgctgtactccacttcatgttcccttctctgttccatggcccagtaattctcttcaaggcaataagccaagacaattgtagggctggtctcctttgtttcccatctctcagaggtcactgtctttttttttttttttgctagatatccagagtcatgaaaattgtaatttttgtctgtttttatttgtttttgtttcaggcaggaagagaaatccagtccctgttaacctgcctcgcttggatgtagttgtttttaatgtacattttgtttaaggaccttgtagtagctgcttttgtgtcagactaggcaaagatttccctatttggcctcttggcttggtgccttgtttagagctgtttgggtaaaatctctcttgtatcatttgctgatctgttttccaatttgttttcctggtaaccatcaactcattttctgaattgtatcacttgatttgaagcaagtattagcttcctgcttgaaaccactctacccttattcttctttctgctgcatttaactgcaaactgcaatgggtgaggacaattctcttcttccacctcctgcacaatacatccccttgcagtacaatttgatcggcatttgtgcagtaaggtattaacagcttttcagatatgccctgccctattagcaagaatatacagtgatacaaaaatgaatttgtcaagagttttatgacttcatgatctatcgtacaatattaatcctgctgcagtgttattaagtcatttttcatctcccctcaaattaatgttgacgttctattactggatttgttcttgtccccagattaaaacataaaggaaaaaagccttccctgctgcaatattaaaattaattgtagggtaagcagtacctagcttggtgaagtagattcctgctggaaaatttataatgggaatttatttctctgctttctatttgttcttgtgcacaaaaaagcacaattggaatatacttctgagggcaccaggagaacatagcaaggagcagggggtacatttaaagtactgagtttcctaaaagggaaatgaggaatcagtggtctgagcctaaggcaaccatacctagctggtagttccagcctagaggctgatagggatgcttgtggtgatagatgtataggtagaacaattttggctgacttaggatggtattttcttcataggaatagcgtgtttcttgtatttcaagacatttggggcacttaaacaaaaactacaacatggtgaggtcaacagttataaatcacagtacgaccttgttcaggactctggaatgagaagacagctgttatctttgtttcagatttggactaagtgatgctgttctgtgaatattctcttttaaaaataactgttttcacccatattgaagccaggatcatcagcttcatgtctgtgaccactgtagtgagatcttagggtattgtgatttttggtcatggttaggtaggtgctttagaatgctcattgttactg

SEQ ID NO: 120616 - DNA, 1056 bp, Homo sapiens
gcatcatccttcactgtaggtgattccatcatttttcttttttgggttatagtctttttgaaagcacagttggatataattgatgagtagtggtaaactatctggatgatgaaatgttaacatgtttcaagatataggaaaaataagatcgctaaacttccataatgtgtcttatatttataaagtgagtctattggaccaatatggtaattgcaagatagagcatgaaatttcttgcagtgactcaaaagtataaaggtcatgaaatgccaattcttacaattagttagaactgctgagaaagaaactaaaacaaaaattgagtcagatgaactaagtgttaagagctttaaaggtaaaactgtccaggtttcccgttgtacatatgagaagagggagtatattatcagtggcagagccatgggttggaatgggggctcagatgtgcagtcttagctttcacattccctcaggtggtactagaaagcaaactaaaaatttgaacaacagtcactcccttgtgagttcctctatagttgatggtaggatgtgaagatggtactttctgaaaacatttaaattgtatatgattacataatttgaacaaagcagtgtatcagtgctaaaagctagttggcagaaacttttgtcttaaaagtgatttatttaaaacttctactgaagcccagtggacttctacattccagcatccaggtgtccagtactctcatctataagagtgagctactcgtctagaggctaaggcaagtttcagctagatccagctaagctggtctgaactagtggaatgagccagttgtagctgttgtcattgcatctcccttttgagactatggaagcctaggacttagtctgttaattatcagagaggtcattgctgtatgtgttacgtgttcatggggctactgcagcagttatacttttttcagcagtctcaaaaagttgaatgtgaaaaatgtctgaaaaaattaaaaagggatgttttatttctaattgttcaatgatataagacttccagtactttagttttagttt

SEQ ID NO: 120617 - DNA, 1032 bp, Homo sapiens
ttcaaaatgaaatatcctctttaaaataagctcttttgaatagatttagtattttccgggaataaattctgagtttctcaggcaagtccagaactaaactaattacttgcatattcttactcttacagaagcatgctttaaaaactgctggttaaagttattgcagttagaaggaaatattgtgtgaattaaattttttaaaaaaagtttttaatgcttccttagaagaaaatattaattttgccaataagtagaaaaaactggaagcaaagttcctatagtaacgttatctttgcctttacacagctgcattattattaccccattggcctgtgtgattaatgctttttcctcacaactgtggaagcacataggattctttctgtatcactgcatatgaacttcaatgctgctttcctagtaagctgtgtaaatatgtggtctcaatatgtatctccagtttgacctttatgcttttactcctgccaaactttgtccttgctgtggtatctcactacatctattgcaaacttttcctcatctgccagaaatgtcattgctctaaaaatttttattttgtctttgtatctcgcaattcctgacattatgcattattttcccccatgtagttcaagctgttcattttctctcagtaaagcttctgtttataagcttactgttttttgttgttttgcaaaattaaaatatattgcttcctaaatgcttatttggctccctgtctttgaagccagcctcattctgagttaaaacaaatatcttacattgatttgtcttcatagttcttctggttcctcttgttcctgttggttatttaaggatgtggccttaacttagattcttagctcctcctttcctccctccttccaacattattgaatatttgctctatgttagggactcttttggtctccagaaatagagcagagagcagcttcctgagtggtgtgcttgttcgcatgtttttttaagggtctagttttattcattccacaaatatttagctgaattttt

SEQ ID NO: 120618 - DNA, 1663 bp, Homo sapiens
tttaggctctttgtgatattttcattttttgcaaagatactaaaatccttgaaaaagtgaatgttaccagtaaagataaatcgttatcgaactaccattccaacagagtatatcataggaccggtaaaagaattggatttctaactttttaaaaaaacgatttttacatttgcttactagaattatgtgtctgtagttcaaagaacaagttcatggagtgtgtgtctgtgtgtgtgtgtgtgtgttttggcttctgttacaaaaaatatgattacttaacaattataatgttatgatcctgaagatgatggagtcactgtaggaaaaatccttcagtgtcttccataggacagcagcttatttcgcctccatagtggaccaaggaactgacaaaacactcttttgtttggtttttatttttcttagaatggcttctactcacaatcaggttaggcagaccacctggtgtctgcctgtgaatggggatatttatgagcagtctgaagcagttcttaagtgtccacttctttgatagagagagactgcttattccaagctcagacattacttttctctcagaaattgcctgccaacacccccctcatagtagaatgactaattatgagctgcagtcttaacatttttcattgttttgacgttgtatgcttggcagggtatagggtagctctttacttcttcaggctgtctatatttatcaaatacagtgtagatgcctttataatattaaatatgtgatttgtaactcttactctccaatttctatcaataaagcacagctgcttagttacaactctggctggattaagcagtttgttttattttgtggctcactagagtaatttgaaacaatgaagatttaccaaggatataaggccagatttttgcaggtgctgttgtgtgttttgtaaacaaacattcatctttagtggctagatatcaggcaggtccccccaaatttctggtgtacactagagatcagcccagatgtttcttatccggggtgggggtaaagagagggtgaccctaatgatcatgctcaagagtgttatgtttggctgatccagtggttctgactgcctttgttccaggcagtgtgtagcagtttaacagctcctttgaatgtgttagtgaatgaatgagagagtaaaagttggggataaaagcagaaaggtggtggcatgataatactggagaacctgcgtgagcatattaattatatgggtgcagtatgccatgtcaaggcagctgctgactcttgacagatcctattaaccccatgtttttttcttcttcttttgaggtgatcttcttagtagaaatttaattttaacctctttcttaaaataaggaaaactaatcttgggtgtcagtcacattcataattgtaggggcaagcattttagaagaacttaactgttttcaagcactaaattctcaacctgagttgtcttcagcaacctaaggtattaatatgtctaaagagcccggtctcttggtttcttgtgcacgtagtttttgggtttctattaatgaaaggttctggaggttctagaataaaacaggtatacccttttggaaattgcattattaacatgcagtgatcattatttcttcaccatgttgttggaaaatttaattttgc

SEQ ID NO: 120619 - DNA, 1498 bp, Homo sapiens
gctcaggcaggagaatcgcttgaacctgggaggcgtaggttgcagtgagccgagatcacaccactgtactccagcctgggctacaagagcgaaactccatttcaaaaaaaaaaaaagagactcttatctttcttatcttgcagaagaaaaggaattttaagtgcagattttcaatggttataattttccaacaccagacaaataatgaacacaaaatatatgctgctgtaagattatattgatagtctcacagtatttctcttcagcattattatctgatcaacacatatatgaatggaatagtaaaacttaacatttatcatacacttgttatgtacttatttcttttttattatcacaaaagtataagtgtcctcaatttaaatgaggatgcacagagattagtaaccatcccacagttaacagaactaatagtttagcagagcctagattcaagccaagcagtctgatcttttatccaacatttcctgagttcagttattcttagctgccccttaaccccctaataggttttttttgttttgttttgttttctgttgagtatggtttggaagaacctgcaaaactctatctaaaatgaagggatacattaacttttcttcagactaatattgtaagagaaaaaatttaaggaaaaatttggttaatttaattatctaaatcattttctgtatattttccttcaggttctttatatatatgcatatttttgcagtgtataaatatatttgtaaccttatattctacaatatgagacatttcccatgtttctattttgttttccaattattttgaattgttgcatattataccattgacctaatttattcacatttgctcatcttttgggattgttttggttgtttcagtttttcattattatacataacatagtaatgaacattttctgcatagcatatttttcttctcttgaattatttttgtaggatacatttccaggagagtcacatgtactctagaacttcatatgttagtttgtgcctggcagtgcctttattatgtgaattaggtagggagaagtaaatttgcagaataaaatgtgttatattccttgtaaagtcatttttgcattatccagtcattttgcatataaatagtagaaaggggtttagttatttatactgttttcttatttccattggggaaagtaagaattggggagatacaggcaatattaaattagaagtgctttaacgtatcagtcttcttcttcggcatagtcttttagttcctatattttcaggagtatggctggtatatgattccaggccctacaaagaaaatgagaatggaggaaagaatagcattgtaatgatagaagagggttaaggaacacctgttgactctgatgataagaattatgatggatttgtcattcgtacagaaagctaggaacttagctcagatgcatgcatagtgtgagagacaagactcaaataaaaatacacaggtagtt

SEQ ID NO: 120620 - DNA, 1078 bp, Homo sapiens
caaaccacaaaaagacatggatgaatcttaaatgcaaattacaaagtggaacctgattcaaaaaggctgcattctatataatttcattagtatgacatggaagatggaaaactaaagtgatagtacagagatcagtggttgccatgagttcaggaagtgaggaggattgaataggtgaagcacgggggaatttttagagggatggaactattctgtatgatccagtggaatagtggctacgtgacagttgtcaaaacatacagaacttttgcagcacaaagaatgaattttaatgtgtgaaaattaaaaagaaaatgtttaggagatcccaggatagaatgcagaatgttttaaaaacagactattacagatgtatgaaacatctgtaatgaggggggcgggagggggagagaaaaaaatgctgaactaagtaaatttggaagtaagtgaattctgaaagactaaaggcaaaagaacctgcacctgagtattgtattctagctgatgaagttgtttttcatgggtgtacaggttaacagttctgatactgttatacatgtatactggaattgaccaaataaataaatggatggtggaagccagatttctcattgttggggtgggtatttacagaagagtaaggggaagaggctagaatggtccatgtggtaatgaattagagaaggatatatcagtaatgtggatacttaatgtggatacagatggttacatatagaaatatttacagagatgaatgtgtacacagattggtatacacatatatttccttgctctgtctgctgagagggcctagatgcagcaaacagtgattatatgtagcacctagatcctggtttctaataaccattctccaatagaagcaaccagggctcttggagaagtggtcagttctaggactggagtaggaaatatataaattgagctttgaacatattatagtgccaaaaagtaaagtgctttaaaaaaccccacaatgaagggggcatgtcagagggacacaggagccagctgaagagctcccagtggcccaagctggaaggaactatttgaacaacaa

SEQ ID NO: 120621 - DNA, 1044 bp, Homo sapiens
gtaggacagtcccaacttccagttgaataataatcccctagaaacaatgctttgttatttctgacactggttcactgctctcctcttcacagatccattactactagtgtttgaccttctggaaggcacaaggtgctcctgaaatcatagttaggactgggaactgaagggctgatgcaaatgtatcttgtaagacagtctgtgttctgttacaaatgatctccatcctggtgttctttcctgcccagttcatttatttttcctaggatctttgcacagagcagagcaacataaactctattacagtcttatcttttagtgggcttttggccaaaggttcagagctctagaatttagaattactttttacttcataaaatcacagggttgatgttagcactttttttttcagccattaattcatcccttggtcatatgtaaataaactaaatttgtatgatgtagttggtggagtgagatgtctggtttattcagcttggaaaacctctttcagaacatggataaacatgtatttgtgcattcccatagcttccggcaagctctgtagagaaggtcagaggaataaaagtaaaggcaactcctttgtccctaggagtaaaaagtagttgcacacaagagaattgagttatggctgttggtctgttatcttttctttttgtcttttagtcttttcttttagtctaaatattgatatattaggtgaatacagagtttagcatccttgatcaaatttattgtattactagagaagtacatttttaccagtgaaaatacagtcaagtgtgaacattttaaatgcagaaagcctgagattttgtcctattcaataaaacggctgaattatagaatactcaagagatgttgttttccttaagaagatatactataaatattcatgcgtactaagcctatagaaacataaactaggcttagttcaacaataaatacttgcaagctcaatgaagacataatggatacaaagatgataccctcaggaagcttatagtttagttctaaattaca

SEQ ID NO: 120622 - DNA, 1850 bp, Homo sapiens
agtaattagagcttacctaaaacccaaaatgttgaactagaaaatcactgtggtctcttctgattctaaaagttggtgattttcttgacatcacaaattcatgcagttgcgtgtgtgaatagtgagatgttaaacctgtaacaagaagagatagatcttcttcagtgagataatcagcttctgggtggctgagaagtttttatatgagtaagatcaaaaatgagagtctgctcagcagatttgcagagagtctctgataaatttctttagtgccatttcaaaccccaggagctccacatatgatggttttatattgggctctgttatgggcatattctatatctctactctcactctgcagatctgtcgaagcatgttttgataaagagtattgaagtctcaaagatgggttttaatatctttaccaaaggatggcagacattgacagatggtttctaaggatagttccttgcaatcaaatcttatttatagtgccagtatataaaatgagtataggtggtgtgcattattacattatcaataaaaactaacagttgatttccactgtcaatggcatctgacttttctagatcagaatcatgtaatgtggtagaaggagctcttaagtaggattgacaagcctttatctatccttccctctctgttttgagcacttgggcaagtcatttgagctacctgagagactgtttttagaatgaatcacttttcttataatgatggatttttaaaaatcacattaatttattatacagttgttacattctgcatggttaataaaggatgacttgccaagagaaatcttaatttcatcaggtttctagaacagtttttaaaacagtattgaaaacattactatgtttttatacttcttcactgtgtatgaggaaaagttgaccacttgagtgttgttatcaatgtacactaaactagatgtacagttcaggggacatcagcacatatatggacatttggcagatttcttgagccaataattctggtccttctcttttaaaagttcttagttaggtaaccacagataattgaaccagagaagtcgtctcatggtgtgctaagtaaacacagatgaagatagagccagctgacttcagcaactcttctctgcatggtgtgtctctgagacttacattgaagatgtataatatgggttacttttacttcagtttcttgtagttacagcttctgcatgtatcatgccccagaaaaaggtaatcatcttcccattatgacatgcagtatacaatttatagtcttttttgtggggaaggagttggggaagaaagtgagtttaatggacctgaggtaatgtttaataacaggatatgtaagttaaattgaccagctgttgtatgtctctgtgtttgctgtgatagaatttgggatagtgagaaatttcacactaattttattcacactaaacaattctaattgtttcttttttataaaaaaatgtgaaatttgcctaattaagaggctgtcctttttaaattaaatataaatttggtgttcttctggaactctgctgtttcgagtgctttttgtcctcattcagtattattaatgcaagacaacctgcttgcatgcagctaagcatggcttctttctcttatgtataacacagagtgggcagggtgtacaaaactcatctacatccttctcagaaaacttctgtgtaacactgccatgtgctaagcctacggaggtgaggaagagggttttttttttttttttttttttaattgatggttttggctcaagctttggagggacgaagaaatggtgtggattctgtgaaatcacaggatgtctaa

SEQ ID NO: 120623 - DNA, 1315 bp, Homo sapiens
ccaggttaagtttaagcttcttgaggactttagtactgaaagacaatggctcacttgtaagacctagttgaagagtacagatttagatttgttcagtgtgctgtgatctgtaaaaaaaaaaaatcacaatgggatttctactaatggatatgtaaatatataatcattccttttatgcttacatccagggtttaattaatcctttggtaattaagaatcccttcaaagtttgcttgtgagcatgttgttccgaccagctattagctcctatactaaaattggttgccttgcagacctgtgttatcagtaataagcacctcaaaagtcactcaggaggaaaaccgaatggaagacctgagcagagggaatcttcattgtatacctttttgtgtcttttgaattgagccctttgagtatattaactaatcaaataaatagttaaataaaatttaaagagaaaactttctaaactttttcactatgagtgtgtgatctctgatgccaggtactgttttgtggaaggggagaaaatactaggtttcggtagcatcttaacaagtgataaatgcttttggctttatttctcactgacatcttgtacttctggtggtgtatttcttctttctactgaccagcaagtaagttccaaaatactgctgaatatcaggttagaagagagccagtgtttatttcccaccctgcagtcttcagtgtaaatatctgaaaatggttatattgggagagacaaaaagatcttccaaatctctcttatacatctgttagtctacaagagcttgccaaaactgtattctgaacttttacaggatcctgctataacccagcatacgtagccaccatccagattttgttttaaaagtaggtgtggtttaatttatattgaaggaggtttcccaggaagttcctgggccagattaggtctcctccttcatcttaaactccaatagaaatacagaaacctctctgctttgatctgaatatgttttaagagacaatgttatgactggtggttaccgttgcattttaagttataaacagtatgtagccacttgccagaattaacaaataggttagagttacattacattcttttgaatctgaaattgatattttatcacttgttttggcctttttgctgaaatgagaatttgtggacggtgggggcgcaagagaaaaaaatgttggttccatgtctgtcaggtaactggcagagttaaattcctatggcatatttctggtcgcaaaaacatcactaaatgtctaaataaagaccaaaacacttctaacattgaatatt

SEQ ID NO: 120624 - DNA, 1035 bp, Homo sapiens
tttttaccaatatgatgactaaaccaagactggtagatgtaaccttatactttatttaaggtctacaaggaggaggagtatatattttactgtttctcttgttatctagaatttaacatgggatatttacctttagggaaatcttttatattataactctgccctggatgcttagttagttaactgtgcttttgtagtttctttaaggattgtggctagtaattatgaaaatatactaaatctcattactaatcagagaaatgcaaattaaaacaaaaatgaggtaatttcacaccattttattggcaaaaattaaaatgtctggcactgccaaatgttaatgaggatgtgtgggctctgctattggtgggtgtaagaattgaatactgccttcatgaacagtttggcaatatttgataaaggaggcattccttttggcctgacatttctaagtctgtattctggaaatgcttgttcaaaggagtcaggtacaagagtattcatcatagcagtgtttatgttaatggaaaacttagaaacaagccaactctccagcagcaagtgaatagattaattgtggtttgttcataccctagaacactatgcagctattagcaaggaatacatctcaaaaacatggttgaattaaaaaacaagtttctgaatgatgtgtatgtatgacaccattatataaagttgggcaacttgcaaaatcttgtgtttgtggatacttatttgtagaaatagtattaaaacatgcattggaatgcaaaccctgaaccaaatttaggatagcagttacttctaggaaacagagaagggtataggatttgaggagtacacacagattttcaacttgacctgtggtgttttctttcttattaaaactctgaagcaaatatagtgaaatgttaagattagacaaagctagctagtgggtgcagttgttgtgttattctctgtaactttctgtatatttataaaatacatgattagatacattgagggtagtatgtttataatgggccatacatt

SEQ ID NO: 120625 - DNA, 1194 bp, Homo sapiens
aaactcttccttactatgtgtcagaaagagaagaaggtagatgacctctctcccccaaatgtcttgaacttcccttttctaacctggcattgcttgcttgccttctgaccaaattcatcacattgggaagtggaagtatacattgctatctgatgagatttcattttaaaagttctccccagtgaaagcattataggcacttcagagttgtgggtgtttggcaggtgtctacagccaaggagagtgagggaaaagtgtttcaagcccagctgtgtggtagaaatggagcatcttcatccagcatctcccagtgaattgatcatgtgtggaaacaccagtccaaaaggtaactcacagcttatggagggaccagaagctttggaataaagcacaggagaaggaacccatgtgaggaagttgggcaggagctgtttggcgttacagttagaagcattgcctttccattccacgatgacttcaactggtatttgaagctagttattagtgtgcccagtgagccatgcatttctgaggtatctcagtgtttttaaaataaagtctgaaatcttgatctgcttagttccaccaaaccctgttcaaattttctgaaggcactttagcagagcttgtcttttcattttgtgaatactaaactgtaaacaatgttcttaaagcggtaaagggaatatacatttttagaatttctatatttgatacttgaaaagttgggatagaggagagacctggtgtttgtgtctcactggagagggaaactcctgctcccattaaaaaaaaaaagaatcatatatttctagatgtatatttcagtcttccgggaaactccctttacagtttaccttcctaggcaatgatacagacctgtttgttttatggaaatgagtgttaactatattttctcaaactacagaaaataatattcatgttattcgtgtcagcattcttgatctctggttttgggtattgtcccctcccccaagtcttatctcattctcaaaagtatgccttttcctaggttcccagaaaactacttataatttgcccttccctcctttttgcggactttgaggatcagctcccttttgcagttgttggtggactaaaatgacattatactatcacagttgaggtgccagttatcttaatataatatgagtttagcatgtttatatgtgg

SEQ ID NO: 120626 - DNA, 1385 bp, Homo sapiens
tttaacaacctccaactagtaaaattcaacaattcagaaaaagcacatattggaggagtcttgggtaagaagctctcattaaagttgtatatagcaccctgctgagctttacaattggttttgaaatgaaaatctgttagattagagcaaacattatcccagctgccgcgataagtaatgtggagaagattaatgatttgtctatgaaagccagtgagcattaaagtctgctactgtgccctttttaaaaggtgcaggtgagagaagaggtaggaaagaagggaggactatgctattcatagctacatgtttatcttcttcatatgagttagtgattccctagcttttttttcccttgataaaaccaaggaagctttaaatttcaatgatacccccaggactagaatttttcattgactagggaaagtaaggtggaaccggaggaaaaaaacactgctcttatgtaacattgaaggttctcccttcttccaatcagcaacgaaattttcttcctcttttcatggaattaattgcagtaccataatctgtcttcttgtggtaaatgtctgaagatatatgggtgaaaattagtgatggtagagttaatacttttcctcttcacccattgcatgcatcattgaaggtaaaatagagcagggctgctgttatataaccttagatttcctggcttggtagggctgtccaagacaattcctgctttccccattcagcaagtgcccctgttttctgagaccttcagtgtgaggcagggagagtggcaccagcaccactgtgtgaaaatagtgccctgacagagaaagaatggcttagatgagtatttaggagaccatcaatacttaaatataggtttatatatcatagcagacttacagttttattagcacaaacctaatcttgtgatttggaaatcaagtctggtattggaaccaaagttgatttttattgttgtctttttgaattttggtatcctgtaaactcttgccattcaaaatgtgctccttatcacctgagagcttgtaagaaatgcagaatctcaggtcctgccccatgcattccaaatactaaatcagaatctgtattttaacaagactacaagttatttgaatgcacattaaaatttgagaagctccgatataaaccatggcctgcttttctaaaatcagcatctattatacttttcctcttttccaaagtaggcaagaaggctttaaaaataaaaaaggaaagaaaatgctttttgtttcaccaacaggaagcctgatcatgattttaatgtcatagcagtgccatgttttttgatgctgtttgtgcatcttcctggagacactgttttaaaatgcagctatttcttcttaatccttgca

SEQ ID NO: 120627 - DNA, 1142 bp, Homo sapiens
tgaggaaataggcccaaataattttaatgtgacttgcttaggtcatgtagctcctaagtattaatggggtacagacttgattttgtttgagtctaaagactttaaccttgcttttctatccctttaccatttggtcagaatttatctaagagcagataggtaaattgtgtaatttctactaacttgtaatatgtacttaactttaggattaccattattttgatcctgcagggcacagcacaacttgattggaacagccttgggctggagtaaggactcttagtatagttcagccactagctgtcttgatgactgttttgttttctttcctttttctcttgtaaaggcaaggaacgggtatgtgtgttgggagtggttagctttaaggacaaagaatgcatattctttgaaaataagtaaaatcaaagttgctactagaatgtactattctttgtgaattcatcaatttgtaaaaattactgggagaaaaagcgtttggtaatacctttcaatacactctaaccatgaatctataaggctacaaggagctttcagaagaaagctagccagacactgaatcaaggagggttttatccttccgataggtttttattcacaaaacctctctagagaaggagctatgcatgtgtgtgtaatatgtattttaaggtagacattaccccttttcattgaagacagttgatgtgattgaagtattattcccaacagcttagcatgagacatttaataacattttaagacatttcaataacaacatggaagttttatattttaaaaagatttgagagatcaaaaaatgataagtatatgaagtaatgcatatgttaattagcttgatttagccattccacaatgtgtatatattttgaaacaacatgttgtgtatgactatgtaatttttattggtcaacttaaataagatttgaaagttttagaatctagaatgtcctgcctctaagctacctgtaatctgactttttggcataggcaaggaagaaacttttcattttggcatgaggaaaatattcaaatgtaagagcagtttcatacacctatagacaaatgtcttttacttgtctggaaaaatccagaacaattcaagaagaagaaatagcttttac

SEQ ID NO: 120628 - DNA, 2077 bp, Homo sapiens
ttgaataccctaaaagtagaagtagctctgttagagagctttgttaccctctagcatgttgacgatacattttgcttcctcctctgtggtaaaggcagagatgatggatgcagtgcagccttttgattgcaattaaaaaggagattctgcttagcatggtggtcaattagctctttatgaaaaggattctgaccttttatttcatacagatatttaaaaatatgtgagccttaaatgaatcttagcaactaaaactgaaacaaatgtaccattttaattgggtttggaaatactgtacaagataaattgtttataaaatgagatatttttaaatggcagggttcaccttaggcccccaggaggatattctgaggcagggtctctaaagacattcatataggagaatgaaagtcgtttcccccccgctttggtgctttattttattttttttaagagagagaataaaaagtttctggcatgagatggaagattcagaattgtcacctctaccttttcatggtcagtagactttcatagtcatttgtctttaccaaataactttagtcttcagatgtttacatgtcattttagatgcaaagatctttgaaagcaaggcataccaaaaaggagctgaatctatatcatataagcggcttggggcagcactatctctcagaagctgttggatcccatcctgaaacctggttcatttgaagctcaagctaactgggatctggctgttttgcttttgagaagtaaaactacggaggttgaagtaaacaggtttggttttaagtatcagataggttggaaataaacctagatcacatttctcaatctggaatcaccatactatactgttagtgttccagaatttctcaagtttgagaaaccttggcctaaaggagtttgccagttatctcttctctgtatttctttgtgttttgttaataaaattttaaaaggtattgggtcttatttctacaaggtatgtcttattcctcttaaaatctgcttccttactaaaggacaatcttaaaggaccgtaagtattatttggaaagaatgagatgatctgagggtgtatagaatctcagtgttttgtctcacatcaatgatttttagcaacttgaagattaaaattgttcatagccagctttaaaacatacctaaggtcatggaatgacctaattggccactttcttcctctttaaccttttctatacacatttgtgttctgggttgtaaaggatttataattttccccaggatttgcctcagaaggagacacaagaggagtataatgtattcataaggtagagtagtagtcagaagataaaatgcataaattagatgcatatgtgtcagcatggatatacataaaaacgaattgaggaaaagctagttatagtgtaagacatgcagtacagtaccatttatgtaaattttaaaaatcagtactctgtagtgcatggaaaagtataagtatgtggtctacaaggagacattccagagtcatgatattggttgtgtttacagagcagaaaagcactagggaggagaaccgtagctttattaataatacttaaaaatttttatatgcattcatatgcataatgcaaatatgactaatattaaaatgaattctaaatggtggaccaagtggttattaggcatgttttctgtgctttgtttttaatatttttgaaaatacatgcttactgtgaaagaaagccgactattgttcagaaaacaatattattcttcctcattctctcacctgaatattattactcttaaacttatgcatctcttgagacattggggagagaaatggattaaaaactagaaaaaaaacactgaaaaattttatttttgtacagtcagtatataaagcatagtactttataagcctgcattttctactttttttcgttgtctgtatgtagatacctgcctcagctcttaaaggaccttctggttgttaacacttacagaaaaggttgtagtgactattcttgcatacacatcttttaaaatttttaaaaattcattatatatttttcaaactttcaaa

SEQ ID NO: 120629 - DNA, 1047 bp, Homo sapiens
ccacccagctcggccttccaaagtagtgggattgcagatttgagccactgtgcccggccattcctatgtcgaaattctaatacattagttgatatttcttatgcatgcattctttgccttgaaagataaaatgaaataagaatctaatcatagttccttatataggaattctaatgcagttcatgtaaaattttgttcctaatttgatatacattttttctagcaatttttcttccttttaatcagtagtcttcacttaaatattgatacagatataaatatatattatctcaaatgtttatgaaatctcccacataaaataagattatggtattttatttaacactacctctttctaataagagtagttgagtaaaaaatatcatatatagattacaatagttttctttttaaaatgatgatatcaggacaaagggaaaatacagattgagtagtaagaccaagatgaggaatttgaacacagaaatccatatataaacatctatataatcattaaagacagtgcagattgaaatctgagcttcctagggatcaaagcaaaaatggaaatactgtgtaagcagttcaaagatcattgtgttatgaactctaaagtggttagcgagaagagtagcgaacagtgttctcagtaacagctcttcaaaaagtgttttttacatggctttttcttacaccatccctcattatagaagccaagggcgttatatttgaaaaataagtaccggtgatgatgactgaactatatctcattttccttttgcccatttgtcagaattaatggtaagcaccatctctcagactaatgcaagatctaagcctaataaattgcctaaatgagaaaaaaaattataaaggatttttgatctataagacttcctattgagctgcatggaataagagtaagagataatgggagttgtcgtctacatagaacttgatcgtttaatttgtttagtgctatctgaaggaatttgcctatatcacatgctattaaatatttgaaagataatttcagaatggataact

SEQ ID NO: 120630 - DNA, 1033 bp, Homo sapiens
atcagagttagagctaaagtgtactgatctagtattataattagtaatggctatatgtttgaaatacgacttctggccaggtgcggtggttcacccctgtaatcccagcattttgggaggtatgcggatcacttgaggtcaggagttcaagaccagcctggccaacatggtgaaaccccgtttctactaaaaatacgaaaattagctgagtggtggcacacacttgtaatcccagctactcaggaggctgaggcaggagaatcacttgaacacaggcggcggaggttgcagtgagccaagatcacgccactgcactccagcctgggcaacagagggagactctgtctcaaaaaaaaaaaaaagaaaagaaatattacttctttcaaacccaatctgactttttctttggcccttttggtctgtgatctgtgatgctttgcagaatatagtatctttattcctttatctgagagggaaaatgtgcctatatgcatatacaatattgcatatagtttaataagattactcaaaattacatgcaaaagttttctgtgcacacacactatgaatcccagattattgtccccacatatttggtgcccctcccagtgtgaggctcatacttccctgtcctgatcatcaggctcagctacgtgacttcttttagccaataaaatgttaatgaaaaatttatttggcttttatgaccagaaactttaagagctgttaggtggttccatttctcttttccctttgcagtgataccagcagtgttccattaagggccactccttcattctgggttcctggaatgaagatacgtggagcagagctgctgtctaccctcagtagacctataatgtgatcaaaacaaataaaccattgttataaagcctgtagattatagggtcattcgtttttgcaggtaaattagcctaagctgactgataataagaaccgtaggttaagaagatctgttccagacctaggtttttgggttttttttgttttttttttttttactttttgtgtg

SEQ ID NO: 120631 - DNA, 1017 bp, Homo sapiens
aacccatgatgttcaaggattaactatactttaacattttgtttatcctctcatatttatgtttttagtatgtcccttgtaaattgaatacaactggacttcatttagtccaaatattctgccttttagctgataagttcagtctgtttacatttattaccattactgacatatttgtacttatttctaccatcttattatgtgttttctgtttactctgctgttttctctgctgcctttttccttatgacctttccttctgaaaagtttgaaaaactattctttattccctttttccttctgattacccttaaatttttaacatgcgtctttggctttgcacagaatgttaaaatcagtatgtttgcattcttctgaataataagggaccttggaaaacttttaactctagtaccttccactaatcttaaacgtttttgaccagtgttttactcccatggttttttagtcacccagatcagtctttattattggtgttgttgcatttaatttttgtaccaacttccattgttttctaatcctcagagactgtgaactccttaattaagctcgttttctatttttcttcagattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtaagtgtctggcttctgaggggtggtagagagagcagcttaagaactttagatgagcatcttggtaatgcctgaccccagaaaaaacagcacttcttttaattcaagataagtgtccacatacaaggcccaagctcagcaagttagagaataagtttcagccattcctgaagaaatagccttttataccgtcaaagtacatgaagtttgaaccagtctagagagcagtggctctcacctatg

SEQ ID NO: 120632 - DNA, 1044 bp, Homo sapiens
tatttaaaaaatggtagtgccttttaacagatgtccttgctagactgccccgggtctttgaacatccattgggcgtcattggctacatatcttcatttctgtctgacaagccttaatctgttccctggaaatttagtatcactgccaccaagcggctaaacttctgatttgtttgtttttaccaattaaatttctaataatctctaaatgaaaccagtgttccctttttcagactatgcctacttcaggaggccagatattgggcaaaacaggctggtttcttctagtaaagcatttagaaaatattgcctattaaaaaatattttatgacttcctgctgggctggttttaagtgaaatatggtggggagatttatttacagttctctgtgtgtgtgtctttctctttgcttttctctaatgaagctcaaagcatcaggccatttatcagagataattatacaacagatggagtttttccgatatataatagtctcaaagtggaagattctttcccataatgaagaatgcccaaactttaaatgtctcttttgattttaatttaacggtgtttttttccccagtgcatttattcattcatcccaaagctggttctgcaaagcatgctgcttttattagggctgtgttctgaaaagattgatactttgcagtacagtataataatgtacagttatatgctatattgaagtgaagagccataatttatcaaaaatcaatgtgtgagatcattaagttaatctctgtcaaaatacaggagttgagcagttcagcagtgttttcttatagaaattctttctgttccataatgtcagttggataggaacttgtttaagtactggtagtatcatctgaccttccatttgtagtcaaaataagaaccagattaaagcaaaaccatgatttttaagttattcattttctggcttgcttttctttttcaaaacttttaatcctatttttaagtatgcaagtaaaacatgactacattctcaatttttgaattacaaagacacaggtttagata

SEQ ID NO: 120633 - DNA, 1034 bp, Homo sapiens
ttagttgcaaagagagatcctattattaagacctgacagtgttcacttctgcctgtaaagcaagacagttggactaaggtaatttctgtttagtgtcactcatcatattccagctgtggtacagctagctatgggaaaggctcagcaaagaggcagaagagaagggcaccggtgttccaagttgtttttacaagtccacgcaacagtacctgtggcctgaatagatgtctttttttcattagtcctgaagcctcttaggaagaacatgcaccagtcatttccctttctaaggaaagtgttgcagccttttttcagtagctgctgcaggctgagatttatgagaatagtcttgctagctgaactatgtttgaaaaaaaaaaaaaaaagctcttccagtgctgagtggtgtctccattaatgttgttatgagaatcatgcttgtgttgatggtaaaatgcaaatgatgcaaatctagaaatcggagttgagccttagttaagcctgtaaatagtcaaaagtgaagcctaaattggagaggtgacagcccctaattttgtattcgtattaaatatgctttgtcacaagagaaaaacaaaacagtgtctaaaattagtactgattttattagccaggtgatattttgacctctaataaaatggggattattctatttttatccccaagagggtgatgatgtcttagaatgtcactgttaatcgctgttggactttatcacattttgaagtatcagtggtaagcgtttgtcagcatcttaacatatggaaaggtataggattctaggtgagagattacatctgaaaaactaaaattgaacatatttaactgcttacccagaatcctttgagagttccatgaaacatgtttttactcttcttacatacgtagcagaaatggaatgtcttggtttgaaattttgactagcttattccactatcccttacctttatttacttaaatattcacattttgttgagactgggaaacccttttactgttatttacacttagtacat

SEQ ID NO: 120634 - DNA, 1102 bp, Homo sapiens
tattttgtcctttttttttttttaagaggaatcctcatcaagaaattcttgataagatatcctgaatctctctctgcccagggaggcttaggaggaaaaaaaaaagatattctgaatctctacagaagggagagaattgtagccctttaatttgttgtccagaattacctttagaactgtgagcctggaaaagtgagatgctgcaaaggtaaacaatgtacagattatgatagagtggaattgacaagctggttaaaaacggatgatgcatttttaattagcctacagtgcctttagttgataaaataattagatacttttatgtaaatgtcatgttaagtaagaaaattgaagtgttacagatctacaaaaggaatggctatttttgagtattaatgttttacagttactatgaaaggactgatagtagaatatttgattattgtgcttctggcaatgtttagctgaccaattccgtggtagtctatttttttctaattgatgtgctgttatttgtgttgaaggtttttagcacatgattaactgcagcaagtgagggctagtggaaccagaagccaaaaataaccagtcgtcacagctattttaacaaaacttttcagagtagattgttgatctctatttcaagattaagaagaaatggtatttttctgtatttactcagctgtggattttgagtgcgtgaaaggctaaatgcagctatcctccaaaccactgttcttgacttcctccttgagttgtagtcttcaactagccgatgggattgaccactacatgagtaggtagccctgggttttttgacatgctcagtaactctataggagactggaaaaatataagaattctggtgcttcactttgaaatgtgtgtgttgatagttaatggggtatctttatttacttctgtttttgcaggttacagtgaagtgagtatgcagatttgacccatgtcttcaactttatagggctgcagtcagtactctttccccgggaaaatctactaccatattgcaaatgctgtaacaatttctacttgttgggaatacagctgaagaatatagtttcatggcttttatgtggaattg

SEQ ID NO: 120635 - DNA, 1284 bp, Homo sapiens
tttccagaaataagaaggcttcagttaacaaaaacaaagaacccttacatggaagcagaagttacagcattttatggagctatagaagccagtccaggagggtttttgaggatgttgaggctgtgttagctttgcatgtttctcattgtctcttcttgttccctgttttcatgtcgcagtttaccatttgaacctctggaattttagtccattacactttatctggtgaatgtggcatttgtagaaaaatgttcagttgaaattactctgctctctggtctgcctttcgaaactgcaatttattcttgcctcattttcaaattcttgcatttccaagtaatacaagccaatgatgaatgttctccttcctcattacatatagcctttattacctgtttcatgttctttggcactcggccactttctatctagctatttattgctgtcatgtattgttctgcatttatgtacagaagttttttcttttttttttttaaagaaagattatgatctccatgactgtgtggtgacacatagtaggtatttgctaagtgttctttgaagtcagcagtgcacttacttggttttttcctcttttaaaatttcccatctgtgtcttcttacactcactaagggttgttgctgttatggccttgttatagtaaagagtaagctaagagggagctccttaggtgggctctccaagtccttaaacccatgaatctcggcactatacactctaggaacaggtctcagagctctttcatctttccctccttttcagtgagtaaattaaatgatatgaattattgttgtaggagatacacaactctgccaagtaaccatcttttacttctgctagtcacagtcacctggggaccctttttaaaataaatgtgtaacatttgcctatgtgtcctattcctttatgatcaccactgcccatcccagggcatgtcattggggagtgttggggtatgtatcaatatcaacctcagaatgtgttgaaggtcttgattttgcagaatgaaattattgattttcaagccttcactcacccaacaactatatctcttgcatactcttgaattatgcttatgcatcagatctctgggcccaccaagattccataaagggcctctcgatatcatatttcttataatgaaactagatattcttccttggtcagcaatgctttctttatatatgaaaatgattcttatttcttctgacaagcagtttattgtttcttaaggccccctccccttattatgtaaggctagt

SEQ ID NO: 120636 - DNA, 1001 bp, Homo sapiens
attatatctttatagtgagcacccattagatggtgttgataaatacatcaatgagtattttaggcagaaagaagagtaaagtagaagtactggcattctttgctgtactcagttttattaactgattttatattgatcacgttctttgttacatgtcagtattatagtggcagttgaaggtggtaatatttttagatctccgttagtgaaatgacaggcattgagctctcagtcatacctttgtaggccttcgttgaggtgaatacctacctcttaactagaaaaagatggagaatttcttgcttggaaggaaattaatgcaatgtccaggtcatctcctaaaaagcctgaaggaaaattgagatttctcagcaatggacattaaaggtcatcaagttaagccagctgtacttcttttcaagaagactgttctgtgccctcttaggctagccagactgcctcagccttaaatattggccctgactctaaaggacagagcttcctgattttgagaggtaaattgaaatgatttattttgagaaccacaggttgactgtctttgtctccatctttctctgtgtcctgcagtcagcaggttgcccatggtggggatttcaatcatttttcttctgaaccaccaattgttattgttattttgctggaatgttctttgtagcctttatgtctaggctcttcaagttaggattcatatctatgacatgtgctgtacagtgcttctactgtgaggtagtctcccagacagaaaccacatgggccttcaggcatagatggtcagtaaataattactttacagtggtgtcatttcttaggagacacagagtgagaccttaagtgagatcttacctacctcctcccatccaatctatccatacaaggttggacctaaagcagccttgagcttaataatgatgtgtgttagaacaaggatactgagattagactaaggtggttctttaagtcagccgtctctgacaaagggc

SEQ ID NO: 120637 - DNA, 1236 bp, Homo sapiens
aaaattagctctaaggattagcattagacccattattatgtggtttagtaagtgaagacctcagtgattgattaatcagtcaccatttgtatttcaagcaattactgttttgatcaggtgaagggtattgtcatattttagaggtgggcagcagtgtagagtggttggtctacaactatcaaaatgagagaggcagctcttttttaagaaattgttttgtgatcactgtgagtctacgaagcagattgcaaaaagtagctgtagtagcaaatgaaagatcagtttgtctttgtgagatagatgggaaagacttttctttatatgatggcttttagccagacagaattattaacagttaaactcattgtaatctttagattaaaaaaaaataaaaaagcaacacgatgatcattttggtatttaaacagagagaaattagatagatgaagggtgtgtggtcgttcccactccaccccacccctaccatctttgtagagttctaggatctccacagtcaatgaagagttgaaaagtactgccaagtcctaggttgcttttggttagaatgtgtgagttaaagcacatcataccttcagattactagacagagtttacatttcttcagagctcagaatgttttccacatgttcccttgttaattctcacaacattcctgccaagaacaagtattttgtgaaggaaagagatcactttccttggcaacaaactacaagaagattcccttttgtccctcatcttttctaaccgtcaagttataccttcagctaataaaatactgtaaccggagttacagtcatctcctttaattttatttggaaggtatttggatatttagctggctatcttcatgacagtatatttttatgtttaaagtgggcacagattcaatgcaatccctatcaaaataccagtgacattcttcacagaaatagaaaaaaatcctaaaatttatatggaacaacaaaagacccagaatagacaaagctatcgtaagcaaaaagaacaaaactggaggaatgacattatgagacttcaatttatactacagagctatactaaccagaacaacctcaaactggcataaaaagatatgtagaccaatggaatggaatagagaacccagaaacaaatccacacacctacagtgaactcatttttgacaaaggtgccaagaacatatactagagaaaagaaaatatctccaataaatggtgc

SEQ ID NO: 120638 - DNA, 1079 bp, Homo sapiens
gtaatacctacacttgtgtgttctgtctcctggtagagtcaatattcatggaaacatttcagccagtacatttaatcctagagagttgtgtcagtggctatgaactgtattgttcaatattacacactatagttggctcttccaaggaggacttcacatcttcctctgctctgtgaagttttgtttttgtttttgagagggagtctcggtctgtcacccaggctggagtgcaatggtgcgatctcagctcactgcaatctccatctcccgggttcaagcagttctcctgcctcagcctcctgagtagctgggactacaggtgcgtgccaccacacctggctaattttgtatttttggtagtgacggggtttcaccatgttggccgagctggtctcgaactcctgacctcaagtaatctgcccaccttggcctcccaaagtgctgggattacaggtgtgctctgtggcattttaaagggaggtagcttcgggtgtgagttcaactgtataattcacttttcaaatctttcttgttggtccttcaggtatagctcttccctcaggtctgcagtatcagcatttgaggcagaaaattagaaatttgacctacttatgtaatatgcaagttcccatcaggagaatattagggaagatataaacctttcattttttattagtgtttaatgtaaccattgaagaaagatcaaaacagtaaatctgtcatggcaaggaaaaagtatttaaataaatgttttaccttatgcactcatcatcttgggtcctgaaggagttcatttgattcctggggcaggggacaaaaggaatatcaaatatttggcaagattgcaaaaatttctctaatcaaaaaggtgccatctgaccatgttttgccacagaaagcagttctcaccaaagtttatcatggcatgtcatagtggctgtttgctgacagtgtgtgggttttggccattcagtggatgactgggaaagggaaataatctactaattgctttcccttgggttttttgtttccctggaagaactttaatcagtctgcttctattgtttatgttgaagaat

SEQ ID NO: 120639 - DNA, 1017 bp, Homo sapiens
ggatgacactgggcaatgataggatgatgtatgctgatgggttttactgcctcatcttgctgctagcttccaagacaagttgtattctctgttttcctgcttgctcatctgtctgaagagatggtcccattgcctctcccgccagcaggtgggctggcatttattcctcatacctgtgtctgcttccaaggcacccccctcgagaaggatcttcagaaatatttcataatcatggccgattaaagttgtaatcttattgtatagtctgccatcatagttacagatcacaccctcagaaggagttgcttatgtggattatagcaccagctgagacactgtggttaggcagccagtccagcactttactaaaagactgctgtgacagagtcctgtagtagattctgtaggaacatgcaaaagaagtgataaatgtgtatcttgcccctgggagcttacaccatagagagaataagtacagaaacaagtacaactaattccagcttttgcgagcaagagatgtaacttatgtttatttcaaaaagtgaagaacaggaagatagattatgccaatcattaggagcaaatatagtactaatgttgtatttttcttttcaagaattatcttcctcgtgaaatgcttagaattcactttagagtcatggggaatgatgaagggatactagaatgtggagggaaagtctaggagtaggactgtgttttccagtgaatggaaaacttcaaatgtgacttggcaatgcttttgagtagcacatgagcacctagtacttggaaaaactgagatacagctctgttcaacttcgagtgctcaacttcactaaatcacagtaatgagacctttgagataggagaaatctgtaacggagccacagaagaatactttttggaaagggctttccggtttgatccaggagtttatcagcattctggtacttcatgtatttgtcatttgtgcctttaagtaaatacacatctttatgtgtagtaccctcaaaacta

SEQ ID NO: 120640 - DNA, 1045 bp, Homo sapiens
aagaagcctaatacatgctaatcccagtagtataagctacataaactaagaattaatgttataggaggatccttcagtctataaaatgccttgccattgggttaatgtaaataggtttttccttttgcatataaagtaatacttgacttgccaaaaaaaccagttcctactgatttattcaggaatgttctgtgggtagtggccagtggaatagagaaagagagataaatctgattaagatatgtttgaaaagagtaattgacaggatttgatggctgattagagttggctgaagaaagactgcaaagtataaatctggagaactgagggaagaaagatgtaactgacagggaaggagtaggaagaaaacttgattgaaactattttcagtttctgatgagttaaattattatagtcctatagaaaattataaatatgagcctgttttagaaattgctaatttagaaacaatgattaaaactgtgcaaatgaataaagaagaagaatggggggtaaggactgtgtttcagggcaggaaagagaaagaggagccagtgagttaaggaagctaaagaaaggagaaagcttcccacaggatcatgaaagatgcatgagaagagggatcaggaaatgtgaggactaaggaaagctatggccatggctagcagaagatcactggaaaacctgaacgaagtttgtgtaatgtgtgggaaacgaaagcctgaaatcattaaagagggccttgataacaaggaaataaaggcagcagacagaaatcattcattatggagttaattgaaccattaaaaactagcaaatagtggtggttggagggagagacagggtcgggcattttttggtgtggaggtggttaaaatagtgaactattttgcccctactaaaatacaaagaaaagggatccaggaagagaaatagaaaagattagaggagaaatggaagaggcatacaagcaagactcagcagaggcagaaacccagaagggttatttctatctaagagtgtaaggaaggacatacagtcagag

SEQ ID NO: 120641 - DNA, 1053 bp, Homo sapiens
tagagtactgaacatagctgattctgctcccaccctgaaagcttgcattataagtcagacaggcaaaacatttggaagatgagaaacactcacgagtagggtacttaggcatcataggggtgggataatttacatgggaatatctgactttttgtctgtatgtgtgtttttgataaaaattcagaaaatttacttgaattagtgtctcattcatctttacccatttccccacctcacccctacactcagtgtttctccataaaggaaatctattttcagtctttttggcaaaggactcagggccagattaggttaacccctgggcaagtcatctatacttagagaccaaggtgttggggtacagcattattcgaagacttctagcttgtctcttccctccagacctgtccaaatataagtcaacagtaggaggaagtgcccacagttgcaggtactatccagctgcccaaaagttgtataattttataaggctgaatttaaatgcctctaggcttcacgtaactacagagtaggcaggagacttactctgtatttctagaaagtttaacttttttgtttgtttttttgaggcagagtcttgctctgtcccccaggctggaatgcagtggcgcgatctcggctcactgcaacctccgcctcctgggttcaagcaattctcctgcctcagcctctggagtagctgggactacaggcgcgtgccaccatgtccaactaatttttgtatttttagtagagatggggtttcaccatgttggccaggctggtcttgaactcctgacctcaggtgatccacctgctgcggcttcccaaagtgctgggattataggcgtgagccaccgcgcctggctggaagtttaacttctaaatgaatgttctaagaaaatgaaaacagcattgcccatcttaaacacagttacagtaagtcctcacttaatgttgttgattgattctttcaaactgcgactttaaggggaacgacaacaggtcctcagataacatcatttggttatgacgttatgagaaaaaaagttg

SEQ ID NO: 120642 - DNA, 1051 bp, Homo sapiens
gcctcacaaagtgctgggattacaggcatgagccaccatatacccagtctgaaatagctttacagtcacctttccttctgtattctgtagtgtaataccttttagaattgctgcacagggatgcctacccacagtggaatgaaacttaagtcaaccctttctctcttcttgaccacatgtatcatgacacataggaacgaaattgtgtagcagcattattttaggctgatttacagtttcctgtacttgtttttatttcctggttttaaaacctaatattataaaattgtttgaggaccagttcagctgtcatcaggttgactttgagacctgtctgtagcctctgagaatcctatttctttctttctgagaagtcagctttagaagccccctttcacttctgggacagccgaagatatcctacaagtactattgctgacagtcaggactaaatagttcactcagcagttataaagtaatggtcactggaagtttactatcttctgaagcggcagcctttgctgctacggttcctcaattatctgccctattggaaatgggaaggaagagagaggttattagcttttcatagaaactacgttggaactcctattcctgttttgaccagatacctgtttgttacacattctggtgtatgcggtactccacgagattagaagtgcatattcaactgcagaaaccggaaccagcatggggagtctaaatgttaccagataaggtttttagggcattttggttatagtgctaagcatttttgggaaaccgtaaagagggttaggataggtggtgggaatagaggctgacagcagttttcagatgtccgtgtgttcatgcacgcagtatggcccaggtaagttcaaaaccttattcttaggctatttcgatcaaccctgccaggcaattttaaattcttggtgatgtagggcagggacactgtggatggctgaggaaactctgggctctgctggctaaccagcttcgctccactctgcagaggctgtctcatcttttgtgatctgcaaattcttgc

SEQ ID NO: 120643 - DNA, 1032 bp, Homo sapiens
aagatgtaaccaggtctcctagtttacccttcagctttgacgcagactacctaatttcctaaggtcttagcatccacctgaaaaaaaagaaaaaaaaaaaaacagtaatatatgttagatgacttcacattcactcaagtaaagccaacttgtctaatctctggtaaatatagattactctgccatgctcttaacctttgtgggcaggaggctggattgctaaatgcatattgggtttgcttcagtatgcatcctttttaaatgttctaacatgtagtctcttggcttgtgcccaattccgaaagtctgcttttagggagatttgactttttctgttggagaagaaagccctgagctttctgcagtctcaacaggatgtaactttcctagagtcagctgggcattcagtttgacccactgagagcattacacttatgtgcccagaaaaatgactgagtcgactgtcacccttcaaaagatgaaggacaacaatgggaacatgccataaaaaagtctgggactgtttttgacaaagagctcttgtgttcctcctgcctgcttggatctctctaggaaagggtgagttgtactgttatttccttgaggatgcatggatgttggagagatgtttaactgccctgaaaggttttagaggggggataacacagtaatttactactgaaagtgaagactcaggaaggtagtttgagctcaaacagaacacttcttccctgcagaaaatctttttttaaatatatattcgcaatcttttcttccatttgccttccattctgtacaggttattaactgctgacaagaaattcacatctcataaataatgcttaagagccattgctatataaattgaatgtgttatgaattgtgatgggcctttttgtagcattcgatgcctagagcaggaagaacagaggatgtcattttcattaatttctaatgaggtgccaattaaaggcagggaagacgctccaaagggaagagtggccaagctcccctgaatcctccgccccaggg

SEQ ID NO: 120644 - DNA, 1044 bp, Homo sapiens
attgtgtggttacattcaattctgtgttgtctgtactccgcttgtttgtaattatgagcaacagcaaagcttcagttccaggagagtatccagtgctatcttggacatttctgggttacctctaagagtgagctcagcaagtgtaggctcctatgaataacggcaatagaaaggcactgttaggaaagtaaacgtgctactgcaaaaaacaggatacaccacaagccagacagcagtagtttttcagttgtgcccagtgcacttgtgttcacccaggtaactggatgaactgtgtggtgatggtgttctcctgtgagggggaggggcacagttactagcattaaatattgctagaagtaatatttttctgtttttctatcttgttgctagaagcaatatgtttctatttttaatgagtcaaatgctgactctatttatttattcattctgttcatctttattgagttgtagaggaagagcaaggggtaaaactgacaaaagtccctgacctcttggtgcttttattctttaggggagagatgcagtaagcaagggaacagataaacaaggtaatttctgatgggagcaggagatatgatgtaataaaatgacagtgtgataagggaaagggggagctgcaaatagggaagggggaggccagcacctgggaggacatgaaagctgagctgaacataaaagctgggagagccagccattcagagagttgggagagcagtgccctagacagaacaaaggccctggagggaggaacaaacttggtgtatctgaggaagagaaagctggccagcccggccagagcacagtgcgttgcgggaggagagtggagacgcagcagggatcagtcgggggcttgcatgtctttgcaaagaatctgattattgtaaacatagtgagaaggcattgaatggttttaagcaaaggagtgatctgacttaaattttaaaaatattcccctggagagccaggcacggtaactcacagctgtaatcttagcactggggacgcggaggtgggagtatcagt

SEQ ID NO: 120645 - DNA, 1096 bp, Homo sapiens
cctctacatctctgaaaagaagttgaggatgtgaggagggatgagtcagtttgcaaggggtggctgcctgttctttatggcctggatgagggcttaaaagaaagaagtctgaaaagagatgctgttggttggaaaacaagtaaggagagtgtttgcttgggcaggctgctgtgggatgcctgctccagacagggagaacaggtttaggaatggatctagatttacctggaagcttgctcctgtggacctgatccaggcccacggggcctggaggtgtggtgagataatgctgatgggatgagaaggtgatgaggagccagccagcactggcaggtgtcttcctagccctgatcttgttctccccagcgttttgaaagaggcggccagcagactctggggacctcagacgtctgtgctccacatgcgtatcggccgctctagagattgcctgggaagctggagggaatgggagacaccccggtgcagctgcgccctgagttctctgagcctggctcctggctccctgcagccctcccctccttgttcctgacccagagtgactttacctgtaccggctccctgctcgataggcctcttgatctttcatcactggtctttttctcttatttgccagaccagtgtctcccttggatttctctgcttcaaaaagagccttgcagcatcctgcgcttctgggagggaaagacagctggaggcctgagtgtgggcatctcaacctctctcacctacccagtggagtgaaggacagctgggggtccgagtgtgggcatctcaacctctctcacctacccagtggagtgaaggacagctgggggtccgagtgtgggcatctcaacctctctcacctacccagtggagggaaggacagctgggggcccgagtgtgggcatctcaacctctctcacctacccagtgcagttagaagtgtcagattccttggagatggcgattggagcccagcattgctgtctcctctgtttctatctaatactttttctagcactagaaataatccactttcctttgagagctcccactcatttttgggttgtggtttgatcactcccaccatcct

SEQ ID NO: 120646 - DNA, 1097 bp, Homo sapiens
ttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctc

SEQ ID NO: 120647 - DNA, 1050 bp, Homo sapiens
caagggcgccatggtcaccaccacccaggcaaagaaatgggaggtggccagcacccccacccttcacttttcattattattattattattattattattattttttttttttttttttttttttttttttttttttgagagtagaaaggcaacttcattggagcttttggggaaaaaagccttcaaagtcaccttctggcagctctggggagggtcatttggggtggactgagagtgtagggcaggtagggtgtgtgctgggcagcagctgtgtccatgcagccagcacccagcagggcagtctcacaggagccgttgtgagcactttggacttgaagcagctatgaaccaccccccgcccccaccgtctctccctctcacacacacacacacacacacacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccaggagtttttcctcattagtgcttgcttgtcggtgttattattttaatc

SEQ ID NO: 120648 - DNA, 1108 bp, Homo sapiens
ctatttccttgtcagcctcccaagcttaaaggctggatccatgtcaggaatgacaggtgagtaactcagccacacgagtgactattaactccagtgtccacaggttgatttgcttgtgtgcatttgtggcacttcctctgtggcccaagtgccaggatgagctgcatccgtgtctcatttaggagacatgcacgatgggtctctgtccccgcaagctgaaccgttcaaaaccaaggaaggaaaattatagcatcaaaagggattaaaactagtgatttgctgtttgagcatttcaaatagatccggaacacctatgattcactgagtggagaataactaaaacaaataaaaaatcatttagttgccagggcaatgtattccagcagaatgaacactctatggaggcccattcctaaagggtgcctccaggtagcaaaggcccaatggctttctcctccgcctgagtgtttgcgtgccatttttgtattccaacacaggcctgtctatgacttcctcctgttccctgcgcctgggctagattagagaggtagggtgttaatggtggacttgatgaagattgaagacccattttctcccccttgagacctgcctgatttggataaattgagaagaacaaagcagcccctttctgtccttgggagaaaacctgttcggtgtctgcttttgcagctaggtcggctcctccctggaaaggggcagaggtgggggcagtcaacagagacccctgctcagggaggagaccgtttcctgccgttgcccgagcccaccaagtcacaccaggcccgctgcctcctttattggtgctgccggttgggggagcgtgagttggagcctgggctggagggtagtgagctgccactaggcgcccgcagcgcatgggagtcgagctgctgaccggccaggctggtgtcccctgtccccgattcctcactattttcctccttctggctgctctgctgctctggacactcaaagtggacacagtggaacacctgggagagaaaaggaaaagaccccatgagtgaagggtcagcatgcggccctggagttgccgcaagttgggatactgccctgcccagctttgggg

SEQ ID NO: 120649 - DNA, 1403 bp, Homo sapiens
ttccgtggttggttaggtattttaagcacagaaagccacatcaacacatgactctgatataccatattaccatattaaataacatgaaatattactgatataccatattaaaaatgtatccttcaaagagggtctaattatccagctctttggagaggaaagatggcagagatagccaaatgccctccttagtgtttgaaacgatttataattgtatatgtattttaggtcatcatgttgcagaaaagtataacaaatgtttattggtggcttatatggcaaaaccagccaacagtatctgctttttcatctttttagtgactgctgagttcattttactgtaagaacacacactcatcttgagaccatctggctttatttattcttagtgaataaccaaattctgctattgtgttgtttcataatagctcaggtaagatgcatgacaacccagcatctaggtgatatgacgtaatggaacagttttaagtcagagactcagaaagttgaaagtggagaagtgaacctaggtgggtgattcagtaaagagagagtatttagtctaaaaaagaaaaagtgaggccgggcatggtggctcacaactgtaatcccagcactttgggaggctgaggtgggtggatcattaggtcaagagattgagaccatcctggccaacatgctgaaaccctgtctctactaaaatacaaaaaaaaaaaaaaattagctgggtgtggtggcgcacacctgtagttccagctactcaggaggctgaggtgggggaattgtttgaacccaggaggcggagctggcagtgagccaagcttgtgctactacactccagcctggcaacagagcaagactcggtctcaaaaaaaaaaaaaaaaaaaaaaaagaaaagaaagtgatagtaatgacttaatactatctgtccctctcctcatcctccttctgaagaaatagactgggcagcacttgggctgtattgctccttgctagaccctatacaaagagctagtcagtcattagtaactgtcagtatcaccaaacctggtacacagcctgggcgggtactccaaaaaagtatactggagatggtctttctaaaagtcaccctcataaatggattgttcttcccatatcagataaaatgccatgtagaactagaaattgtcattcaatttttatgcctgagaaatatatagtcagttgatcagttgggatttgagaataaaaaaaattaagtcaagctgaccagcatttccttcatgaagttgccccatcatagcctcagtatggctgtccttcttgtgagcttctgtccgtgccacacacacattcaacttcaggatttagaggctaggcaactagtggtagacattccagaccaggaaagtcagggcctg

SEQ ID NO: 120650 - DNA, 2123 bp, Homo sapiens
gtcatctatacgttaggccacacttggagacaccagttactcacacttgtttatggggttatgaagtacctaaagctgatgcttattttagaatagaaaatagcaataaggagtcagccagtcatacctgcacatttaaaggggacttatcttttgtattgcaggaagtttttattataaatttacccaaacattgggaggcatgtggaaagtagattttgatgctaagtatgtgaattgcctgagttctaaatttagagctgccagcagatcctgtggacccccagtgggaggctcctctctacccagaacatttggaagttaaaggagctagaaggaaatgaagtcctcttgggtagcaaatgatcaggaagaagaatctgagagctcctatttccttctttcttacttaacccaggagccacgttattctgtgagggtaataattttttccatgcctgttataaaaaaaatgaagcatacctcaataaaactttctcagtgagctgtgtgagcacacaaaatgtacatggtcagaaatttttattttattatggaaataactttcttattaatgttatattccaaatgattaaaaataaatcaagatcacatttagttcacctaccatcatcacttacctgttccactccactctactgactgacccccccacattccctctgtgccctcccatgagtttacttactataggcaggtggcacttttcaagcacaactctagtatcgtcctgcttaggaccctgcactgcttcctgctgctctctgaatcaagaacagaattctttgcgtggcctagagtgccctgcacaatctggccccctgcctctccatactccctctgcatccctctccctgttcccatctccctggcatcctctgttttcccaccatccatcatgctctgtcctcacacagagcctttgcgcatgccatgctggtctctgtctggagcccaccctctgccctttgtctcattaaccacccccacttacccttctcagctcaagggccacttttcaggaaagtttgccctgaccacccatcttgatcaaatcactgtgttatcccctctcataaaaccaagctactttttttcacagcccttgttgcagtttgcaattacccattcatagcatggctgttaagttactgttcttttgcaccagaaggtaagctccagagcagggatttggtgttttactcactctttgatccatagtagtagcctagcaagcacctaacacttgtaggggtcagtatgtacttgatctgaatgaatagaagcatgcgtgccattgctctgtctccagtcacgtatgcatgttggtttcatttgtcttgttactgtctggaggtgtcattgtcacaaagcccaattgggaagtttgcccattccagctcagatgctgtcacataaagcgcaaggaagagtttatgggagagaataagatttgcccatggtgatgtagtccttgtaaactacacatgtgtcttcctaacttctctttattaacccattattgatctgtcatctttggctcatttatagcattattccacaaattttaattcagtattgccagaggctcagttttctttggtttttacatctatcattgcccctcacgttagtgacttggatcccctggtaacagtttatcacttcaagttggttactggctggaagtccattacctttatttttaaccactcttagagagagtaaagtttatttttatggaggggccaagtgcttttaaaactcttttccagctgtgcccctttcagttcagaaattgatttgatttaaaatcccaagttcgtctggttaatgtttcaattgcttctctggatttttagagtaaaaggttaaaaaaaaaagcccaaacttaaactctgaagagggactctaaactgcctgccagagcatcacatgtacctctcccagcaggaaagagtctgttcaacagaacagacctcactctggaatcctagagctctctgtacctctcatggtctcaggatggctgcagagggtccagcctaccaccatccagagaggtgctcagtcagcacccttaccatgaccaagtcttgatt

SEQ ID NO: 120651 - DNA, 1041 bp, Homo sapiens
agggaaggcgagccctttaggaggccaggcgagagggtagcttgaggccaggagtttgaccccgcctggccaacacagtgagaccctatctctacaaaataatcttttgtttgtttgttttttaattagctgggtgtggtagtgtgtgcctgtaatcccagctacttgggaggctaaggcaggaggattgctttagcccaggagtttgaggctgcagtgagctatgattgcaccactgcactccagcctgggcaacagagagagaagctgtcctcccaaccttccccaacaacaaaaaaggtaacggtgaaggaaaacggaaaacacaggcaatcctagtcctcagtaatagctttatatgtgatactaaactgaacttgtgcaaaggattttcactgattataatcataagattaagggaaaataatacaagctacttttatagagtgataggttagaggttgtaaattgtgaaccagatatgtaaactgagagtaatggaaacatttggcagtgggattacagaaatgggcttttggtgaaggtaccaggttagaaccttgtatcatttccatcacttagttactgtatgagtttagacaagttacttaacatgctttaatcctcacactttcaatatctgtaatttcataataatagtgcttgctaagaggatatttagaaggattttaataagacgaattgtacagagcacttaacatagggcctaatacacagttaacattaaagaaatgttggccatcatgatcattattattgattgttttttgttttttgtttttttgagacagaatctcgcgctgtggcctgggccagagtgcagtggtatgatctcagctcactgcaagctccgcctcctggattcaagcgattctcctgcctcagcctcccgagtagctgggattacaggtgcccaccaccacgcctggctaattttttgtatttttagtagagacggcgtttcactgtgttagccaggatggtctcaatctccagatctcatgatccacccgccttggc

SEQ ID NO: 120652 - DNA, 1041 bp, Homo sapiens
agaagttgatgctgcttgctggttccccagggcaccctaaggagttgatgctgggtttcttggagaattcagactgtggattcttcatttaaattgttgacccttttttataaagggccacattacaggctgagtaccataggcaacaaatcacagatagagaagcctcgagtttgtacctcaggccagaccagcttactttgtgcttagggagggaaagagacaagccacatcagctacctgtacaaataaacttctgtcgaatagcaaataataccccaccttcctttctgtcatctgtatgcattaactaaagtacttgtaaaccatctatttagtaagctattctagaatttttgttaaagatgatgtgaaacctctatattttccattacaacctatccctttttactttaaaaatctggaaaacagttgtctttcttttgtcttctggcacccctgatagcctccacaatttcttgaagattaccaatcgtgtctctgagattacatctgcaatttctttcagtaggcttggggtgtaactcatctgagtcaggagacttgaaatcatttaaattgactagatactctctttgacttcacctatttgggacttcaattttctctttattatgtttgttctgacatttctaatttgaagaccagtctccttgccaatgaagattgaagcaaacgggaagtttagtagctctgcccactctcttttaatgttctccgttttccatttgcttacctggtaccccacacctccctccccaccaccgccaccatctaacagtgttctatgcgcatctcaaaccaagatgcctaaaatggaattccattatccttccctccctgttcaagtcacgtcatgtcatgattccccatctcattcagtggcaccatccatttgtccattacttgagccaaaaacttgggaatctccctgatttccttcctctccttcaccttcctctctcatccagtcagccataaagttctgtcagtacagcctaaacatctcacaaatccttc

SEQ ID NO: 120653 - DNA, 1132 bp, Homo sapiens
gttatcacacagcctttcaaagatccagcatgttaagggtggtttgctgtccagtttaatgtcatcccttcaccgaatggatgggctgcttccctccccctcttcctctcttgaaaggttagcctttcttcagaatagtacaggtttttcctgcaacatctgtcaacttggcaacgagcacaccctaaggaaattatgaacatttgaagaccatctaaatactgtagggtacctttccttctttctctcctctctccctcttctccctcctgcctttccccaagaagaatggagcagccacatggcaatgtcactgtgtgtctcactgataaattataagcctatttctgtctgtgattcgtttcatatgttgtgatttgcttattcctttgtgatagctcttgaaaccttaaagcagtgacgattgtaaaaggcagactgtgggaagaccccttcgtttaattaaaagagacctcccttagccactgtactgttagcacaaagaggctactttggtcaaatgactcagatgatcttgatctgattcagtaggtcagaaattgctgtccccagcaaatatcgatcagaaggaactgctttctcggttattctgaaactgccagctgcatattacactagcaggtgctaatagttttttgcaggtcggtagaattgttattggttcttcctttgcctcttatccttaaaggtggcttgtcccccatcttgtgtaatacccagatttatgaaatgctggtcccacctacccattccacatggggaaaaatctggctttctgtgtctggggaagtgccaagcctaggtcttatgcttctctgaaactctcaaaattcttttgtaaacattgtctaacttattctgtcaatattcataaaaaggcagggagaagaagggattattatctttataggtagagaaacagtcacagaatggttaaatggcttccttgacgttgcctaggaagctgtttacagaagtgaggttagttctctgaatgcctgctttctagtccattgccttgtgcagtggactttcaagcagaagctgggaagggaagagcagctgttttcctcccgcataattaatatgtagatatgatggaaagagagtt

SEQ ID NO: 120654 - DNA, 1040 bp, Homo sapiens
tcaccatggcgctcaaggccctgcatggtatgatgcctgcatatttgcttcattttataccaattctcatctagctttctgtattccagccacacaggcctttccatttcaaaaatacaccattcattctctgaccacagtgtctttgcacttgctgttcgctctggaatgcccctcaccctctccttatccttcctctcactttgtcaaaccccaccccttttatttaagatgaccttctgttatacctttaagtttcagattaatgtcacttcttcagaaaaggcttccctgaccccccctacccctagtcttggtaaagtttcttagtatgatgcttatagatgtggagtttttttctttcagagcacttagtttcatttgtaactatacatttatttacatggttcgataatagaagagcctgtctgttttgttcactgctgtattcccagcgtttggaaccctgatactcagtaagtgttgaatgaatgaataagtggaatgatgtgttgcattctgaggaccagaagatcaacccaaatcctggtttccactctgctgctgatttactatgtaataaataagacaatctttctgagccttaatttctaaaatgaaaaaaactaacctaatgagctggggctctttttgtttgtttgttttgttttgtttttttgtttttgagacggagtcttgctctgttgcccaggctggagtgcagtggcacgatcttggctcactgcaagctccacctcccgggttcatgccattctcctgcctcagcctcccgagtagctgagactacaggcgcccaccaccatgctcagctaattctttgtatttttagtggagacagggtttcaccatgttagccaggatggtctcaatctcctgacctcatgatccgcccgcctcggcctcccaaagtgctgggattacaggcatgagccaccgcacccagcctctttgttgtttttaaacaggtatccattaggtatagagaactgtgttaatcgtatatgccatccttagttttc

SEQ ID NO: 120655 - DNA, 1055 bp, Homo sapiens
atgtatatttggatattttatcttcaaatactttgttactctcttaacttatcttaatcagttctaaggactctggttgatttaaatgccttattgctaggtgacatagggaatggcttacattttttagaagtattcaatatagtaattccaatgaacttaaaagaatgaatgtaaatgttgtactagtgctaaagaattgaaaatattttagtaattcattcagatttgctatgtagggaatgtttgtgatagtcaggtgaagcccctcacaccaagggatttaatgataggcgagtttgaagagaagtctgtatgatattgattggatgttcagactttccatggctgtgcaggtattttggcctttgattggatatgagtggtatgcttagctgtggaggtatcttcttttcatggatatatgaattcatgtttgcccgaagtagcctcaagaaagttcaactcacaaaagtgcctccatataatttaagtaagaccaaagtgactgaattgtcacttttgaattgtcattgcaaaagtcaagttatttggtgggaaatactgcctgactgatatttggaaagaggattttaaattttagtgtaattgtttgcttggttgttttctgtcttgttttgtttttattttcagtaatgggtagtctgggcgttgtgcacagtccatcccaggtcttgacattctagataccatgagtggctttgcccatccagactgtttattctgcttttttttcccccatgcccataggttttcactcacctgctgcaaagatcatgcttagatcaattagctccttgattctgtccctttattgcagtttgctttgagaagggacttcatatgttccggtgtggggataagatgtccctgccttgtggtctaaaacagaattctgtacctttacaaagggactcatgtctcctctctttcccaagttttgttcatgttggcacacatgtccatactgacctaaaagcatgggaataactataatgggaaagatgagtgtaacttgcaaatgtttattaact

SEQ ID NO: 120656 - DNA, 1091 bp, Homo sapiens
ggaaattagttatctaaacttggaaaatctgattccatatagtgttttaaaaagaaagaacaggagggaaggaaggttattgcatcccttaggtcagcctggaatatattaaccttaagaaccgccattgggaaaaggccctgttagtcacttcctggctcttctgtgcacagtaggagagctgtctctcctttggtagagacttgagctagagaatagcgaaatgatctgatcaaattccactaaaccacattccctctattccctccaaggttgcagacagcagcactcaggctgacacagccatatgtagttgaaaaatgctatgctggttgagttcctgtgggtttaaggaaatggacaaaattagattcaggccaaggtgccagaattaatacaccccttcccttccagaaagcaccagggagattgtcactgccaaagtgaaggacaatataatctttactacccagaccggtaagaacttatgttgaatgaacctacccacccacccaaacccagtaaaatcaataccttctgtctgccttgagggcttgaaggaacagattagggccaaattcctgcttaaccagtgggctctggtacatgtagcagttgccctgattctcaacacgggaagagtggtgtctccttgcagtaggtgtgagcacactggacagtcagttcaggacatagcattaatattggttataaaggtgagtgatcagcttatgtcaaggagcagatggctaaatgaggtgcacagggaatgccgtgagagtcaagcttgaagaatcaggagggaaaatagcccatgatataaaaaccccaaatatagtttccttaatgtgaattttctaaatcagcatttacattatacagttaacttggactgatgagaaatgtaaggaaattaccaaattagtgaatagcgattaactcagaagtaaaattatatcgtctaaattgaaggttgttttacacagcagaggggaggagattactaaaaccttgtccagtctgtcatatcctaattgaaatctgttcatttaatataccccatccttcagagtgcatagttcataatctgg

SEQ ID NO: 120657 - DNA, 1031 bp, Homo sapiens
ctctaagtgcttgctgctggtcaccacacacacagccagcagccctcaaactgcagaaaaaccaataaaaggacctcactctcttcctcccccataaaaaaggaaatgcatgcttgcaggacatacagagaaacctagcatcagggagaaaaacatggagaagcaaacagggcaaaaataagtccagccaagagtttgtatagaatttgacagacctttgctatacatgttcatggcacatataagatccttatggttggaatggaaggcatttggatgtgtcagaggtagaaattgtgtcagatttgggaaaattgttggaaggaagactggagagaggcttatgtcgtctgaatggagggtacagagggaaaagtcaggaggtctgaacagccattctaggaccttctagcaccagatgggtaggccacggtctcagtgctgaaaacgacaagaacatagcccctaaaaagggaaagtaaacacagaaaagtattaatttgttgttcctgcaaatatggatgaaaagagttttatcctgccctgcttcatacttaaaagtgttatttttttcttgaaggatgtgtagattggtggagcgggattttcttttagttgctgtagcactgtttgatttttagaaaatgtgttatgtcagtccataccaacccactaaaaccccaactcacagctgcagaaatagcctgaggatgtgacaaattagtgttcctcatcatactgcgattaggcttaacatcttttaataatgaatgtgactccacatggcaagagaataaactagcagtttgtacaaagatattatcttccaggaattggggtgatacttaaattttaatcactttagattttggtttatgagtgagctgaggtgcatctaaaaattctctcattcaaggcccaaagacattggtttcattgttggcacatgtggcactgatggcccaggagatggtgaattatgtgcattttgtgattcccatgggacctgggaggagtggtgggaggaggac

SEQ ID NO: 120658 - DNA, 1059 bp, Homo sapiens
catatggctttggtcttatttatttattattattattgttattgttgttttgggtttttttgaggtggagttttgctcttcttgcccaggctggagtgcagtggcgtgatctcagctcaccgcaacctctgcctcccaggctcaagcaattctcctgccccagcctcccgagtagctgggattacaggcatgtgccactacacccggctaatttttgtatttttagtagagacggggtttcaccatgttggccaggctggtcccaaactcctgacctcaggtgatcctcccgcctcagcctcccaaagtgttgggattacaggcgtgagccactgtgcccggccaacttttgtcttattatcctagacttactatagtctctccctgtaacaaacaaatatgtacagatttatattcagaaacatagttgaaaaagaaacatgatttgattgtttaatttgaagtttgtaggaaggtgaatgtccaagagtaaattcttaagtgcttccttgttctacctgcaagcatcctttcttactacacaatatagaatgtcactttagagatgcatcaaataaacattttggccaaatggggaattgggaccagtaatattaccaacacagaggggacttttgggtaacaagagtgaattgggccagacgcgttggctgatgcctgtaatcccagcactttgggagcccagggtgggcagatggattgaactcaggagttcaagagcagcctgggcagcatggtgaaaccctgtctttacaaaagtgtataaaaattggctggatgttgtgcatacacctgtagtcccagctacttgggaggcggaggtgggaggattgcttgagcctgggaggcagaggttgcagaacaccaagatcatactactgcacttcagcctgggtgacagaacaagaccctggccccccactccaaaaaaaaaaaaaaaaaaaaaagagtaaactggaaaatgtatcccaaatataaatatcactataattttactacatttatattgatcagaattttaaaatttgaccttacatt

SEQ ID NO: 120659 - DNA, 1523 bp, Homo sapiens
tctgtgttgtagcgcagcacactctgagatatgtgacggcaccagcagagaggtattttcagtcacttcattgtaccatcaggaagaagtttgagtggcatatgatgacaatcagtgatagccctataacctcgtattttataattaccactagaatatattcaatatgtatgtgggactctacggagagagaaaggaagaaattctattcccagctgcataacataaagctgtatttttattaagagctttgactgacaatataaatcataaatcaccaacataaagcttaagacaccagaagccagagagaaaatataacctgtaaaatgtacaatactggtatagtttaatattcacagttcccaggattttaaagcaatttcataccaaattaagacagctgatttttttattcaatattttcttttttcacgtaagctagtcttcttgatcctttgtgccatttctgtgtcatgtcagctgacaataatcaatttggatatctatgcatttgagtaattcattcttgaaaaaaggtggtaaaaaattacagcacatttgttgtaaaaatatttgcataccatgaagtgactgtaaagcatagtcagttgtgaatgaaagtgaacacccaacgccatccagcatggggctgtatgtgtagtgcaggtgcttcatacgtgtttactggtggcatctttgatgctgaagggttaaagagagagtattttgaaatttcctgggtctttttggaatgtacaaagaagaaagtattgcatttgcctgtttttttgatgcagtaatgtatcattaacaatttattgtggtgtatcaagccatgaaacagaacacatctgagcatatttctctgacagacaaaggtgcagattttatgtattgagttaaaggaaatgaaactttcccagcaagggtaagtagaaagaaatttggccatagatataatatatgtctttaaaatgtggtgaaaataagtttaaaagattctttgttaaatcctcacctctattaattaatcactatactataaattatcacagatttcctgccagttaaagacagttagaagatctagtagagagtttggtacattacatagagctaaaaataaattattattgtcctgttgtcattttccccctttgtttaaaatgctctcttgctagtataaaacctgtggtataacaatactcagatttctttcttgagaaagggtaagacagtggatcataaagcacaatttgttaacctctttttaaatgtagcttttgtaatgacactttaatatttcagaagtcctgaaggtttaactttagttttcagtttaaatgaccctcaggttcttggtattagtatttcaaggttaaagtttagaaacagaataggtgtttttatacatatacaaaaaactactggccaaaggattgatggacactgtcattttcaacacagttcatttgaaaatggccatattgaatctataaacacactaaattcagttgata

SEQ ID NO: 120660 - DNA, 1910 bp, Homo sapiens
ctgcctccgcctcccaagtacctgggatcacaggcacctgccatcatgcctggctagtttttgtatttttagtgaagacagggtttcaccatgttggcctggctgggctcgaactcctggcctcaagtgatccacctgcctcggcctcccaaagtgctgggatgacaggcatgagtcactgcgcctgtccaccaattatttctctttggtctttttctatagcactggtacctgaagtagtacctaagcattagaatttcgtatcattttcctttggatacttcctttgggctctgtgtttcctgagaatggactgagtgagggagggatggtagaaatgctactgcttttagccttagtttttcggacaaagaggggtaaagacaaaattaatttggaagcctgttgttggtaagacttaggaaataataaaagatgttccctctttgcatatattctttttttgttgattctacacagcaactgtttactttggagtatttatagtttgtatgttcagtggtttttcagggatttttcttgttaagccaacatgcaaatatagtgaccttaacaactatatctcatgatgtaaggctaaggtgtcaatgtggcagtcttggaattatttcaacccgagcaaaggaaaaacaaacattggtgggttcatcccctatccagatcacaaagctttggattctttttggattctcttcaatgtatttaacctttaagcattagaatagtaggcaaaggaagtaagagaatatgagaactgtttttttggttttgttttgttttgtttagagacagggtcttgctctgttgctggagtgcagtgtcacgattatagctcactgcagacttgaactcctgggctcaagtgatccccctgcctcagcctcccaagaaactgggactgcaggtgcatgtcactacacctaactaatttttctattttcttttgagatgggggtctcactgtgttgcccaggctggtctcgaactcctggcctcatgtgatcctcttgcctcggcctctcaaagtgctgagattacaggcatgagccaccacgctttgccagtgccatgattttaaatcgtgtccttcaagtgttagtaagtaaagtggcctaattttaggttatgtatcagctgtttcattgggattccttttttaggaaaaataaattatctccaaaaagaaagcaaaaacagctttcctttgatctgattatacatcagagttgttccattgaggaccttgaatgcagggattcttgaatttatctggatggaaaggcaagcatgatggattttgttagtcttctaattgaatccagttttgataattatttccattgctacttcaggatttacaattgatcatctttatagtcatgaacataggaaaacattgtgaaaatacccatggaaaatgaaatagtttttggtttttgttgaaagcagtcacttagctgattttgtcctgcatatttccccacatttaactttacccaacttagctccctttttccaagttagaactgaagtctagcacattgggaaaatgacttttattaaatgcatgactagaattcttcaaaaccccagctagactctgcaaggggctgctgcaggttgcacacaggaagaactgtggctggtctgcttctcgtcctgatccgggcatagccaggctggtacacaggcatactggataagtaattggtcttaaatataacattgcaaagaactagaactcaaaagtgattccctactgaaagaacttcctcttttattgctctgaaatgatctttcaatttggcctcattctgaaagttgccatttgaattggactgggaacaaaagttagaatttattgaaaacaactcattgcttaatctctg

SEQ ID NO: 120661 - DNA, 1029 bp, Homo sapiens
tttttcattttttatatttaagtctttgattcatttggaatttatcctcatgtacagtatgaagatggatctgattttttgtttgtttgctttggaactaaagcacattgagaaagaatgtatccgattttatctttttccgtatggccatctggttaacccaacaatacttattaaaaagcccatccctgatttgcgttgttgcctctgttaaataataaacatacaatttcaaatgtagtttggctctatatcttgggttttctactccacaccactgagcagtcgattcatgtgccaatactacattattttatttatagaggctttataacatgttttaatatctgctcttctttttcagggttttcttggctattcttgcatgattgctcttctaaattagccttataatcaacttatctaattttgatggggaatgggttatggtattcttactgagatgttattaattagaattagagagtagtggcatcctctgatcttgtcttcctctccaagaacacggcgtgcaagtctactttcatgccatgttcttttttatgcatgttgcccctcagtttgggccaggttgagtatggagagttggtaaggatattcaagtagaactacctggtcagcaatcagaatgtgggacaggaggtcacaagagagagaggttggactggagatacatgcagggaaccacttgcatgaataatatgtgaattcatgacatgatattttcttgtttttttaaattattttttatagagacagggtctcactatgttacccaggctggtcttgaactcccaggctcaagtgatcctcccacctcagcctcccaaagtgttgggattataggtgtgagccactgtacccggccctcgtgacatgacattgcacactgttgcattgttaagttagtcattcagtatcattctctaaggaacttcctcactgaagatgtttaattcataggtgttacatgaccaggtaatattttcatgttttcttatcaatgaa

SEQ ID NO: 120662 - DNA, 1037 bp, Homo sapiens
ataaactttttttaaaaaatcaatataaccccaactgtttttagtggaatttaatcagcttattctaaaatgtataaagtataaagattaaaagtagccaagttacctatgaaggaaaagaatgggttgtaggaaggggcacatgagggcttctgagatgctgggtaggagttcattttacagtagcttgctaagttattcctttatactttatccatttttgtatatattggttctatcacagaaagggtgtttgactaaatcaatattatgttctagctgtaccataaaggagaaatgaaataattagactagaagggtgaagtgctccagcagaacccagaatgctccccagaatgatactaccccccatgaaaacccctggtttagaaaattaactttgtacggaggtttacaattgcatttgaaggcactggctttttgtttaatgaattgaaaaactgtttttaattagttatcctaaatcccttatgcttcattctgaacctgttatcagtgaacttaatggaatccaagagtaactgatcattactttcagtcacaaacatgcatattttttgccaagttttctgcatttcatatttatactctccatttacttttctttctttatttcttttgcattactgatgtaccctgtacttgtcattaatgaacttaattatttcattgataatttaaccttggtcagaacttctagtgtctgctaatgccttactgtttgttatcatctcaaaattcagtagagtcggcctctcgtccatttatctggtcatggatgaaatgttagacatagaggatgattatgactagctatattactatgaaccactaaaatctgctgctccatgtgcttttatcctgaggccaatatacggaagcctgtctttgagatgggctgtcagcagccttagacatacatgtacaaaggaagaccgaagtcaggcttaagaattattaaattattagtagataaaaattttgaaaccaaaacacatgtttaaaaacaaatgaat

SEQ ID NO: 120663 - DNA, 1034 bp, Homo sapiens
cacatgcctgtaatcccaggcctttgggaggctgaggcaggtggatcacctgaggtcaggagttcgagaccagtctgaccaacatggtgaaaccctgtctctactaaaaatacaaaaataagcccggcgtggtggtgtgcaccagtaatgccagctgcttgggaggctgaggcaggagaatctcttgaacccgggaggcagcggttgcaatgagtcgagatcatgccactgcactccagcctgggcgacagagcgagactccatctcaaaaagaataaaaaatttaaaaatatactttttataacttttataactcattcagattcacacctagtaggttgagagatctacctaatgtttgtggcccataattgactaaacatttacaatgagctggagcattgtcattgagccagttgttgggcggtattatattttttctgtatcacagagaatttcccaattgcttccaaatttgtttcttataaactgaatggactatatgaccttgtatgatgaattttcagtgaacttatgctatctgcttgctgatacctgaagtttctttaaaggaaccagagacttttattctgcaatgagaagtaaaagcctacagtgcagatgccttggaaatataatccacttgaaactcattcagtcattcacaagttttcattagtcaatgaatgagtataaaattcatgctaataaccatcacttatttagtttatcctgggtacctagcctagatgctttgaatacatatctccagtaattcacacaaaaagttgaatgccaggattattttcattttgcggagaaggaaaccaagcctctgaaaggtcaagtaacttgcccatggtcctgtagacaggaagtgaaaaagctgaacatggcacgggccctgtcgtgaactacttaaaaatatagtcgcttattcatcttagaccaccaagactgaattgaatttttaattctgaagacattcttttaatgcattgtatctgccttaccattttttactatatgattta

SEQ ID NO: 120664 - DNA, 1050 bp, Homo sapiens
tctactaaaaatacaaaaattagctgggcgtggtttcgcacgcctataatcccagctactcaggaggctgaggcagaagaattgcttgaacatgggaggcagaggttgcagtgagccgagatcgtgccgttgccctccagcctgggcaacaagagtgaaactccgtctcaaaaaaaaaaaaaaaaaaaatagaattggggtagatattattgcttcattagtttcacatacagaagattctatagcccttcttctcagtgttggaaaataaagtatttatagaaagtagcgtgggagatttggatttaagacaggaaattggaatgtgtctttttgggtgttcctcattctactgcttatgttgactatgggcaggaatctttacctcttaacttcattttttacgtttattgaaatggtactttctatttatctacttatcagtactaggcagattctgtataactttcagtttcaggatacttaaggaatttatgacatttcatgattttgctccaaattgttaactttgtacttagaatgttaatattgaatgtccccttgggcctatggttataccagtatactctctgggctgggtgaggtggctcatacctgtaatcccagcactttgggaggccaaggtgggcggatcacttgaggtcaggagtttgagaccagcctggccaacatgatgaaactccatctctactaaaaatacaaaaattagccgggcgcagtggcgggcacctgtaatcccagctactcgggaggctgaggccggagaattgcttgaacccagaaggtggaggttgcagtgagccaagatcacgccactgcactccggcctgggcgatagagtgagactcagtctcagagagaaagaaagagagagagagagaaaggaaggaaggaaggagggagggaggaagggagggagggggagggaaggaaggaagggagggaaaagaaaagaaagaaggaaggaaagaaggaaagaaagaaaagtaggtctgtgagtttttttggtgcaaaagttggctgtttttt

SEQ ID NO: 120665 - DNA, 1086 bp, Homo sapiens
tcctacaggaaaagtataagtgcaaattactttgctaacttagtactcaatatcaaaaaaaattctagatttggccaatgctgtattagaaaacccaaatctcctggctccctgaccggtgttatatctactatagctcattatctgtgctttaaaagttttataaaatatacataaatgtttaattagtatatgtggtacagaaggccctaatgcattataaagtagacattcaacacattaaaatatgtctattatgccataaatttgacatacctaaaagtaatatgttactataatatacactaaacatttaattaacattagtgttgcttgctttttacaattgtaagggacttgatggaagaatttaaaaagcttatctaagaatgtttgaaaaagaaagttgtccagaagtggttgtgttctttctgaaacctattccaaacaggccttccctcatcttacaccctcaaactgccgttgtcaaggtcaccaattattaccacagtgctgagcccagtagtctcttccgagtccttgtcttgcttcacttagcagcagcactggattcagttgttaacaccctgctccttgaaaaatgtcatttacttgacttccaggacacctctcttctctggtttcctcctatcccactggctgtttctacttagtgcgttttgccggttcctccttctcctccagcctctaaaactgaagtgccttggccttcatctgtgaccctcttttcttttctatacataagcatgctcaaatttggtgacctcaatcaagtctcaagggctttaaactatatctatgctgaacactcccaaatctatatatccagcttggacttccttgaacccaagcttcataaattcagtggcctacttgacacttttacttgaatgtttaataggaatctgaaacttaacataaacaaagccatactcctgagctagcctctacaatcccccatcttctgcagtcttcaggagtttactagatagtaattccaatgttttgcttaggccatcattctgtcatatccctcttcttgactgccagcaagtccttttagtt

SEQ ID NO: 120666 - DNA, 1054 bp, Homo sapiens
ggggaatgacacaagcagatttgtatctttcaaaaccgctccgttttgaagaatcatacccctgggcagaggtgtggagtggattagagggagctcagagtggatggggagaccagtaaggagactgtttagtaattttgatgagagaagagatgctagctaggaggctaaggtcgtagcaacaagggcaggagatgtaaatagatttgagagatttagaaggaagccagtttaggacttggcgattaattggatgtgtgcatgtgggtaagaggtggaaatgagtgagcgagagaaagagagagagagacaaagagagtgtgttcagggccaacttcctgatttctggcttgagcagctgcctgcttgctaatccctataatgagtgagaatggtggagaagctattttggaggagagaggaagtggtagcactgtatgccctttatagtgggaaattgggaaatacgagttgatatgccagaataaggggaaagtgagacaggggcagggcatgcattgtgaaatgaacatgaaaacacatgacagaaacaagtgaacagttaggtgataacacatctgtaggcattgaggtgtggtaagttgagccagggaaaacatattctcaccccttcacctagaagcaagaccagcctaaactaatcttaagtgtgttatatattggcttcagaggacatttgtctgtcagtgtcagggtttcagtctctgttgattcccctcacagcagcctgaatttttcttctctgataaagttagtatagaattctagctttgtttgttaaattgttcatgtggtccattgtgttacaaagtcataccaccacaatccatttgcctgccaagtcaatacttgcttcacaaacatagcagaaattaagatgattctgtctagcttgagtttcttacaatttttttttaaaaaatccttgatccttttatgttttaagagcacaaatgggccaagcgcggtggctcacacatgtaatcccagcactttgggaggccaaggcgggcagaccacctgaggttgggag

SEQ ID NO: 120667 - DNA, 1135 bp, Homo sapiens
actagacagtctgacttggaggagacttcactggattacactaactctctttcagactgacacatcttacattaacttgataccactggttggttggtcacttcccttcctggtagactttgactttctccagccttttattaaactcttcagattaactctggtcaaatatgaggatagtcaacagaaaaatagttaagaccaaagaatcctatcaaggttttctctcctatggattgattaagaaagtaatagcctgcagatgttactatatcagtcagaataggctaggttatactgtagttatagaccactctaaaaatcttagtgccatatttctcactcatacaacaaattcagtaagaattggtagggtctttgttcattgtagttactcagggacccacgctgacagagactcaatacatgcttccatgatcacagagtcaggggaaaaagagctctagagggtctcactctagcaattcaatattccagttcagacaggactcctgccactcccactcacaatttacatggccccagccagccaaagaggaataggaaatttagtcttccatgtgtccagaaggaagagaactggatctagatatcagtaagtagaaataatgactctaattatgtatgaataaatgaataaatcttcttttagttagtgaaaagttaccatgggggcaagtagctttttagcactgtatttgacaagtcagcccatttccataaagctgttttaacatttaaattgtggcatacacttaatataaaaccaagtaataataatagtagccaacaccaacataacagtctgtataatcctcatagcagccctatgaaaaaggtaccctttttatccccattttatagatgtggagtctgaagtacagaggggttaagtaagaagcccaaaatcacataattagtgagtagcaaagctaggattttaacttgggtggtctggctccagagtccaagctcgtaatcactaggccgtaggatactttacattttttcacaacaaccattttccttattaatatttgttaactaattattctatatgctataagaaagactccagttctctagaggaagagaattgaagtatcagcagtgg

SEQ ID NO: 120668 - DNA, 1051 bp, Homo sapiens
atcaccttcctacatctaagtcatatcattgttttactttcaataatagtaacaagaaatttatcatttttctccccttgttttacctatttcacttcatggcaccccttttgtttcttagtcacatagacctacaatttaaatcagctttgattcctttctactcttcatatgtttaagcagttgccaagttcttttcattcatctctcataatttctcttatattcatcttttttttttccattctcattgccagcatcctaatgcagagcattatggactcaggcctaaattattacatctttaattgatttttccaacatccagttaatttccttctgatccatcctgaacatcatcactagatttatcttactaaaacacggtttttgttaaacttagcaatttcaaagtttcaaaatgattgcaatagtaattgaagttattaatgttgttaagagacagcatagtatagtggtatactgtattggctttggaactaaatagatatgggttggaatcccaaattaatcccttagtagtggtgtactcttggggactgagttacttgacctttttggggcataggaatcctcatttgaaaatggggagaataatatgatagtcttataaaaattaaccacagtttgtaaaatacatagtttagtgacatcaattaatgatagttattattagtagaagtgttgttcctgttattgttatctgtgaggataaaatggagaaatggaacagggagtagaggatggaaccaggtagaatagttccaattaaaagcgttaggtaaaagagctcttctacattggaagggctgaggactttttaaagttttcaaagaatgaggactttaaaaaatttgtagttcttaagatgctcacattgtaaaatatatcagagtcttctctcctcaagtacactacagacagtatttttcaggtacatgaactaaaactttgcaaacccaaggatcaatgaccactggttttgattattagaaatttgatggttacttttcagagtgcagttcataga

SEQ ID NO: 120669 - DNA, 1034 bp, Homo sapiens
gctggggatcacctgaggtcaggagttcgagaccagcctggccaacatggtgaaaccgtgtctctactaaaaatacaaaaattagccaggcgtggtggtgcgcacctgtaatcccagctacttgaaaggctgcggcaggagaattgcttgaacccaggaggcagaggttgcagtgagccgagatcacaccattgcactccagcctgggcaacagagtgagactctgtctccaaaaaataaaaataaataaaaaataaaagcatggtcagacttttatatagcatgaattacgctttgcctggcatctttgaaataatacctttaatagaacatttgatgtcatataattaaagtattcaactggcaaagatgctcataaaatggcctttttttgtcatacttaaattttttgtgtattctcatttgttataaggaggggggaaacagaatcaatatattcttcaatttaccattattcatataagtggtactttgccatttgccatttttcaaataatccagatgaccttgcttctgaccacaaagtgagattttgtgtgtgttgtttgtgtagaaatatgttgctacagtgaaaactcacagtatattttgaaaactgctagaatgatgtcaggtatctttggttagttcttcctgttagggatctgtctattctagtttttgctgagttatgatgttacatttttccttccaataaagctagactgttgaggaggggaatcttatatcatgataggattatcctgagcttttgtttaggctattttctaagccttttagggaaggctatttcctgagtcttttgggaggacaaatcaaatgtggaaggaatgtagggcagcagtgcagggactactgggtccttttgcgtttttaggaacatgaggagttgttcatactcagattatcaaatagaaaatattcagtctcaatttaccctggttatctgacatattagcttgtaaactctaatgaaagaactcattttgcaggtaggaatttaaaattagtag

SEQ ID NO: 120670 - DNA, 1160 bp, Homo sapiens
ggagtgaggctgagagaagctttgctcagagagaggtaaagcaacctttgaggagggatatagaaactgtatttctgtctgtaaatgttattttattaagaaagttttatattctaaggttgtgatattcattcattggttcattcaccaaatgtttgagtatcttttctgggtatactctatatagtagatgatttgatctcttttgagttgaattttaaaggactatcctagggaaacttgagagttacagaggagaataaaacatgatttctgccttcaaggggcttacagtttgatagatgcaaaataataaagcagtatgtattaagtgaggtaatagaagtacaaatgctctaggattttagaggaaggaagcccatatttgcagggaaggtttccttacgatatttatactaggccttgaaagatgcctgggatttctttagacagaagaggcagagaaatgtatttctggaaaaagttacaggagtgagaaaggacatatttaggaaatgacaagtgcttcagtttggctgcaatataaggtgtgtgcgaggtatgtagggaatgttaggaaataaggttgatatataggttggggtcagaatagaactttgaatatgccatgcaacaagggttgaatttacatgatagttgatcttgaagactgaaaactaggaaattacccagtcagaactgtgctttagaaggatgtgctgggggactgggcatggtggtttacacctgtaatctcagcacttcgggaagccaaggtgggaaaattgaggccaagagtttaagaaaaatgtactggaaagccatgagtaaaatagattagaatgaaggatagagggtacagagaaattggaattcagaaattctattggaattacctataaaaaacaaaggtagagccactttaaacatgtgcagtttatatatgccagtaatacctaagtaaggccgtttaaagaaaaaaaagtaagctatgataacgaggcactgaacttggaaagatgaaagaaagttcagatttgaatgacattttggaaatagaatctacagaggaggatggaaagagtgaagaagtaggagtggagtcaaacatgatgaaatttttaagcttgggtaatttaggaaaattgtggagccagaat

SEQ ID NO: 120671 - DNA, 1063 bp, Homo sapiens
gggagaagagctcttggagggagctgccatagaacagactgggaataagaccactgaatctagagccatcgtgtttccaggcctggctcagattctctgagactctcagagaatctctctggacctttagaactcagtgttcatttcaggggttgagctagacctcctctccacttctcttccctgccctatcagtccgtggttcaaactgggaagtatggcagcagcttttggctgaaaaacagcagagacccaagagatcatgggtatgctgttcttctcagaaccaaattgtggcccttatattggaataacttgttcattctgggcagtcaacaaatattacattcctgtataggatgatgctgtgcgtggtgctgtggggaaggacaaaaaaccagaaaacagtgaattggacagagaagatgagagctaaaggcagcatatgttgtgtcagattagtgctttgcgtagtaaatgttgagggcaggctttgagatgctgagggaagcctcacagacccatagctgcagagcaggaatatgctatgttcaggcaatggtggaagctgggctgtaggaaacacagccacagatttgaacaaagatggagacagcaatgtggatccagctgaagatgttttttccttttaaatgtaactgttactaggagattttctgagaatataagtattactattgaagaaaatttggaaaatagaaaaagattgagatggtaaaaatcacccataatcttatagtccgtagaccactaattcagtacttcattttacttctttttggccatgtgtatatgtatgtattctttttaaaattgaacttcagatcatattatgtatgttttatattctgcttatttcatttaacattgttttacttttccctacattattaaatgttccttgaaaacattttcgaggggtgtatagtgtttcattatatagaggtaccataatttgacttttcctatattgaagcacatatagtttctgttttgctgttgtaaataacgctctgatgaatattcttgtatataaattttt

SEQ ID NO: 120672 - DNA, 1077 bp, Homo sapiens
aaatgggattttttttttcttccaaagattgtaataactttgccattgtaccattaacatagtcaccacctcatgtttgtcatgtaaccaatttatgtttttactaacattgaggaaatgattttttttatgcttcctcctttctatctttcaattttttcccatctacactgtgtggattatcagataaacaggaaggtcagtgctcgcttaaccagggtttggccagtgctcagtgggtgggaagccgtcgggagaggagctggaggggttgtgtgtctgaacccctgtgctccacattgggcgcctgtcaggttccactgacttttcattgtatatttggaaactctttcatagccagagcaaagcccagggaaatctctcctcctgtggtgttggtcgcgttcttgtagtttccatttgataacagcatagtttacagagaactttttgagcttttggagaactcctgagacttattttgtctttgcctgcagccaaaataattgaagcattgtcagtctatttcagcagcacttcttcaggtagactgtgatactatttgggatgttcagatagaccaaagagaacacagattgtagctcctcctggagctataatcctggttttatatatgataaaagtgaaatggaattttagctcacaagacataccaaggcgacttggtcattatatagtagcagcctcgcttataatttccagagtttcctctgagttttaatctggcatttgtttcttcccttctccaaggaaaacaggagttcttagctcttccctgtagcttctgaaataaattcacacagaatttgaaggcaagtgaagtaggtcagaatccttccggaagccaagaacccacttatcttccctcctttagttttctgttttgtctgcccatgcacatttcctcttaggtcctctaaggagagtatgggaagaaagggagtcaaattcaatgatgcagaaagggtcagagaaagtggttgtagatgactgatgagatttgacaccatcctcactgccggccatgtaattctctaaaaaaaataggagacaaga

SEQ ID NO: 120673 - DNA, 1004 bp, Homo sapiens
gtctgtagggtgttgggaggaaggtatgtttagcaatgagggcagacagatagacaggagccatgtcctacagggacttgatagtgtcgaattctaaggatgatgggaaaccatagaagggtttaaaccaggtgatggtagttgagatttttgaaagataactctagtgtgatctagtgtgagaatggactatagggaagaccagacagcaggtgggcaaggaaaagtgaatacaagagactgggaaggagctgccagtgaggcaggaagaaaacaaggacaacattttcatggaagtcttaaaaagtcagtctttcggtatgaggaggggagatgggagagggcagtaggtaacagaaaatcgactcctggttgtagcaagatagagcttagtggcgtcctttaagagccatttcagtggagtcaagggagaagggaatagaggctgagggaataggggtagcaatacatgtagaagataaagtatcactgggaggggaagcagagaaatgatgaagaggatggagggggacctagggtcaagggaggatgatgttaaggtatgtgtgtgtgtggactggaatgataccacagggagggaggatttgataatgcaggagagtggatctttgtaggggccgtgtacctcattatgggagaggggctggatctctagctcaaggagaagattgactttaggtagaattgaggttccttcttttcctgtaacaggaggaaaggcagagtatgtagaatagatgtacccagattgaaagaggcaaaaatggaagccttaccttcatgttgacagtgcttgtgccttggtgggtctttgtggtatatcatggcctcaagctctgtttttgcaggtccactgagttatttgtgctatatatattcttttcctacccaggccatctatctcagatacagatctgtttacatgtctgtctcccccactaaactggcatctcttcaacaagagtagttatctttgtatctcc

SEQ ID NO: 120674 - DNA, 1062 bp, Homo sapiens
ctcaaaaaaaaaaaaaaaagttgcaaggaaataataaaatgttgaaaatattttattattggatggagagattatgaataattattctctttttttgaatttccttattgaaaaataattttcttaatgaaaattctataatgaatgtgtaccacttttgaaattcaaaaaagcattataaaaaaagaaacattaatttttcttaacaaaatgggttgagacttcaccttcagatcacacattctttgcagagctgctggttttcgtctgacgttttaaaaagctgtccaccacaccttggtttgcagagcatgtctctgtaataaggtaaaggcctcatggcacagtgagaatagacgtggcctaggagcccggagacaggactgtgctatgccgacacatcgcagcctgaagtcactgcctcgtccctgggtgtttcttcatttacggagctagagaacgttggtccatagtttctatacggttccttgcagctctaaacctggataattctgattcttccccaagcttctcagcatcttctttttctttttttgtcccctaatatcatctcattgatgctaagttgggaggctagatccatttgaaaatctgactctgggaatctttgttgttgatattaaaaaaaaaatcccttggacacttaaacctgtaggggctgggcatggtggcttacacttttggggggccgaagtgggaggatagcttgaagccaggaggttaagaccagcaacacagcaagacactgtctctacaaaaaatttaaaaattagccagaggtgatggcatgcacctgtagtcccagctacttgggaggccgaagtgggaggatggcttgatcccttgtctcaaaaaaaacaacctttagggaattgctttttctaactagggactttattctctattacacctatttcatactttgtgcacccatttttaagatctagagcagaggtcaacaaatgtttttggtaaaggaccagataataaaaatttcaggccttgtgggcaacataaagtctctgttacaaattattcttt

SEQ ID NO: 120675 - DNA, 1649 bp, Homo sapiens
agtggtccggggcttcttgggttttagaatcaaataattttgaaattggatggtgtgtagaaatagtggtgctcaccacaggtttcatgtgtccccttatgttgcccagcctttgttgctattggatttgggctttgtgacttgcccaggccaacgagctatgagtggaagggatacaggacacttctgagccaaggcatttaaaagctagtattcctcttacatccttttctgggttacttcttgccttgttttttttttttttttttagtactagatagaaaaagatagaaccatacaaattttgaaatatatgtgtctctaaataatgaaagaaatttagcttatgtgatgtagaactgtttagtacagtctgtgaagaaatatgcttagcattctcttgcccatgaacatggagtgtggatggcagagtccagctctggtgttgtgactcatccttgatacctcaccagtcctggaacaacctagttgtggaaaaactgggataggttggatttggttttagatattatagacaggtgcgtcaggcagctgaatttgtacagtaaaccacttttgtaaatgatcagatttctgtgtctgataatttgttgggaatcacttggatgttggttgtgctggaaattcttattaatgtgaaagacactttatagttattgtttccataaagccaacaagattcaaacataacagtattgagaccaaggggcatctcagccttaaatccatttttcagcatgcctaacacacattattcttattaaatacctctttctataaacctagctgttgctacctcagtgggttgcttgcagtttgactgtagcctagcttgcttaattaagacttaaaataataccttcggttctgcctgggacttgagagaatagccagctctgaagcctttgcttgctgtaatggttgctcagtagttggagttttgtagcaacaaggtttggaaatcctctaccatacaatggtttttattgttaataggtctagttgtaagtagtcatcctttttgacatcagttccttcttgctgaatactttattcttctcagttttcttttcctccctttcatcttttctgctctctcctttcctccccttcactgcctttctcgttctctttctttccatatcatgaactggtaaatttgcaaaaagggactccatactgctgccatgtgtagggtccgggaaacctgatcattttgaagagctagcccgttctaatgctatggttaggaaacatcttactgaatgttgcatcttttgtgatgtgtgaaattccagaggaagtacagtttggggaaaaaaagtgtatccttgggacctacattagagaatataaatcacaaatcaatatacagttcagataatactagatcgtatacagcaactgcctgtgacagcagtgggaggtgggaaaagtcccctccctgtgtgcattttgagaaatacactgtttttatttggtacagttgcatattcatttctaacagactgcatcctaaaagaattggacttttatagattccatgaatattcagagagtcaccaaaaccaattttgtcctttaccttatgtgtctagacccatctgtcatttgcttgctagatggtc

SEQ ID NO: 120676 - DNA, 2788 bp, Homo sapiens
ttgaatcccctttacaacatccccatctggcaggtgtccagcatcagcatctctagggattagcagagttcttgacaatagaaaccagcttctcattgacaccaggatattgcagattgctatctctataccagtagttctcaaacttttgttcccaggagccctttattctcttaaaaattgttgaggaccccaaagagcttttgtttatgcaggatatgtcaatatttatttgttgtcttaaaaatacaacagtaaacccattacatgtcaatatagatatcatttttgatgaaaaataactatttaaaaattaatttaatggagagagtagccttgcaaatcttaatgtctggcataataaagagaagactgctggattctccatttctcattcaatctgttgtgacagaacaggtgatggagcctgtggaaagctcaagtgcacagacatgggaggtaaataacttctctgaattcagaagttttgatctcacagacctcccagaagggtctcagggactcccaggagtccccagactacattttgagaactgttgctctcttatacaccaagggatgggattggtgatgtaaattggcagggactgcagtgaaagaaaaactagatgcaaaaaggggccaagaaaaatgtactcacatctatgatcaacaagtattgagtgtttactatgtgcccaagtggaaagcactgaagatacaggttgagtgtcccttatctgaaatgcttgggaccagaagtgttaaggattttgaactttttttgattttggaatatttgtattatacctactggttgagcattcctaatccgaaaacctgaaatctgaaatgctccaatgagcattttctttgctcatcatgttggcactcaaaaaagtcagattctggaggatcttggatgcttggatcagggatactcaacctgcactaacactcgcgtcaggtgttctctgtcttcttcaatgtgaaggctcattttggcctaaaaaaatttttagaactgtaagttaactttttaacttacagcatccattgagaaagtgaacaaaaagcaactgtgaattttgttctcgttttaataaatttctgttttattcatcacagcaatatctatggacattagatagaaaattcattagaaaatgaatactctatattgtatacattaaacatttggtcttcagccagtgctttgtacccatggagatctgcagaacctttgcagatatatctgtgcttggcctctgtacctgccatgtcgcctatgacccacaagttgggaactgaattcactcatctgttcttgtcactggcattaaagacattgagtgatggatttgttttggggttatttttaagcctttaagacttttgatgccttcaattaagatggccaggtatcataaagaattcatgcatgcgcttccggggcttctggttttcttgacttgtccttatcttgctaagagcaatggataggcatttgcagatcaggcactctcacctgccctgtaagatgttgctcagagttaatggaagagaattgtgttgagagagttaatactgagttagagaaaagtggaagtgtgtaatagtgcaaagggaggagtgagaaattaaatggtatctttttagaagtctgccttattgcagtctgcattgctccttggggatttttctactgagtacaagaaaatcagcaagcactttttgaaaaacccagatgaaattactgccgtaaatttttattttttttcatggtataaaacccttaatttagatggggagggtttattaccagtgttttcttggcatggctaaattcaattaatttcagatgacaagctccaggtcccccctactaccacccctctgctgccttttcctcccccctccatcccccaatatgtggaaaatacaatttgttattggtttgcctttggctctggagacctcattaagggcctgagaaagagattctatctctctttctttgacacctttctattttctgctggattcagaccatttccattgccacatggaaagtatgcatggtgtgtgtgaggggaaggttagcagacaagtagtaatgattataccttttaaatattgatttgaaatgactattgcaagttaagaaattgttaactgcagtattcaactaagatacggagctcagcttaagatgacgtctctgaaaagaatgtgggcacatttagacaggaaaacttattcagcgctctgacagttcatatgtaacatacctggttgtttgaaagcaggaacaagatgtcaacagaatatcgtatttactcacagtcctaagacagcatgctgcaccttcaagttcttgttgctatcagaatactgtgagcaaacgagggaaataatctatggtgttttgttttgtttttctctgcatggtaatatagaatctattgtagtgtgaataaaagaagtcacaagagattcattactgtttgtgaagtgtactgtctgtgtctttctgcatgggattctttattttacttacaaagcagatataaaaattagaattgagatgatagagaatatatattgcataaataagcaatttaaacagaagttttaccattataacaaataaataccctgcttcagaggttggagattagaatcctgttacattaaatgcttgacaattaattagctattgtctataaagttcccaagatgacaagttacttaaatactattattaggagtagctggattagtaata

SEQ ID NO: 120677 - DNA, 1053 bp, Homo sapiens
gtggagctagaactgtgaaagggcagggagagttgcaagcaaaaagggatgaagtggtttgagagtagtaggggggaacaaggacagctgcctcctctatctcctggctctgggatttatggggcattaagagaaaaaaatagtaacttgagagggctgttggggaagcatgtttaactgctagtgataagaaatcaggagagagagaggttggagagggagaggttgaagagcagagctacctgagaagggagaacaggtagatgggctgtaaagtcttggtggagagattagcctgggccgtctcctggagagaagggggagggcagcagccctgtttgtgggttgttggctagaggctgcccctcctctttcatttctgcagaaggcagcgggaacagctgctgagagtagggcgatgggggattgggtaggagacatgagaggaatggaggaggtgtgatgtagctgctgtggagaatggaataatagaagtgacacatagaaagagcatgaggagatagtgagggctcagctgagattggagagtgagttaggcataaactcacttccctcccttttcattacacgtagaatgtcagttttcccctatttccaccaaactgaattaattgctttctcatctgtttccatagtgtggagcacctacttttatatcacttatcacattgcgttacagtgatttacctgttttccctttcagagtgtgagttcttggacagtaaagcttatttatcctctcttcatgatcacctagaataatggctggaatgtaacaggcactcagttaacgttcattgaattgaatcaaattgcacaagtatggtcattttattttcctaatagctctttcccttcatgaatctgatgccatatattctaaacaacttattcatttctgtgggcacagtgtgctcattaatgataagccatcctatttctgtgttacgcaagagtaagacctgcgcagaagatgaagatatcctgctcatctctgcaggtttggtatttgtgtatttgccttggggattt

SEQ ID NO: 120678 - DNA, 1042 bp, Homo sapiens
ccacatccttattcttaaatagctcacagtttactggaagagtgaattttacatgggtcatctaaatgttgacacctaattaatagtcaccatatggggtttggtatgtacatgttccacaggaattatctgatcaaatgagtgatgcaaactgtagtatccctttccttttttaaaacatagtagtggccgggcatggtggttcacgcctgtaatctcagcactttgggaggccgaggcgggcagatcacctgagatcgggagtttgagaccagcctgaccaacatggagaaaccccatctctactaaaaatacaaaattagccaggcgtgatggtgcgtgcctgtaatcccagctactggggaggctgaggcaggagaatcacttgaacccgggaggcagaggttgtggtgagctgagattgtgccattgcactccagcctgggcaacaagagtgaaactccgtctcaaaaaaagggggaaaaatagtggtaggttttcattgctctgtggatgaaactcaaaattcctactctgagctttcaagagggtcctagaccatttcatttccctttcctctacatgtacacatctaaggttaagtccttcccagaactgcgccttatgtttgaaacgcccttcctgtcatctatgcaagcaaatctttaccttttgcctttccatgtgaaacttttccatatctgtgagaaaaatgacccaaatatatggtttcccctcattctttgaattgcgcctaatgaatatgaagttaatcatcataatttagatatgattcaagctacatcagaggtatttacagccaggagcggtggctcatgcctgtaatctcaacactttgggaggccaagcaggcagttggcttgagctcaggagttcgagaccagcctgggcaacatagggagatcttgtctctacaaaaaataaaataattagccaggcgtggtggcaggcgcctgtcatcccagctactcgggaggctgaggcagggggatcacttgagcccaggaggtcaaggctgcag

SEQ ID NO: 120679 - DNA, 1034 bp, Homo sapiens
aaaccaagaataatagacataatatctctgttgtctctcttaatatgcaggcccagaaagaataaaagagtaaatctcttcccctattatcttttagttgtaggagaggagtatggagagaggatattgaaataaattatttaatgctggatagttctatgcttagtagtaagaaaataacacttctttgttcaatgtcatgatgccattagttcctgtgtgatttgaggagtttttgagaaagaaaatagtgttagtttactggcttttaaagtccaggccagttttaagctcaaattccatagtgatatcttttaagcaaattcgcttatttaccacccagcattttgcctcattgccctgccccaggctctgtttgtatgaagttgtcatgatgtaagaggaaatgttgactgttctcttaagaaagaaagccttgaataagaaaatcatgttctcattaaatccgctctttaagagtaggtgggaggaattgctatcgatctaatggatttaacagttcatatagaaagtctgtggaatagaagtaatattctgcagctgagtaactgtagattaatccatcttcagacagaattctggaagcatctgtaaaactggaaaattaccttttttttttccaggcacaactggactaaatgtatttcccaaatactttagaattaaattatatccacataagtaggtctactaaaaattatatgaaaaattgaaataaaatcataaaatataaatgttaggttcttcttggctacatttgctctggtgccagtctgtttcgaaggtctgcagtgttgaagggtaaccagaggtcacttgtaaaaattctttctttgttagatggttctctaatagctagtggtggtccattttagtttttagttggatgaagtagtccttttaaggtggatggtgaagtcagacatttaaggttctcttcaagctcttcctttgacccttttaaaacctttttattttattctacccactgaaagcacatcaccaagccctcc

SEQ ID NO: 120680 - DNA, 1063 bp, Homo sapiens
attgtgttgagttggtggcagaagaggcacaatctgatggaatgaaggaaataatgtattcttgattggtctggtctttgcattcctcatatgtgtcttccattttctttttattaaatatctctttattttttccattaatatactttactcagatcactgtgactgcttaatagatactacacagtaatagtagctgttttcatgtgggagataaaaggatgaactagtcagagatgaatgttaattgggtgcatctaataagcctgagatttcctgcttcagtgtcatcatgggagttgaggcagagcatttggaccttcctagcatgtcacctactgaatgctcttgacccgttctgaattgcctacactgggcagtgcaggcatgacagagtctgcgaccaggtagcccttcaagctgcattggaggcatggaaattctttgccggtctgtagtttgtgccatccagatttttgaaagtgttctgaaggaatctgtgttctttcacctggttttcatgcctggccttaacctagggacataaagtcacagtagctctataggtgtttaaacacatagttctacatgtatctggttagttgaacccttctttttttttttaaattcatggaatggctgacttatttatttcatgtaacataatcttgaaaatacaaagtactctccctcctattttctagtccagtgaaggtgatcactttcctctttcatttaccttggttacttgtttcctgccctgaggtgaggctacttgtagggctgattaaggtgagatattttctcctttttgaggctctacttatgagctagaataataaaaattcaagaattgtgccgaattttcttttgttgatgactgtgatttagtctgttatgtaactacaatgtataatttacacatcctgaagatcatcagtctctgtacagagtgactatatttaaccctcacttctttggaaaaagagaacattaccaattatctttgaaactgtgtttgtgagacagtgcacattgatccaccctctgtctccatttttaa

SEQ ID NO: 120681 - DNA, 1028 bp, Homo sapiens
agctcagggttggttaatttggtggcttaatgatattgtcaaggatctgggcttttctgttttttagactctgccatcattatataagctttgtgctcaaactggatcctttcatgatcacagtatgactgttacaggtccaggcataaggtccaaatgcaaagcatctcttccctttattgctcgaaagagctaagaaacctttcccagaatctccctagagatctccatacacaattggcgagaaccagttgaaattatcactcgcatatcagtcattggtgaagataatggaaccatggtgattactattcaagatctatgcctgtaaagggcattcctcctcttttcacgttgggaggagagaatactatacaattaggactgatacaattagtaagaaaattctataggcaacaacatctgttacacagcattattccttaatgaaaatgcctgatcttgtcctctgaagttggttcgggggtggggggcacattaaagaaattctatatgtaattattgttgctgcctgaatggtttctcagttagtgacatttgctactgtattggccctggtcttttaggtttttaggtgtttaatatttttctactttttaatatttgtcattctttgactcagtgtattttgaaaatgtgcgttttaatgatttcttcttaatttcatctggaattaattcctataagcctagtggctaagccttgggttctctggaaaacagagcctgaggtgaggattaaggtggtaatgctttcttggagggttgcaggtccaagtctataagggtaagggcaaaaggaagaagggaaggtgcaaagaaatggattcgatgtgttatagagccagctagcttttgctttacaacaaactaagaagagacatggaaggtgactcaggaagcatgcagcttttttctgaaagggttgcaaggaggaactaagagtagtccttggaaaagagaaagaagggggagaatttatctgcctgatatttcttcctgtctcct

SEQ ID NO: 120682 - DNA, 1079 bp, Homo sapiens
actgcctttccagttcattgaaggccccggaacactttagcatgtggtggcagggcttgccaggactcaggttctgagccctggggtgggcaatttctttctggctagggctggtctaaatgctccctctgataggtgccaactgagttctgcccagtgctgctttccactgtgacaaaatagcactgagttccaatgcaaagtcccacagtcactacactctgcctccctccaagtgcacagattctctctttgtgccacatggccatggccactactggggaatggggaagggatgttgtaggtgattcaagactgtctttcctaccctcttcagtgcctctttccttaatataatattattatgatcacttacctgactcttcattcttatgaaggggctttttttatgtggatagttgttaaatttggtgttcttgctggagggatgatcaccggaggattctgttcggctgtcttattctgccttcctatttctgattttcatgagagtgatttgtcatgattaaaaaaaaagtgggaatcatggtgatagagtctttcctttcctaggaaattggtttctgattatgattctgacttatattgatgtggtttaactacaatgtagaatgtccttgtattagtcccttttcacactgctgtaaagatactatccaagactgggtaatttataaaggaaagaggtttaattgactcatagttctgcatggctagggaggcctcaggaaacatacagtcatgacagaaggggaagcaggcaccttcacaagattgcaggagagagagtgagcaagagcagggaaaactgccttataaaatgatcacctctcgtgagaactcactcactatcatgagaacagcatgggggatactgcccctgtgatccagtcacctccctcccttgacatgtggggattacagtttcctcccttgatacatggggattacaattagacatgagatttgggtgaggacacagaaccaagtcatatcattctgccctggcccccaccaaatcacatctttttttttttttttttttttttttttttttt

SEQ ID NO: 120683 - DNA, 2551 bp, Homo sapiens
ctctcctgagtcccgcccaggttagggcaagtggaatcatatgcttagttttgccagcttttttaattttccaagagaagtaaggaatctagagtgttttgttaaagtcttaaatttataaatatcatcaattaatatttatagtttatagtaagtagtttataaaaatactatgggccagatggaacagccttaccggtcagataggatctcatgggtggcactttgcaatctctgtattagtgtgatggcagtggaaatgcagggggaaaatgagattgaggtatattttgagggtggtaatgacaaacatgatggatagagtggatgtggaagagaatggatagaggagagaatgagagagggagacatccttgacactgggtttttggcatgaaaactgggtgaatgggggtacaatttactgagatacagaaaccaggaaaaaagacatactgtgggtgcgggaagaccaaacatttagttgagacttgccaagtttgagatgcatgtgagtcatcaaatggaagtttccagagagagttggatacgcaagacttgttcttagaaaacaggtcttgtgtatatacaagagataacaaattgagagttactgacatgtaggttgtttgaagctgttgggtagatgaaatcaactagggaaagagtagtgaaggccacctgtccagctgtagagtcataactgtactctcttgataaccatctctgatctctcctccctgtatattctctgtataaatttatgggttaaatatgtagtcaagttcatataagttttctatttcagaaaataaaaactgttttatctttttagtaagcatgacagcaatcttaggaaccttagaatttctactcatatacaaatggaagagatggctgactttatattaaactttctagaagcagaggaagaaagcagagctttgactaattcttagtagagatttcaatgtgggtcaatcccagaatgaaaattttgttgttgttgttgtcgtttgagatggagtcttgctctgtcaccaggctggagtgcagtggtgcgatctcggctcacagcaacctccatctcctgggttcaagtgattctcctgcctcagcctcccgactacctgggactacaggcacgtgccaccatgcccggctaattttttgtatttttagtagagacggggcttcgccatattagccaggatggtctccatctcctgacctcgtgatccgcctgcctcggcctcccaaagtgctgggattacaggcgtgagccactgcgcctggccagaatgaaaattttataattgacctctatgtccatgttccagttataaaattccctcctgtttgaattcttccctcttccttattcccgtattcccttcccttctttcctcaaatattttgagtaccttctatatgcaaggcattgtatatgcataggtaatgtaatagtaaaacaaaaaacaaaaccatgaagcttattgtctattgtcagtaataacatgttcaaatattctattattgtgacattcatttttttcatgctttttatatgaggggaggcctaaaaacaaaaattagaataaatatgaataatatgtacttcactttaggagtctttcatctgagttgaccagaaacattgtctttaagtttctattcatcattgcatctgcgtccagcattaagacagctactgtgttttcttgacttgatgtccttctcatcaagctgtgaatgtatgtgaaagagaagggccctgtttagtacagaccatgggaaggtgatgctgtgtataaagtattgccactctagcatgtaacatcatagaacgcagcatgaggtacatcacagctctgctttgctttggagttaaattcagagtagtgattttatgtttttaaaaaatttatacttaagcccttaggtatcttaacattcgcttccagtgaggcaccgctgaagctctcctgctagtcggcacaagtctttgctgtccagggataccagtgttttcttgagacagactttttattctataaatctttataaagtttgcactttgggttgaccttcaggtataagacatactgcctttgtttagtacttaaaaaagaacaaaaactaaatctgaacagagccaggctttctttttcttagaattttgtgtctacttttataccatgtaagtgcccagaggcatcttaagatggacatgattttatcaatcttaaataaaaataaatgctttataggtttgggatttgcaagtgtgtaatatgctgcaagccagcggaatctgttgtaatacaataaagtttattgtaacataaaccaatttatcaaaaatatggctcatggattactagcctattccataaaattggaccccctatggagtatttcatattaatttattatacctccaccgtgtgtgttattacttagcacttattacatgccaatgatttcttaggctctgaacaaaatcaaaagatggaacttgacccaggccaaaaagttgtttgatactttg

SEQ ID NO: 120684 - DNA, 1332 bp, Homo sapiens
gtaatcccaacacttgggaggctgaggtgggtggatcgcctgaggtcgggagttcgagaccagtctgaccaacatgatgaaaccccatctctactaaaaatacaagattagctgggcatggtggtgggcacctgtaatcccagctatctgggaggctgaggcaggagaatcacttgaacctgggaggtggaggttgcggtgagccaagatcatgtcactgcactccagcctggctaacagagcgagactccgtctcaaaacaaaataaaacaaacaaacaaaacagtatcgtaacagatataataataatgaaaaggtttgaaatattgcaagagttactgaaacgtgacagagttatgaagcaagcatacactgttggaaatatagtgctaatatacttgctcaaaatggagttgctgcagaccttcaatttttgaaaaacacagtatctgcagtgtcataaatcaaagacaaatagaatgaagtatatttgcattaaaaaaatcaccatgtatatcaattagggatacattttagtacaaatcacaggaaattttggcttaaataattgaggtgtttattcttattagatgataggttggtataggaattcaacagtaccttcagaagccaggttatttctgtctttccactctgatattcttggtatgttggcatttgtcctcattcttgtccttgtagatccatctccagccctttgtcaatattccaggcaggaagaacaagaaagtctaacaggaaggggcaaggcctatatcaggaaagagaaaactcatcggatagaacctttgtgtcatcctacatccctttttctcatgtaccacatctaatccatcagcaaatcctaggggccctgccttcagaatatatagagaattggaaccacttcttaccatatccactagctactacctgatgcaagccatcaccttctctgttagattattgcagtggcttgatacctggtctgcctgctgccattctcacattcctatagtctgttctcaaacccctggagcagtgtgtgtgtgtgtgtgtgtgtgtgtgtgtgtgtgtgtgtgtgtgtatgtgtgtgtgtgtgtgttttaaatattaaagcattagtcacatataaaattcattcttttttttttttttttttttgagacggagtctcactctgtcacccaggctggagtgcagtggctcgatctcggctcactgcaagctctgcctcctgggttcacgtcattctcctgcctcagcctcccgagtagctgggactacaggtgcccgccaccacgcccagctaattttttgtatttttagtag

SEQ ID NO: 120685 - DNA, 1007 bp, Homo sapiens
agggaaagattaatgcgtgagttgggaaaaaaaatagatattttgctttgaaattgctctattctttcttccaagatgccatctaggaatgcacgattttgaactttgtaggcacattttcattttaaaggaaaaggaaaaatgacttgaaaaaatgtgttggcaaaacctgaaaagaaagctctacaaaaaaagaactctagcccgaaaagagaacaggaagaaatgattactgatgatttcaattttcagtaaattacaaagcatacgtaatagacttcgaagagagatgattccaatggcatacttcatgccgccttcacagataagtgtgtaaatgaaagggaaatgaattgtttcagcctggaaaatctgtaccattttggtggagtgaaaatgagtgaaattgaagtaatcctatcacttcttactgaaaatataacatataaatgtttttgatgtgtttctagagaatagtatacttatagatttgctgcaaagaaacataattttgaatcagaggtaactaaatgagtataaaaaataagggtataatagtgttttatgtaatttacactgcaaaatttgaaaatttgaagtattgctgtgtgggtgggaatgtttttctttttaactccttagaacctagcaaaattttcacaatggaaaagaaacttcattcatgtattcatttaacacataattactgaaagtctacagtgtgccagataatattaataagacagaaaaagtccctgccactaaggagcttatattttagtagtgaagatggataataaataaggaatcatgtagctaattctaccatttcacttatcatatgatatgtgctgtgaagttcaggattctctgagaggtcctccctgaggaaatgatgtttaagctgagacctgaggaaagacaggaggtaaccaggtggaggagaaggagaggtggtgcaggatgaaggaacagcatgaacggatgaaggaacagcacgtacagag

SEQ ID NO: 120686 - DNA, 1093 bp, Homo sapiens
agccaagcagggaagtgttttcacagaggatggagtgatcaactgtgtcgggtgccaagaggtcatgtaagattaaaactgatgattgatgactggatttggcaaaatggagatcctgaatgcccttgagaagcagttttagaggagtggtgggaggaaagctgaataggagtaggttcaaaatggagagagggactgggaacagcatgtatagacaactattttgagaaacttacttgtgaaagaaaggaaagcagtagggtggttccctactctgaaggcttagctgcacagtcacttctggtgtcaactgtctgggaaaagttatttttgcagaaaccttgttattaccactaagatttttttttttccctctcctgacagctgtcattttggattgcttttctcctttcgtttgacagttcctaagtgaggacctactgaaatcttactttcttcttgattctcaaatagtaagcaaaaatactgagccagcctgtttggggacaaacatactgccctccaaagcaggttaccagggctctcagtttagagacatcacatttcctaagacttggggcaatgccatgggaacaaaagatagctaatatatcttgagtgcttctgtgctagcacagtgttgagtgttttatatccattatctatttaaccataatagctggttgggtgatagagattcataaagagaaccttacaggtaaataactgggatttagcatcatgttttatcttaccagcgttcatagctcattggaatactgagggatgttttatgaatgtctctgaagtgcaaggcatttttatgaaactgagcattaaaaggagtcacattgtaggttacttttaaaaaatattgtgaacttctggttaagaagatagccttcacttatttatactgagaggctagatttggggaaaaacagcccaatctaatgaaaatcctctaaaagatcttaaatccttagaatttacaagtcacctttacccatgggttctcttgtccctttctgcagttattgattttttcctggtgccttttctataatttctgcctggctgtatccatttcctt

SEQ ID NO: 120687 - DNA, 1896 bp, Homo sapiens
atttttggtagagacgaggtttcaccatgttggccagcctggtctcgaactcttgacgtcaggtgatcctcccaaagtgctgggattacaggcctgagccactgtgcccggcccatttttattttttcattaatctttgagattgggccagccttgccatcttactcttcttcttgagagtatcttgcgatgagttagtcctgccattacttcctctttctggactacttttatacttcctctttccatatagtcagtgtagtaagttcaaccagaacactttgtgcaacccaggcattcattctgtgtctcattcttgttctctctttgcatgtaagcctaagtatgctggacactgcttccgatttctatactgtgttgttggcctgaagataggaaaatcccaagatacagaattggacttaagatagaggcccttaattgcatcttgatcctaagccaaatgttccagtccagttttactgtattcctgctctgtggtatttagatgctgagccacctcatagtatcatactttgattttcattcagcttgtgatttcttattttctgtaaatgtaaatgcatatggagagaatggtaaatggcagagcaggaattcctgggtcttcagccaccacactcttaaaatccctaataatttctacattctgggtgtttataaaatcttcctgggtgtctgtaaagtcttcctttctttatactgctgccttaaaccctgccttcaacatctctatagcttggaccttgcaggtctctttacacttttctaatccgttctccacattgctgtgatcctaaaatgcagactaaacctattgtttgccggtgtaaaacctttgagtggctcctccttgtctataccatgaaacccaagatccatagcacagaggcaatatagtgtattggttcagggtgcagttctagagtcagtctgcctggctttgaatttggctttcctttattagctgagtgatttttggccaagttacttaccctctctgtcttcagtctgcacgtctataaaatggaaataacaatagtggcttctttgtaggagaaggtttgctatgatgtttaaattgcataagaataatataaagggattaaaacaatgcctagagtagggtaacacttagtaagtgttagatcccggcctactttgctagtctcatttcctgctgaaaccctaagctccaaccaaaccaaactgcttctagattccaagtgtacactgtgctagttcattgttctgtatctttaaacatggtatgccctttgcccggagtgaacatcgccctgcctgatgcctgagcattgtcttcactctgaagattcccagaccagtctgaataacctgagtattgtaggtattgaagattcagtgaagtacagattggacaacatgtctgtcttcatagaaattatgttctactggggagagagagacaacaaaataaataaagcagggaagaggatgtttatggggtgggtttgcaatttcaaataggcaaggcctcattataaaggtgacatctgagtaaagacctgaagattaatgaacaagccaatgtgggcaaagagtgttccaggctgagggaacagcaactggctctggtatgctcctggaatagtaaggagggcactagggctgaagctgaagagaaagtagtataagacggtgtcagaaaagaaatggggccaggttgcagagcgcttggttgagtgagattgacagccactggagggtattgagccaaggaatcctgtgatttgattgttctaactactaggtagaccataggttgtataagggcagacacattctaacaagaataatttagacaaaagatagtggtggcttggatgagggtag

SEQ ID NO: 120688 - DNA, 1915 bp, Homo sapiens
taaatatatacttacatttaatctcaatttttaatgtaatgaaaccccttttccacattcactatggaattttggtcgttatttcaagtgaattcactttaaatgtcctttttcaggtaattgttgttctggaataatgagaacctcctgtaatgggttatatacttgtctttatgtgtctgtgtgtcttccctctccagttttgctggtaacgaacagcagcaacaaacacaggcaaggagagttagagatggggtgagtcatccttagtaaaattgtcttttaaccagtgaggcaaagaaacagaaccttgatgagcaataatctattctagaagagtagctaatcagcagattatacttttatcttggagaaaggactgcaggtcactcattaaatcaaaaggcattacataaataaagatttccagtttgggggtactggaggggactgtagcaatattgtttttgaagtctttgtttctctttagtagcatcacccatagctttgatgttactcacactctaagatgaatacattttggagcttcctaatccatttgaaaaggaaaacgtgtttgtaactttaccagccttaatttggcctactggtagacttggcaggctccgctgcaacagcaagagtggagtttcatataccctgctggctgctttcactacagccaagcttctggaagcccattatttctgaggataccattcctttttggattttttttttaagtcttagagtctggggaataccccaaggttgtgatagtatccaagaattcagtgttttggggattttgaaatctgtgaaaagaacatatatcacttgaaattacaatgcacagttgattttctggtaacttccaaacagtatgcaagctccgttctaataaaatcagaagattatttttttgggaacttgaaaagtaaatgtataccttaaagccattttctaaatagagctcattcattatgacccacgtttgcattcatgcctcccttgaacttaggccagaatatttatctacaatttaaatagcaacacgttagttaagtgcttgatttaaagtggctggcacttccatttatttttcttttattggaaaagttcattcctctgagaggggttgaattagtcactgtatagttgagataagtcccttgatctggggacaaaacattcacaggatttgtgtggctgtctatagcatctgtgtgacaggcacatcatgaatctcttaatagttgtgagattgcttttcactcaaaagtatgatgtgtgactgactccttcttctctattttatggcaaatcatgtagctcatatatcatgctagccataaatcttaatttatgtttgtctgaggatttgactctgagatttaccttcttagatgctgaaaatattcaataccatatggtttcttttattagtatgatcaaaattttcatcaaaatgttgaaaagttgacactgagacggctaaactagtaaatagtgtgttttgtttaatgtctttcatgtgtccagtatgaaaaaatatatagaaattcattgaacccagaacttcctgttcccaatggtttagtaatcagtcttagattttttttttttttaagggacaaggtttcgctctgtcacccagactggagtgcagtggcatggtcatagctcactgcagccttgaactgctgggctctactgatcttcccacctcagcctcccaagtagctgggactacacatgccacaacactcagctagtcaaagatcttttaagttctatcatttagctagattattaacgagaagtcttgccattatctcttttcccaagggtggaaggattatttctgttggctttggctcttatggcaaagagtatcctacattgtctagaatct

SEQ ID NO: 120689 - DNA, 1750 bp, Homo sapiens
aaaaaaaaaaaaaaaaaaaaaaagttagataggcagacaaaaggggaaagcgtttggagcagagacaggtagggaaatcttgagggaggaaagaacttggcttgcttaaggaaatgaaaagatgtcagtgtgctgggagtggcagcgaggtagaggaggaaaggtgggtaatgaccaggtcgtacaggtctgcatgtgtgtgtggggcacgttaaagagcttgtggtagtctatcaaaaatgcagctcctaggaaggtattgagggatgtgacatgatctgactttagttttttaaagactttgcctccttgtggggaatggattgagttgggccgaagtggaagaagggaaaccagttgggagacctctgttgtagcataggagaggagtggtggtcttgtgtaaggatcgtggcagtggagtcagagagaaacgagtggatttgagatgtgttcttcagcttatgtgacttccagggagcattgttagatacaggcttgaagatggaaaaggaggtctgggctagaaatagaaacttaagagttgttgtcttagaagatgatatttgaaaccataggagccaattagatccaaaggaaatagaatgtagtaaagtgtagaggaaaaagaaaagaggacctaggactgagtctgaagtgctccaaaatttgctcaggtagaagagaagttgtaaaatgaaatggggaaagaatagccagcaagaaaaggacagtcaagaatgtgtggcttcaagaaagagggacaggtcatcagtggcagatcaagtagatgaggaatgggaagtgtccatcagccctggcaacactcagtgcatggttcaccttggcaggagcagttttactgatacagtagtggtggaagtcagattagagtgggttaaagaaggaaatgtatactttataataaaattaaacatgcatacacccattgagccagcaatccccttgttggcaaaattcattccaagaaaataggtatgtaagcatgtttattgtagcattgcttatagcttcaaaaaactgaaaactaccaaaatgcccatcaataaggaattgattatatctgtatgaattgacctagagggattttaataaaaattgttagatgaacaacacatattagagatacttcttttgtcaataaacaaccttacgtatgtatataaatgtttatttggatttatatgagaatagagaatggtgtggaaggatacacaccaaactttaatattgattaagcaagtagtagtagatgtttatttatcttttgttatacttggctatgcgatcatttttaaaaaataaatagggagttgaagttactttttaaaagttctgggagatgaggaaatgaagaaaaaaagaatagatcactttttttgagaaacttcgccatgaaggtaaataaaggtacctggtggacactagaaatgcatgtactttttaaagacgagaggtgctaaagcatgtttaaatactgattaaacggattcaggaggaagaaactgaagagggaaggagaaagacagtcaatggaataagacacatctccattttgtgtaacagaaagaatgttatattttcgtattgtgatgacttctattttcctgtgctatcttcaagactgcaaagcatatgtttttaaatgtaccctacagaatctgggtctgaaggagtccacatcataatttgatctttgcagattttggcttcttaagaaaaatacaat

SEQ ID NO: 120690 - DNA, 2131 bp, Homo sapiens
ggaagagtttctaggaccttcaatccagcttctaaagtgaataagaaaatgtggtcaatgaaataaaacttcattgattgctttttggatgaccaagaagatggagggacaattagatcttgtagataaacaaacaaacttagatacagattttttgtgtgtgaattacatagtcatttttctatcctgcttactttggcaatggtgctctaaaaatgatattgttgagtagttaataattctgtcagtggagagttaaatcttgtacattcagatttcaccccatactacttaacaatgattgctctgacctttcatagtatttatagcttgaatctcccaattagccattaattatatatcttgtatacttttgaaatcattttgcagttcctggaccttgctttatattcctttggtggtagtggctcatcaggtatcttgttgaatctctttagctctctaaaatccctgaatgcaggtgcctggataataatctgtttttctggaaaatacccttttaacactgctatttttttttgccagtgttagaaggaaataataggaaacaaaattttatattttttttccacaggaaatatgtttaaagaagactgtgagtacaagtcccacggttagtaaaatcatcagagctttctcagtcatcattataaatggtagaagttccctagatcagggtgctgtctgtggatacaaggttagctcaagggagagtagaccagaagtaaaaccagattgcttgtcggctgccagaaaatctgggcagagtgccaggcctggttcatcttctaaaaattcatctcccagtatgaaaatagagggctcaatccctgcaaggaacggtggtagcacgaacacttggacttccttcagcccaaagcactttattgatgcgaagaaaggtggggggagtggattgtggattggagtggactgttggcattgacctcatttaagagctgtaatattttctttagcggccttacttatgtttcaaattataatttcattagttaataattcttcttccaaataatatgggtcatatatacacatgaatatgtccttcatgataagaagctataggtttaatttctaatagtcatagaaattctgtgcacattataaagctattagaatgtaacagctgttttagttcatctcattttgcaaaagaaatgtgatgcagactaaaatgatcagtaattattttgaaagctaaaccttcagttatagaaagaactaatttacacattagttactgataaaactacagtatgctatggtttcaaagttagtgttatcgcctgcctaagactatgaaagagaaatctgtgccaaaagacgtttttccttcttttaaatcctgttttgcattgcccattgtaattttggagttgcaaatcaacagtaatgaaaaactgcttgatatttttctaaggaaaaaaattagaaggactgttagagagagtaggatttagaaggactttattttatgtctgttgatcagtgactaccatctgccttccatttaatgttgtagaagcatgcacgcgtttcccagttctgaacagatgatgtgcatggtttgttgagatatatgtgtattctggatgtgtgtgtgtatgtatacctacagtgcttaaaatcacacttgaagtgtaaaacagataatgagtctccattttggtctcatttgcatattcagctcttacacacaaaacaatagactacaatgacactgattttcttttctacttgagaatcagcactaaccagctgtcaacgaatatttcgattaaacacttttctttgttggggaactttggggcacattctttgtataaacatattgttttctttgatttcaagggacttattttcagtgtgattcatggctgcatcacaccggtaagctgtctgcacaaaagtatatttttctctgtaaacttcctttttaccattgatttctctagggcaaaagtatggttaagaaaaaatatttcaactcaggatatttgcccgaaataaaggtggagaatatacctgctttaagtaaactgaagattttaaagtatagattcatatacttgacttctttaagattttt

SEQ ID NO: 120691 - DNA, 1098 bp, Homo sapiens
aggaatgaggataaagagaaatgaggttacaggacctcagaagtggtaggaagggaacagtctaacatttattgagtatcttctgtgggtcaggcacatctcattaccttgtgtaattcttacaatagtcctgtaggagaaaaaccgctacttaattttataggtgaggaaattgagccttagaaaagctaaatttgtaaccaggtctgcctgactccacattacattgctgatgcaagaatcaaggtaaagaaatagctctaccttagagtaggagaaggaggcattgagccctgaagaagctcttactacctctttggaaggagcagtttccagcaatcctgtaggggaggacctgctgtggccaaattctactagtgctggtcacagccacccagactacacacacattatactaataatgatgatgaacaaccggggatattttctgttttaaaatgctccaaagggagtgcagcaatcctttatctaggtatgttttgtcagtttgtttgtagagcttcgaattttcctgccccttagttctccataagatcattttagagtattattatagagtgaacctaatattcttgaatcctagcttgttttcattaaactgtgtttagaaacaaattccatatattaggaaatttttatttacaagatctcttcacaccttgagttgctttttttttttagttgggaaattttctgtttattattttcatctagaacccttttattagggggaaaacacaacaacaatagcaaaaaaatcccccaaaaccccgccatgttttatattcagtaagacctttgagaaatgactgtttgtccttaagttattcaattgaatccaagcttctttgttttgttttgtttagaggataataacatgttgagcttcttttgtgtgagaaaacagaacaggattgcccttttcctttgcattgtattttataattttagaatataaattagtgtcctaataagcttattgcatgagatgatgttactaacattaatcacctgttgttattaccacaaatagccattgcctgtttttcattctgaaagggcaaaaactatatttgc

SEQ ID NO: 120692 - DNA, 1975 bp, Homo sapiens
ggaacaagagcgtaggtgggagaggtatttacttcaggggctggtcagagtttagaggaggattaggagcgttgtttactggagacaaggccagacagggtgttgagatgggtgtaaattgacaatttagagtctggcataggagagatgaacttggttaatacaaaacggtttctttctttatttccttttttaaaaaattatcaaaatggaaatatctctcattataaagttataatgtatatattttaaatattgataaaacttgccatctggaaatgttgtactcaatttctaccaattgcatgtaaaaatgcccctttctgtgaaccttcaccaatgcagacactgtcaccgttttgccaatgtaatacataatttgtttaaaacaaaaatcctattttactttgaatttctttattggtgagttaaagtatcttttaatactggccatttgttaatttcttatttatgaaaagcctgtttttgtcttctgcatatttttcttctgagatagttttctttttgtcttgtgagaactttgtatcaatacatatatatatatgacattatccttttgcctgtcatatatgaaatttgttaacgcatttttagtgttttattggtactttttgccatatagaattttactttttaaaaaatgtattcaaatctgtcagtcttttaaatgatttctggcttggtattatgattagaagattattcctcactctaatattaaagtatgttaaacttttatgtatatatatatattttttccactacttgttttttttttttaagccttatatcttaagtatttaatacagtcaggatattttgcatagatcttttcaggtagggatagtcagttgattaaagtcatttatttgataatcatttcttgctatcctaatgtgatcagccatatttatgatgagctggattctagcatataccctactcagttccactgatttctttgattcttgctgaaagtattttaattattgtagttcacttccctcctttttcttcttttcttagaatgagaaattgtgtgtgccatatgtgtcatagaaaaaagaaagggtatcatagagcatctgctaggctgtcttctggttgttgtagtcacattagaggccgtaagtgatgataaacatctcactagaatggttctactttcacttacaacaggaaatttaggcatgcttcaccagctaaggaaatagattttatgtattcattcgtcactcacccattcaacaaataagcgcctactttatgctattgttgtacttgatattgaggccacaacactgaagaagattgccaaggtttctgtgcttttggaatttgggagaaacagattaaaacaaacaaataataagcacatcacataattataagtgttgcaaagatggtactgtgatagtaacagaagtcaggggagaaggattattttaaataggatggttagaaaaggccagagatggggggtaggtgttttaagctgagatgaagggggtgatattttctggtcattgttttatttgtttttggttttgtgtgtgtgtgtgtgtgtgtgattgtttctttgttttttagatgggcttgctctgtcacccaggctggagtgcagtagtgcaatcttggctcactgcaacctctgcctgctgggctcaaatgattcttctacctcaccctcctgagtagctgggactacaggcatgtgtcaccacactcagctagttttttctatttttagtagagatggggccttgccatgttgcccaggctggtcttcaactcctggactcaagcgatctgactgcttcagcctcacaaagtgctgggattacaggtgtgagacaccatgcctggcccattgttttagatatttacacaacatctaaatattttctttggtgtacattgaatgttatttggcagtagctggtctactgtggga

SEQ ID NO: 120693 - DNA, 2267 bp, Homo sapiens
tagagctgttacgtgtttagagactggctgtattcatgaaggcagtttttgtcttggtatagccagctcccaattctggttgaaaaaaaatgagcaacagtgatgttagtgataatgataacaagaaaaggaaagaatcttgatatccatgttaataagaattttttaaaaattatagccactttattatattactactttccttagtaaactgtcttttttactaggttataattttgatagtatttaaaaatgaacctaagaatatgtctctgtagattaactgaggatgtcttggtgtttcttatcttcacaattattcattgtctacctaaacaatgttctaactgcacttcttccaagaacttcactgggcaaataaattgtttatttccttagcacgtaagtgttcagtttgcattatgttagttaatttgcacgtttgtatgtcagctttgttctttagtgtcctttgcgtgtttatcttgcctctgatactaaaattataagctcttggaggcaggcagtatggattctaatcttttattattcttgcacagtgctcagactgtgaccttgtatgcagtaggtactctataaatgttagcacaggtttcatggtgtcaaggcaatgactatgtaatgaagagagattgatgggaacattaatatgtacatatattccttgagactttttatcaatgtattcattaatacatgtatgagtgctggaaaattctctgtaatggtaaatggttctgaactgtttgcaaaggttactttgttttttcttcaggaaactgaatttggaggttattcctgaagaatgtgtcatgtattgatgaaagattacatctaatacatttacaaaaatgataccttatgtatgagaaatctgagattaccccgtcctctctctgagtttaggctaaactgcatataaatcagaactgtgtagtagaaaaacaatgggctgtggagttaggtagagctcttctcaaattcttgtttaaaacagtgggctgtggagttaggtcgaactcttctcaaattcttgtttaaaacaatgggctgtggagttaggtagagctcttctcaaatctttgtttcacctcatatttgtgttgtaatacgattgtgcctctctgagccctagtatctgcatccataaagaataggaataccaacacctcttcatggggtttgatgtgagagttagatgatacagcacatttacatgtacagagcacagttctggcagaaaggagggactcaataaatggcagtcatttttattatttttcctaatttcagaaactcctgaatggtggttgaccttcagagagagtcatccctgccatcctcgttggtcacggtagctctcactgtgaggtggctctcactctaacctctaaagaccctagtctttttggtacttttttgtatcgccaacccatacatacagtccaaaacatgccttaaacagttttatcttaacaaccggcctatctttgtatatgtctaggagttttcatatattttggttggtaaaatatatataacataagatttgccactcatctatcttgtcaaatgtaattcagtcagcattcacctcaccaagatagtcgatgttatctaatggcagataatatcaggcttcaaagccagtgtgaacattccaaccatgataatgaactcagagcaatggttcgctttgcctttctggactcattttaggaatgttcgtgagttaagtggggattgctctatgtagccaaaagcttagaccagttatcctcttcagcctttaactggagatggagaaaagtgactcatcaatttatgtttagtttttcatatgccttgagaaccatgttatgtcttatcagccttttctttctcaggaaaggcaatttccgctttacccataatctgtaaccttcaaattgtcttcttggttatctggtaaactctctcccagtcctttccacagctttcttagatgatcgagcctagtactaaacagaaaacactagtaatgaatggtggatattgagtactctggggggtgctcttaaaattttgagctattcctcaacatggtgctgttaatttggcagccatataatattgctgaaaaatgagaaaactttagaacatgagcgaaaatggatagaagtagaattcaaagtgtgcatgtgactggtggctggaattgcaagtgggatcttggtctaaaacctgggagttgagagagaagaaag

SEQ ID NO: 120694 - DNA, 2545 bp, Homo sapiens
agagtgaggggacagcaaagaaagtgaggggatgacacaaaataagctgaccttttctggtcacaactgtgggttgcaggatgacatttatggtcacctaaatcttccaagattgttcctgttgatattacagtacaagtaataactgcatctcaaatttaaatttggcttatgacaggggaatatagatttgttcaggatgggacctgcatgtaatggttcggagtagctgactaggggaggattataggctgttttcgttactgccagattatcagctggcaagttttaagttgtacgaaacacgcattatctcttgactggtgtcattgatttttttgcaggtagcttgtatgtgggagggtaggagactgggaggcagcaggagataagctgccctctgtgagggagccattccaagttgactttcttccttagaggggtggccgaacaccctggccagggaaggtagagggagaaagcatacttcctgcttctccattttctgttctttctctctctcgtggcatcatttatcttctaatatggtataggtgagacatcctgaccatgtttgaaaaggagtaaatatcttgcatgcctgatgtgccaagcactgtgtaggaccctggggatatgaatataagtacaggatggcctttgttcttaagcagcttatgatttgagaaagcagacagacaacctgagagataatttcagtgcattgtaggtgaatgctatcataacattcttttgttattagaatttgattatgtagaaaatgtaattagtgaattctgtattttttgtaccttttaacactttattaaagtacagctttgtattgttttttaatgtggtaatttttttctgctttttccttttgattcacaggtcttactcatacttcattgaagtgtcaatggatgaacttgattgggtcagagtgatagatcattcacaatatctgtgtcgttcttggcagaaattatattttccagcccgtgtctgcaggttagttttcagtggttaataaatgatttttattcttatataaggagatttggacttggagaagcagaactgcatttttcatcttgaaaaaagagttattcaggatgtcaactactaaacatatcccaagtaaaaaacttaggaaagtatggaaaatcatgcatcttaatatttacagtgtgttgtggaactatttatacaacatgtcttgtataatatgtatgtagtacacatgtgaatgaatgagaagggacagggaacatttgagaagtggaatgctttttaaactccgtgctatacagtgaatggtaatattcattgtgatacattgaaagcagaattattgttagggggtgcattcttcttatgaaagccatgagaaatatttctggagtcttccctgggaatggccagggccagaggacatctttgaatgccattgtacatgttctggttatctgttttttcctttaggttagtggttaacaaatggggtttgacagaacaggtgtttcaagtggggttgcatttggggcaaatgaggcttagctagtggggctctaggctcagagcttctcttcagccagagcacctctgcttttatttttgttatgtatcgcagccctcgatatggttgtcttttaaaagtatcaaaaagctactgttttaatatttcatattctccctttaggtataatccatcatttaaaatttctgaaattttgtaaagcctatacaaattagtgaatttgtttaggtggttaaaggcccccaaaattttgttgcttttttctgctgtgttttctcactggaaattgcctttagatattctttaccttaaagtcaaaagattaaaggtagaaagtgattagtttgtttgctcaggaagaaaagggaagggatatggtgagtgtacaccatggagaatgtggagctggcccctcacccatgacccatctgatctcccactgtggctgattgggagcagatgggaaggcaccacagcacttagtctcttggtcagaagttactcttatacttgtgaaacttatggtctaacagcaaaaggctgaatttttacctccactaaggaacttcacaaaaccgttcagcctctggtacagtaaagaacgttgcctacattttttttattggtatgaccggacacaatattgttacccagggatcctcttgtgtgaaaatgaagaaaatcaatttcatttccccaaagacagactaaagtgtctcaggtctagcggttgctcttttatcagaggagttttgaatggattaaaataagagggacaagaaattgagtgaagattccatatctcagagctgcctagggatacttccagagtgacagagggacccccacatagaggaggagattgagtctgcattgactcaggttattactgttgtatctgattaaaacacaggcagcataacaaagcgtctgatatggactgaaggactgtgtgtttgcatttaatttgaaacaacaggaacatgactcccagaacaaatc

SEQ ID NO: 120695 - DNA, 1484 bp, Homo sapiens
acatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcagtaagtacctgtctatcctaaactcaaccaagaagcttggtatgcctctcatgccattaaaaccgcaaagctactacagaaccgtgtagtgcaggtgtacatgaaatatgtacgtttataaacagctagcctatggaatgtctttccctttcattttcctgttaattcctcctgagattgattagcttttgtagacccccaaataggtatttcttgccattcctggacagatttctcaactcctccccagaatgtcagaaatggacactttcctaaaaagctgctgctcatgttaagaccttttcttccttcctccatcaaataaatactgagtacattctatgtacttattattttgggtaccatgaacatggagattcttttttttttttttgagatggagtttcactcttgttgcccaggctagaatggaagttgcaatctcggctcactgcaacctcgcctcccaggttcaagcggttctcctgcctcagcctcctgagtagctgggattacagccacccgccaccacactcggctaatttttatttttagtagagacggggtttcaccatgttggccaggctggtctcaaactcctgacctcaggtgatccacctgccttggcctcagaaagtgctgggattacaggcatgagccaccacgcccggctgaacatggagattctaaataacaataataatagctaacacttatgtaacatacatacataaggtagctaacacttatgatacttatcaccacttaagtggtgatttttcttattaatggatttatagcaattaacacttacagagtgcatagtatgtatcaagaacaggtcctacacgatttaattctcacaactctttgaggtatatactgttattgactccattttacacaatgaggaaactgaaacagagaagttaagtaacttgcccaaggtcacacagaaagatgacagagctgagagtcaaacctatgtagtttggctccagaagttgtgtaattaaccactaaactatgctgcataattgttaaacatagtctctgcctttgatccttttaatttcattgtggaaataagacataaactcccatgaaaagttaaatacaacaatattcaagggagtacatgttatagaacttcagaagaagtggcttggtatggttgagggagatttcatggaggttatgaagcttgagttgagccttgacatttgatttga

SEQ ID NO: 120696 - DNA, 3567 bp, Homo sapiens
taagagtatgcaaaatgtggcatacataaacccacattagcataatactacagtttataaaggcttctaatttaagttttctactaagaagtttggatactatccaacgtgtagcaacattgcaaagctccacatatgaacatatgaacatgcataaaatggaattactttacattttagaaagacatatatcgtcagtatatgttgagttgagctttatattggtttctattcttaatttttcattataaattactgtttagtctttatttttcttacaggttgttcacttaaccctgtagtatatattgatgcatatttgtgtcaacagtattcttgttttgtaacttttaagtaactagattgtacattgcagttccaatatgaattattctctttgtattagcaaagtacatgtatgtataatctttccaaagagaattgaaaaatagcatttcattcttatcacccttgcatattttacctagtctgaagatggtatgttaaagtttgagaactgctgctctgaggagttagctgacaggtctagaagtcagagtcagaatcatttctgatatcttacatttacttagcaaggttttataagttcaggaccttgacaaaccctttctgaatctgctacttattgggtatgtgattggacaaattaccgaatcttgtctgtgtctcaatttcctgtctgtaaaatggatattttaaaagtacctacctaattcaattttttgaatattaaataagatgatatatataaaaatgctaggactgtgtctggcttataagtaagtcttcaataaatagtagccattattgttagatgagaagtactttcagtgtccctactataaaatggttaatttgttaccagattctaatttggttttaagcttgttttcagattaatacatccaacgaatatatatttagtcaacaaatattttaatgctttttgtgtggaggttcattgttaattatattgtatgtttcaaatgatttaatcatttaaaataatcaaaggtcactttcttataaaatctttactaccagtaagtagtaaagttgtcatattggccattttcttattatttgcttgtgttgacaatgttatattatcttcaatcagtggtttcattgtgggaaccttttttattttttaagacagggtgtattagggttctctagagggacaggattgataggatagatgtatatatgaaggggagtttattaaggagtattgactcacacgatcacaaggtgaagtcccacaataggccctctgcaagctgaggagcaaggaagccagtccgagtctgaaaacttcaaaagtagggaacccgacagcgcagccttcagtctgtggccaaaggcccgagagcccctgacaaaccactgctgtaggttcaagagtccaaaagctgaagaacttggggtctgatgttcgaaggcaggaagcatccagcatgggagaaagttggaggccagaagactcagcaagtcggctgttacccttcctgcttttatgctggcagctgattagatggtgcctactcagattgagggtaggtctgcctctcttagtccactgactcaaatgttaatcttctttggcaacaccctcacagacatacccaggaacaatactttgcatctttcaatccaatcaagttgacactcaatattaaccatcacacagggtcttgctctgtcacccaggctggagtgcagtggcatgaacatggctcactgccgcctcgacctcttgggctcaagcaatcctcctgcttcagcctccctagtagctgggactgcagatgcacaccaccatgccaggctaatttaaaaacaaaaagttgtgtagataaggggtcttgctatgttgcccagactgtgggaacctttttataattcacttgtcattttgtgagagagaatttaattaaaactagataacttttggaaaattcacttaagcaagcacatgttaacttaatacttcccatgcacaagtaaggacactaccttcagccctgcatctttgtggaattcccactcttctctcaagtcacctatttatttgatgacacaaatgactgtttttgacatgtagatcatgagaaggaggcagtgccatccacttactaagaactagtaaagctggctgggtatggtggttcacgcctgtaatcccaagcactttgggaggctgaggtaggcagatcacctgaggtcagaagtttgagacgagcctggccaacatggtgaaaccccgtctctactaaaaatacaaaagttaaccaggcatagtggtgtgcgcctgtaatcccagctactcgggaggctgaggcaggagaatcacttgaacccaggaagtggaggttgcagtgagccgagatcacaccactgcactccagcctgagtgacagagcaagattgcctttaaaaaaaaaaaaaagaattagcaaagctgatttttattctcatttttctaggttaaaaattaatatcaatccaggcatggttgtgtgcacctgtagtcccagctacttgagaggctaaggcgggaaaagcacttgagcctaagagtctagcctgggcaacatagcatgacctcatgtctaaaataaatacatacaaacacatcaatataagtgttaatgttttctttccaaattcctgtggtttgtattgcagtctccctcgaatatgagcagcccactttggagagcacatagccaattatttgaatattaacccttactctcatataagaatataactgataattttctgagttctgttcatttagtattctatttagcatctttgtggttgttttggtatggtacttatggaagtatttgactttctaaatttcataaaatcatagccaccctatgagttttagaatttacattacttgttatctggtcctactttccttagtagacaatgagttcttcaaaagtagagacttttattaatctttgtgtttctgtcgcctagcactgagcctgtattgtagagagagctcaataaatctttaattgaatgaatcatatacatattcagaaactagtttgttcattggcaaagaagtggagaatcaatgtgttaactggtaattggaattacatgcatgcttaataaaataattttgtcaaatatttttatgatactattctttagtggtcaaaccggagcatatttataaacatttatttacaaacataaaattacagaatgacaagactttggagcttaactggacattcaaaatctttcccagagaagaaggtatgtcaggaatcctgtcatgtgaactccagtcatgttcttacgtagcactttactggctggaggataattctcttctgcaaggtttagaattgggtttgcaaaatatcagagtcaaggttacatctagcagcacggtcagtcttcacctgttccttagacttttggatgacaggggtagagtatatatcaagagaagtgaagtatcctttctgtgagaagtagaatgtgattttttttggagagtgttta

SEQ ID NO: 120697 - DNA, 1063 bp, Homo sapiens
ctttgggaggctgaggtgggtggatcacttgaggtcaggagtttgagactagcctggccaacatggtgaaaccctatctctactaaaaatataaaaattagctgggtggggtggtgcacacctgtaatcccagctactcaggaggttaaggcaagagaatcgcttgaacccaggaggtggacattgcagtgagccgagattaggccactgcactccggcctaggtgacagagcgagactccatctcaaaaaagaaaaaaaaaaagaaatagctggaggctttggtaaagcacagatttctgggtcccacccccatagtttctgattaagtaggtgtggactggggcttgaaaaattgcatttttgaacaagttcccaggtgatgctgatggtgctgttagaggatagatgaaagaaaaggaaccagcactaacaaagtggttgaagtgtatggagaaccaggagatagtttagagaagaataagaattttaacagcctccagactctctaggtctaccagtctgatttccaatttcgtagagcttatctcattcttatttttgttttctccagaatctattataatgcctgatacatagcaataacctttgaagctgcttaatactgtcctggtgcatgatggcatgtacctcacacacagatttcatttatcctcttttatctctgatgagtcatggggaggatatgatttctaattttacacacacacaaaataactacagaaaatttctttcatatatctggtgtgtagctatgtgcatttgactttgtgttagatgccctctcccccccctttttttttaaaaaaaaggaacaatccagtttgcaaaataatttttaataatatgtgccaggattccagtctgtgtcctgtattaggcacattgagtcttaaaagggaagcaaataatatattccctgttcctgggaagtttacagataagatgggtgaaatgagcaaaacccacaggaaagaaacaggaagaggtataatcacagaaacatggatgtagagaatctgaatctaaggacatattctttg

SEQ ID NO: 120698 - DNA, 1195 bp, Homo sapiens
gcggtagccgtcccgttcgcagtccacgaaggtgtagtgggaagtagacgtttcggggattcggggtggctctaccagcctcccaaagagaggagttcgaatcaggggcagcccaggttccctagcagtctcgtatcctgtctgagacgacgttgcctgggactgaggaggcgaaacccgggaccccggggtgggggtttggaaagtttgggactgctggggccctcatctcccctgccctggccagcctctgagtaggagctggttgttatggagagagttgtgaatcagtgcctgcgtgcggcatcagacacacccacgaccttgggagggcgacctgtcagtatagatccggggcagccaacctgttgcctagagtttctaacttcacatgtatgtgcatgtgtttccttggcgttttagtacattgttgttacagattttgagaccaaggtgctgataggcatcctcatttcttacttcctcatagacttagttatcttgctatatttcccagaaccgtgttgtgcttttgtcattagtagatccaaggaagtatggaagcatgttttgtttgtttttcctaaaggcagtacaggctgctattttctgggcagaaaatacggattctgttcactgtgtgggcggaaagtgttgatgatgggagaacccagcatgtaaaggtgtagctcatcctcagccctgtgctgtcttctcagtgctctggactctatcatgggtagatgtataggggttgtggttaccatacttgggagcgaggaatattggagacagggaagaagccagtcttttctttctgttgattaaggcaatttgtagaaccagtgaaaagataggctgtactgaaatctaatgttttgtgtaagaggatagaggaaaataagttcaaggttctcatttaggtctaaaattctatgattctgtttcataactgagaatctgtaaagtatgttacctcttggaaccagtaataaccttgctttgtaacacttattagattactcggaattcaaagtgtcttcctccctccactgtaatagcttttaggacaggagtcatctgtgttttcctccttgccctatgtctaacacataggaaaaatgtgcttgccacagagtaggcatgcaatggatatttgttatatagcacactatgctcaagtggtgtatctatg

SEQ ID NO: 120699 - DNA, 2287 bp, Homo sapiens
atgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaacctttgtccatcatgttctttctttaaaaaaaaaaaaaaacaactccccttagtgagtactgaaaggatttgaaaaggcttgtaggctcattctgaagagagaacaattgtgattctgtacagcccgtaaagcaggtagtgtctatggataagggagtgtgggaaaggtgggaagaagaaagtgaatacggaataaaggattgtggtagataaagtgcaaacagaagaatatcaaaaggtaaggaacttatgaagaccaatttcacatgttgagtgctagaactgacaaacgggagggctaatacattcacaaattcagtaatttaagctttatttccaaggaaagaa

SEQ ID NO: 120700 - DNA, 2608 bp, Homo sapiens
gtgtgtatatatatgaaatagcaacaaggttctttatatttttcagtacaaataaacacagttctcttttggagatagccgtttctatttattaacaagtaccataatttcagctaaatgttactatatttacagaattgatgaattacagaagttttcatttttgtatttcaaatatttacagatgcatttttcatgatattttttcactgatttttcctcctgcttattccattaaaataggcttactacatatagctcttctttttagtaaaacttgaatattaagttatgttgattatagtatgaattagcctttcctgttgttaatgattcaggcttgttgttttttcattgcaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacagtgagtatgagtttctatatttatatatattatagattttttaaggtagtttttaaaaatcttttttgttttgtttactgaccagtataattcaaaccagatctgcctatgacttcacatttttaataatatattgaagtgtttttcatgcatcttttgatctttgtattgttcttgggcaaatgagatgtgttttttttagagacaggctctctgaagcctctaacttctaggtagtcttcctgcctcagcctcctgagcaccttggactacacatgtgtgccaccacacccagctagtttttgtttgtttgtttttggtagaggcatagaggcaaggtctcactatgttgcccaggctggtctcaaactcctggcctcaagtgatccgcccgcctcggcctcccagactgctgggattataagcatgagccaccacgcctggcccatttgtcttttatttttatttatttatttatttattttttgagacagagtcttgctctgttgcccaggctggagtgcagtggcgcgatctcggctcactgcaagctctgcctcccggattcactccattctcctgcctcagcctcccaagtagctgggactacaggcgcccgccactacgcccagctaattttttgtattttttgtagagacggggtttcaccatgttagccaggatggtctcgatctcctgacctcgtgatctgtctgcctcggccgcccaaagtgctgggattacaggcgtgacccaccacgcccggcctccatttgtcttttagataagagaatataagaccctgaaattgtaagatatttgcctgtttgtctctaactaatttttaggtactataattagtctttcagcatccaaaattttgttcttttattattttgctacattttggatccagaaatgtgatatcatgtgttcctttaaaaattcttcaaaccattttgtaataattaacattcaaatttggtatttttataacttgagcacttaaaaatgtaggcaatttctttacattgtttatctgcatactttaaaagagattgatttcagagtgtgtgatttcgtgtgtcccttgattcaaaataaagctttggaatcaggcaggcttagatatgagtctgtgactctaaacaagtaagtggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtaagtttgcctgtttttatgtgatatatgtagatttgtgtgattttgtattatgtatataattatgattttaataaacctaaaacattaatgtcctaattaagtatgatcaatttattagagatatgattatttttattttccacaaataatcttatttaggagttgtttaatttcagagtctcgatctaaaattacacttaccatctcaccatgatttacttttaagtctcagaattaatttccagtagacttttttttttaaaaaagctgtagttaatactaatcccagtttctgctagcacatacacttctgccttgatctccagtctctcaatcaagatgacagtattgcaggcttcagctggctgctatagtcaatgccaaccacaaacctattaagtattagtaaatgattactgttttttggtgtcgattattcttaactgattagactgtatatgagctgatattgattaattttaaataatttataattcaaggcaactaattaactacttatacccagcccattagatct

SEQ ID NO: 120701 - DNA, 1031 bp, Homo sapiens
ctatagtgagggccaaacagcatggtggagcttttgagtccagtaatccagtgaaatgattttcagaaaatcctcaagagaccacaggatgaagctatttagtcaagctccccgccacccttgaaagacaagctgattgaactctgaaaaaggttgtgaactctctctggatatgatagaacatcttctgtcttagtctaagagtaagaatgacgggtgacagagatttgtcttctgttttatctcctctggttggttttagcgaaattattctaggccctgtttaatggtttgtgttttatatcaatgattcattaagagcttattttagggaagttgcctgctatctcatttaaaaaagcaaaataacatttctctttttaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtaagtaattatacctacttttacttagtaaagctgaaaagtagtcagtagtactatctggtactttttgtaaatattcacatgtagtaagtgtttctatatttatgatttaagttcctctttcacattgaccaaacatatttgcagtgtgagtaacttttaaactactccactaaaggatttttttttgaatgaatagtgagcatatccaataaaagacatcagagagtaactagaagcccaaagggcttttatagctaggattcttttttttttttttttgtgagatggagtctcactccattgcccgggctagagtgcagtggagcgatcttggttcactgcaacctccacctcccgagttcaagtgattctcctgccccagcctcccaagtaactgggattacaggtgtgtgccaccacgcctggttaatttttgtatttttag

SEQ ID NO: 120702 - DNA, 1049 bp, Homo sapiens
aaacaaacaaacatgtaaccctgaacttaaaataaaagttaaaaaaaaactatcatattgcccccgttttctggtgtgtgtatagcaaagcccgtttaagttagtatttttgcctatagaaatatgggctctagatactattatgacagatattaatatgtagctatgtgctccgtttgaatacctccttgaaatttgggataagggcagaaaaaaaatacatgtaataggaaataaaggtgaagagaaaattaagtgtcgtatatggtcaacatcattgtttcaaaatctcaggttaccttggatgtgcatttacatatttattgactacctactgtatataaaacatgaataatgataaaacaatacaaatatagctgtatatattttttgccttctcccttgtattgaattcaaacattaacatcagatttttaattacagctttatcattctcagaaagatgacccccctcttgctcgcaacatgccccctatagcaggaaaaatactctgggtgaggcagctctatcgccggataagtgagcccatcaattatttctttgtaagccaagaattaaattttaatatgtggattttggtggttttaatataacaaatatatcatatcctataatatttgtgtgcattaaagtagccaacaacgagccaattcttttaccaggcaaggaaaatttagtttataaatatacttgagagagacaaagtcaattccttcaggtttagtagataagccagtctaattacagttatctcaaagtcagtgaatcttataattttatgtcttttaataacacaggacactttgtaaagccttttaaaaagtaaaaataaaaaatttgaaaacaataaagtacaggcctagcacagaagcttacttctgtgtatgggcagataggtcactgatacatactcagtgaaggtgaagataaagccaaagagtgtattcctgtatgaagaactgccactgagagcggaatataatacagttgattcattctctatgtccttcagattattagatttctg

SEQ ID NO: 120703 - DNA, 1081 bp, Homo sapiens
aaatatttatttatttatttatttattatggagttttgctctctcgcccaggctggagtgcagtggcgcagtctcggctcactgcaacctccgcatcctgggttcaagcaattctcctgcctcagcctctggagtagctgggattacaggcacccactaccatgcctggctaatttttttgtatttttagagagacagcgtttcactatgttggcgaggcaggtctccaactcctgacttcaggtaatccacctgccttggcctcccaaagtgctgggattacaggcgtgagctacggcacccggccaagaaattttatttttatcgtttgatacatggttacctttttttgcgtgctggaatttaggaatttgccctgttattcatggttcaaggaacatcagtcaattatatcttgtccagaacagtgggatgggatcagaaaaggaggtagagacactgaatgcctggggcaggctgtggggctggaggcctctctctttctaaaccctttgtttccttttccagtcttccctctatatactgataacgtttccctacttctgcttcttgctgatatggccttccccatctctgttttactgtgaggcagaatctaaactggtagcataattatttgatatcattttacatataagtactttcattatttggatataaaaacattcagcagtcttttaaagtaaatcttttcccttaaaaaaacagaaaaactcagacattttatcaagtccggacggtaaagctgtcatccgtcagtataacaagatctcctatgtgctggtggaattcgaggtggtctatcacacagcctggatcagagagatttcacagttgcattacggtgtgtataacactgccatgagcctacaaagtagggattaggtgattttgaatgagttcatagttctggagaactttttccatcccttccacataatcttaggatagttacaatttagatttagggatgctacagtggtttatttgtttacagttgttaataatattctgattttataagtgaaaatgatcatgaccttgaagatgacatacttaa

SEQ ID NO: 120704 - DNA, 1006 bp, Homo sapiens
cttcctctatcattctccccctcaaatcagccttgcactgggccagccgaggcttgccccactcagtggggaatggaggtggtgaaaattgagggatggactgtatgtgccggcagtattacacatttgtttcttctttccacaggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagtaagaatgtaaaattagtcaatgatcttactgatcctttttggatttgatagcatatagatttttaaattattttatatgtttgataccttttgcatttaaaaaatagtatgtttcatcttaaacataacgtgcaggcattttttcctggctttgggtggtgggtgaaaaggatttttaaatcacttttctactatgatgatcttaagttaaaaattaaaataaaccttagcactaattttactttctgcatgatagtaggttggataaacttaaggtaaacataaattcgtcacttaagtagttatgaatatgatatgatagtgacccaaaatgttatgaacatttttttgacacttcctgtatagaaagaaactggtttcttttttattttattttattttgttttattttattttattttattttattttagttctagggtacatgtgcaggatgtgtaggtttgttacataggtaaacatgtgccatggtggtttgctgcacctatcaacccatcacataggtgttaagcaagcatgcattagctatttttcctgatgctctccctcccttcacccccatcccccaccaacaggctccagtatgtgttgttcccctccctatgtcaatgtgttcacattgttcagctcccacttacaagtgagaac

SEQ ID NO: 120705 - DNA, 1037 bp, Homo sapiens
acatgtgggatttttttttttggataggatcttgttctgttgcccaggctggagtgcagtggtgcaatcatagctcactgcatccttgaactcctgggctcaagcagtcctttcacatcagcctcccaagtagctgggactacagtcacatgccaccacacctggccacatgagggaaaacttctggtaggaatagggtgtttaagctcaatcttaaaggcagatcagggcttagtcaagggaaatgttctcataaaatccagcttgtatttgaaagaaaaaaaagtcaaatgaaaccttagccgcagctatgaccttatcattaagttttggtcacattgtttgcaatgattggtatagtaagtttctcattaaaaagtagcaagattttttttctttacagaataaaccatttgctaatgtcaagttatagtctgacttggaatatttgggagcagtaaacttggccttaatgacagatctttaacgaagtctttgtattgaaaatggatatagttgtatgcatttggtatctataagacattgtacacgcaatgtatgaaatatttgattggatgaactctgcctttccaataatggactttattaaatattatacatgatgtgataacttagttactttgtttcccagaaaagaactcaacttgctgcagaagctgtatggattgtatgacaccgtaatgagcagtattagtggttattatgaaatactttggggagatgtagatattgaaaaaattaatgcagaactgctggaatttcaaaacaggtgagtttcaatggaattttttataatgcctgtcttcttaggatcctataggtatttcagaagctaatttattccctaatataatagtgtatatacataaaaccttcctcaaataaatgtgaaggtggcatattttttttctctttctttctgaaagatgtcgtaaacttccaaaaggacttaaagattggcaagcttttttggatctcaaaaagagaattgatgatttcagtgagtcatgtcctct

SEQ ID NO: 120706 - DNA, 1071 bp, Homo sapiens
gtcttacagccgcatctccctgcagtatctgacaacatcaatgaggtgacatttcatgcaaaagactatgatcgcatcatggccgtcatatcaagagaaggagaaaaaattgttgtaatttaccttgctttaaatttttttattagaatttctttaaaaacttaggttgaggagaatacagttctcttacagaaaaaaacaggaggagagggagttctcattctacagccctgggctttgttaaaaactagtttagataaatcctttaacttctctgagactcattttgtaatttatgaagtgaaagttttggactaggtgatctgtgtagttccttccagctatagtattaggtgattttacccatatttaaaatattttgtataaaatatgaaactgtttgcttggcatagggcactatgatttattaagtgtgcatggaacgtctgtaaaaatgccaaattattatcaatttataatatccttgtaattttgttttagttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggtgagaatacacaatgcttaagtaatggtgaaaagaaatggaaataaaggggaaggatgcttagcaggtggttgacctgatggtgtgaggcaattgtagctttgaattaggttagagtggcctactcacactcattttagcctcagctcccaaccacctgcttgtcaacctacaccattctagaccaacccatcccatgtcccagaggaggatatgccactattttcccatcatgaaggatacatacattgagtctaatagatacatatgtaagcgtgtgtgtgtgtgtgtatttgtatacagaaactcctcgacttatgatgggattatctcccaacaaactcatcatagttgaaaatatcattaaccaaaaatgcatttaatgcatctaacctaccaatcataagc

SEQ ID NO: 120707 - DNA, 1107 bp, Homo sapiens
gttaattgtgtagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtatacacaaacctcctttgtgatcattttttccctgctagcgtattaacacagtatttttttgatttttccattttaattacttgcaagtgaaaagtgattttctgttttaattattttcaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggtggggcagagagatgggaagaagaaccctcagagtctctccacgtttcactttctcaataaacacagattctgtttctttgttgcaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaagtaagatttttttttgtacatttactacttcgattttgatttttttttcactcagttgcagtttacagccatctgaaatagaaagttcagacagtccataaaaatcatttgatgatgtggctgtaaaagctctgataattttgatttctattaaagatcttcttaatgatcttactgttttctctattattttcacttcccagagggatgttgtcagaggaaggggaatgaactatctttcccattgtcaggt

SEQ ID NO: 120708 - DNA, 1050 bp, Homo sapiens
cttctggtcaacatcctccaaagagacttgtagaatataaataccaaaatccttaccatgatccaagactctacacattttgaccgcctctccctcttcccgtgactctttgcttccaccacatttactgatctttgtatacgctggatatggtgttcactcagtacctctgcatttgcagtttcctctgcctagagtgctcttcccctaggtatcgaactggcttactttctcaccttcttcaggtcttggcttatatatcatgtcaggtgaagcctcccctgctctccttgagtcacacccttgagcccctcctatattctacaaaagtcttagagtataccattttatttacatatcaacatgcatctgtacatcttgtctctcaccactagaatgtgtgcttcatgaggacagaaaattttgtctatgctacaagagaggctggcacacagtagtcattcatgaaatgttggttaattgaaagacggttatatttgaggtgcttgtgtgatatgcactaagagatgctcaatagagacttgaatatacaggtgtagagcttagaagagaatttgaagctagagttatagatatgagattctttagaatatagggttgagatagcatttcctggaacaatgagaagaggaaagagcccaggatggaaccctggagaacagttacatgtgagggatgagtggacaatgagtggcttaggaagtgatcccagagccctgagatggacctggaaaaaaaacaagcctctgaaaccaagagaggtaacatttccaaggaggggggttggcagtgttggaggatgcagagaagataagatgagaacataaaaccaacaaccaaaacagttagtaatataatattgaaaactcaggacagaaaccatcctacattctgatctaaaggtttttaagtgttgaatattgagtatgaaagatgtctacagtaaaacttgttgtaacttggagtattaatgtaatttaaccaaatatcttataactcacatatctaaatttatttggaaattagttt

SEQ ID NO: 120709 - DNA, 1447 bp, Homo sapiens
atcaatgctttccatatctagagtacctcgaggttatctcttaacgggtatctctctgggtaagaatgtggtattgttacagctttgcctttttatatcctagaagttggtagaaatagtaaattagcatataatacagtctttgtgctcaaacagaaaaaacatctattactatacgtatagctgcatgtcagacttgcctgtccacttattatggatatacagatacatgaaagactgttgactgagtttggatccacacagtaaaatccaggttatgatatgcagatatatttatggaaatcctaacacattaaggaccctaatcaaagcaatttatagaagatagccattattaactttaaaggtgaacattcgttgttcttacctgcatgacaaccaactcacgttcagtttttgttatgacatatttccacatatactaccaataattagggatgattattcccacagttcatatagtccttaagaattcaggggaggtgacttgttcaaagccaactgatggtagtagaacaaggtgttggaatctgcatccagtgccttggtcttgaatccatcctatccaagagattatggtcttttaaatcctaagttggtttatttatgatttttttctgtccgtgttgtcacaaaatgtgaacttaatcttgatttatttactcagcagattttatctaaaataggatttgtgagacagttgtaaaagtaattctacttttagttgtatctgaaaactaactgagagtattacattttttcatctctaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacaggtgcgtgttgcggcactagagtttaaatgtatgacctgagaagtttatactacttggttaattttttttatttttatttttgagatggagttttgctcttgttgcccaggctggagtgcaatggtgcgatctcagctgaccacaacctctgcctcccgggttcaagtgattctccaacttcagcctcccccgtagctgggatcacaggcatgcaccaccatggccggctattttgttgttgttgttgtatttttagtagagatggggtttctccatgttgatcaggctggtcttgaactcctgacctcaggagatcctcctgtctcagtctcccaaagtgctgggattacaggcatgagccaccctgcccagccggttacttcttgcattacctactaggataagtagagtaaggagcattgtcatcatttgctgtggggcttgtgaagcattgatggcatctctcacctgcccactgtcttaaaaaaatgc

SEQ ID NO: 120710 - DNA, 1004 bp, Homo sapiens
gctgtctctccaagttggcttctagaaacatcctcctaccccactgtaaatagaattatggtacttaaaaaaatttgttggcagagatatgatagagttagtgttcattgttgagttaggtgtctacatgattcagtgtgtcaggctgatgaataataaaaaaacaattgtaaacatttcttatatcttctgcagattgggaagagcagctccactatccattgggtctaaaaataataaaattctacatgcgtgcacacgcatgaacacacacacagaatagttttaaaatagaagggagtaaatccagtttgttctgttcttcatgatgtaaacatagatggtcaaggaaagattcgagctgaacaaatcagtattaaactttaattttaaaaattctgtcatagaccattaacgaggaaaaagtctaatatcatctagaaacatatgatcaaaacttgggctcatttagtgcaagaaaatgtaaacattgcattcttttttcaaataagcacgttttaaatctcaaaacagatttcacgaataattcgaacgtcgtgtggaaatgcattgctggtgggtgttggtggttccggaaaacaaagtctttcaagattggcctcttttattgctggctatcaaatattccagataacattaaccaggtaggatgaaataaaacacaatatgtttttctatagttaatttctctatagttaaatgtttagaaaaaaaggaagcacaacagtttcctgtatttctttttaaggtaaactttaagtattatatatataaggatatttacgcaagtgtcacaaagtaaatacatctatgtagccagtctacagatgaagaaataaaacacttcttgtatcccagaagtgcctccatgttacgttgcagtcattaccctcccaagggtaaccatattcaaagggtaagcccattgattagttttgcccagttttgaattttgtatcaattgaactatacaggatttgctc

SEQ ID NO: 120711 - DNA, 1028 bp, Homo sapiens
tgaatgaaaatggatcacagcacaaattcatttcaaccacttatccctaatatttgtccagaaccttaaagttttgcactgttgacaccagctttcacatagattcatatatgcgattttatttgatcttcacaaaattctgggaggggtagagcagatattcttttctctattttccagatgaggaaacagagttggagttaagggtgaagtcaaagacccctcagggttgaaacatcagacagatttagtcctttttccacctcacctctgagaaaccttgctcaagtcctgtcttcctgctagtgaatcactctacatgatcacactgatttcaccttgggaaaggtgtcgttttatgggagtacgcacaatgattgaaatggtccttttaatgttctgctttcagataccgccgaagagcacatgtgactcccaaatcttacctctcatttataaatggttataaaaacatttatgctgaaaaggtgaagttcattaatgaacaggctgaacgtatgaatattggtaagaggaatggaatggaatgggatggaatagaaatagggtttatttgatagggatctcaatattttgtttggtggacattttgtctgaaaatgaaatactcactttgttagtagtagataattttaaaggatggccttgagggtattttgacctgtcgagaaactctgaacagaagaaaatctaaacagaagtggcctattttctctgcagaaccatttctcctggctctttcaactctgggtcccctgtgctgagtcactgagccattgctggcagatggggacaagccagcttttgggaatggacaacaatttcagtttttggtttcattttgatttgccttgatttgtataaactttgccatgttaattttccctacatttctaataaagaaaaaggcaaaatagaagcaaaaacaaataaaaacaaaaagagattgtgtacctaagcaagagttttccaagtgtctgctatatgtagtataactagcaaaagta

SEQ ID NO: 120712 - DNA, 1015 bp, Homo sapiens
taaccagttctttttctctacggtgctaaaagttgcaaagtccattacataagttttcacagttattttcatttttataacaaagagaaccacaaaaatgttaatatattttctatttcatttgccacctcagctgcaatatgattcaaaggcaaaaaatgatagctacaaactgtttacaaagccacagagagcataaatttgtcaaataagtttcttggccaaactaatcttattcaataggacattgtgactttcccttaaatgtagctacgtgatattcttcggtcagagctattttctttgccttcctgttgaaactcagaaatatggtcaatattgttgcttttaagacatgtatatttttaaagcttttgtctacaattttgtgtttgttatattacatgtacagtgcctaataaatagtaaacattgaataaatatttgatgaaggcatatacctgtactcagtaaaggtatatatgtgtgtatttgtaaaggtcttgataaactaatggaggcaagtgaatctgttgctaaactctctcaggatcttgcagtcaaggagaaggagttggcagtggcttccataaaagcagacgaagtgagtttgcatttattttatcactgatgaggaatatttttccatattaaaatgcattgttttaaaatggtactaaagaacaagcagggtataaacccatggacaattcctgataagatagtgttcacaaagaccattagacatttttgtttaacttataccagcgtatacctgaactattaattttgctacttggcctaagactattatttcttctctcactctgtctgtctctcttgttctttttcatctgtttatgaaatttctgcttgactatgagttatatttggtcttctgtttaaggtccctgtatgttccaggtttctgggatggcccaaatcgaggaagagttggtagagtttttttttttaaaagaaagaaagaggaaaaatccatactcctctcaaggag

SEQ ID NO: 120713 - DNA, 1010 bp, Homo sapiens
caggcagacctgcattcaacctctatatataatacacacacacacacacatacacacacacacacatacatacacatatatgtgcatgtatatatatgtggatatatacacacatatatacacacgtgtatatacttacacactgctaatacacacacatataagtatgtatgtacatatagatgatctggagtaaatttgcttaactttcttgggtttctatggggattataatttctcattgatccttaaagaatcaatgtgagcattaaaattaattaatacaaaatgctaggcacatagaaagcactcaataaatattagtgcttctgttcctgctgatgacctggctcctgtctgtctcttcaactttatctcttgtcattttgtccctacacacaatgcgatccagtcatacagaaaaatgtataggattctggaagaatggtcaggatctgttacctttaaacgtgcctccacctctgctgggaatgcttttcctaactttcattgcctaattagagtcattctttaaatctgggcccagacctcactcctcccaggaagttttcagttcttcttcgaggccttcctttgttttcctatcactcacatgcttctgtcatggcagaaatccttatgtagggtaattgtatttgctttgccattttcagaggttatgaggacaagactattttggtttgctttgttttatatgggagaatgcctgcaattgttaaatgaatgaataaatctatgataatcatttaataaaattttcacaatgaccaggacacattctgcacccccacttcctttatgggtcttactgtaacgtacaaaaggaagagatcaccgaaccgaaggagtcttagaacatgttattgatcatatggtctcccagtccttgccttgatggtcaggcaatgtcttaatccaaacccagccaatggatagaaattttcaaaaatgtttttatgagccatatattacagtaattttcttgtctc

SEQ ID NO: 120714 - DNA, 1134 bp, Homo sapiens
atctaaacacgaagacccaaccaggaattcagaattgcagttttaaaaaaatgtaagcatatataaagtgaatgtctagtcttttaggttgactttacggaaagtgttaaattcttcccagtgccaataggagacagaatacatggatagaccctcagtgcgactcaatatatcatttctgacattcttatgtttactttttatcacttactcatcttgtaggggtcctgagaaaataaatgaatatccagatatgcaagttgctttgctttctctgagcgattatagctatgtaagtttgaaaggattaatccttgactattctcttccatctgtcaggagcagaactctgacattgcatctgagcaatgccccttaaccctcctcttttgatcatagagaccccattacacatctagaccccattcaacaaaatcatgactcaccaagttttagaaattaatttttgtatgttactttaatttttttaagtaagtcttcttctattgcccttaaaattcttgattacctgtccaacaaatctctcggtttcccttagcaatgggcacattctttgtaacacagatagaccaatgagttctttctgtttaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgagctttgtaaaaaaaaaaaaaaagaaagaaagaaagaaaagaaaaagaaaaaaagaaaaaaattaagaaagagaaagaaagaaaagaacaatggtgacatctacttatcttattgagcatagcagcaaatgcaatttcctttaggcagtagtatttggtacgtcggaaataaactatttccagactgatacttcagtgtttccttttattttttatagcgtataaaagtttctgaggtgggggcaatattttgataagagtagtcgtttagctaaaactaagtaacattaaggaaacacattgtctggtcttaatatgttagtgcaacacacagtatatatatgtttaagcaactctagatat

SEQ ID NO: 120715 - DNA, 1038 bp, Homo sapiens
tcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatttaaggatgctatgtttaaatactgataatggttttcactaataattgcaagctgaatggagtgttgagagagatttcccatcacacctaataaatacacaggacattaattttctagaaatgctctgtagatagccatttcagctgtaataagaaattataccatttataaaaataaaataagatattggtttatttttaagcttttgatctcagaatgtctgtacaaactttggtgcagcttttccctgggaattaatgactagagagggttaatgggctaaaactctgttgggtcatcaacttttccagctagtcattaattctcaaatgccctaagcctcaatctttatcacttaattaaattcaataatttatttaatttatacatgtatatctcaaagcaattatacataattatttttactcggatcaaatgtttcactctattgagtgatttgacagtttaactttgggccttaaataatttctttagtttctgtgggtgcaaaactttaatttaaatacggtgttcatgttaactgtctttggaatactagcctttataacttccatggtctgtttgtcaaagtggggtaagtattgattatatggcataatcagaaaagaaaaccagacatga

SEQ ID NO: 120716 - DNA, 1012 bp, Homo sapiens
ctcacaccggcttaactagtaaaggggatgtgccgtctatacaactggggtttcagaggaaaacagcattcaggattagtttgtgtcatcatggacccacttactttctggttccccactctgtgttccacaatgccagctttatgctaaacatggtgtccctcaaggcggcaacatggctgcacctgctcatgtctggttttcttttctgattatgccatataatcaatacttaccccactttgacaaacagaccatggaagttataaaggctagtattccaaagacagttaacatgaacaccgtatttaaattaaagttttgcacccacagaaactaaagaaattatttaaggcccaaagttaaactgtcaaatcactcaatagagtgaaacatttgatccgagtaaaaataattatgtataattgctttgagatatacatgtataaattaaataaattattgaatttaattaagtgataaagattgaggcttagggcatttgagaattaatgactagctggaaaagttgatgacccaacagagttttagcccattaaccctctctagtcattaattcccagggaaaagctgcaccaaagtttgtacagacattctgagatcaaaagcttaaaaataaaccaatatcttattttatttttataaatggtataatttcttattacagctgaaatggctatctacagagcatttctagaaaattaatgtcctgtgtatttattaggtgtgatgggaaatctctctcaacactccattcagcttgcaattattagtgaaaaccattatcagtatttaaacatagcatccttaaatattccttctttgcctgaaatgatccgttaatgaaaaatgaaagtctgcctttaactgaaaatggaaatttaactgtctcaatctgtcactccttaagtactacctattcatattgatcatgaaattccaagactgctagagatgcattcttagaaatcagaaggtgtgtctcccaaat

SEQ ID NO: 120717 - DNA, 1042 bp, Homo sapiens
atgggcagaacttcacattacctctccctgccctgtccaaagatggaggggaacttaatgctcatcccagaaaatactgtgtgtatttacccctaattcattatccctaccactttactaggttcctggctgcccaggagagggatgtggtgtttgtctgcctcccaacactgagaaagttaaaatcagattaaatgctttgctggtggttatctttactaagttccattgtggcctttggattgtcaattacagctttcaagtcacagaagcctatttcatacattcttatctgggaattgttcgctttgctagaccttatcacatcctaatacaaatattgctttaactctgctatttcattcccaattcacaaataatattttatgattgtgttcccagtagtgatgattcaactcttccactgtgcttatcatggagagctggttgggggtatttgccatatggttaatgtggcaacctgtgtttttagtggccattatccaagtgctaaagggaagaagagcaacaggaccatggtccagccatggggctaaagtgcccttgcacttaacaccacatgtgtttgggttaaaacggaggaaaaatattttcactgctagggcggtgaagttaccagtggagtgtccaggaataaaaggctgaatatctcttaaaatcaaataatagagggctagaaataacacttcactaagagtcaggaggcctggactttcgtgcttgctgtgaaatcagttagctgaaagcagttagttgatcaagttatgtctctctcagggcttctgtttccccatctgtgcagttagaggcagaagtaggtgatctttcaaggtttttttcaatttctaaaattccatcgcccaattctgtgacaatacagtgagtgtaggtaattctttttcatcaatttcagaagtgtttactgtgatatttccaaaatctcctgggaattttagacatatgtttcagaaatatcacagaagtgtttgctgtgattttgtgtaaatattttttttacttg

SEQ ID NO: 120718 - DNA, 1049 bp, Homo sapiens
ttgttcatgaacttgtcccaacaaaaatttatttagatttttttttaaatggtggaattattcaggatcggaatcatggaacagctgcagcaagaaggattggaatggcttgtgaaaacggcagtgtgtgtgtgtgtgtgtgtgtgtgtgtgtgtgttgagttggggaaggcagaaaagaaaaagaaaagttagtatatacttagaggtaaaagagtagaattaaacattcccatagatgtatagggattctactctccacatgagtcctcaccttaggcactagaattagggtctaggaactaatctaataaatccctggcccttccttagagactgattatgtgttgcgataggaaaagctgatgccatagaaacatctggactcatctatgtgggttgttggatcatcaattcttggagctatcaggtctaatacttgccatacctttaaaatgctctctggaatatcaaaacaattgaatcatttgctctgagtccagtttgattatttattggtgatttgacaattgtaaacagttagccactattgcacaggagtctcttaggccctctttgattaagtagagggaaacaaatgagggtcatgtgaaagtttcaagacagacacgtcatgtatacaacagaaatttttagttttcaaaatctgaaatggcaagattgcaaagggaagccatcacagaatctaagtgctcttgagagaggtttagataatccaactgaaaaaattcaaacccttgcatttgacatttcaaactttcaagagtccattgtagaataacagttcattcaacaggtatttgttgagcatctactgcattttttgagttgtcagtggagacctagactttttttaaaacccaagaactccaacttggcaaatctttggagatttctttatataaaccccttagctatagagccatgaagtaatatttctaatatggctatatgccacataacgtttcagtcaacatggattgcatatacggtggtggtcctgtaagagtataatgtatttttactgta

SEQ ID NO: 120719 - DNA, 1064 bp, Homo sapiens
acttatcttaaaagttgaaacatgcatgcagttgaatacatgaacagagaacacaatattctagtaaaatgacacaaaaggcatttgagacccattccgacattttgaaatatggcacaaccccagttttaaaaagtcatataaagtaccgtataagaaaaatacaaataagtctgagaagaaagttcaatgaaaatagctgatgagacaacaaaatgaagtcaacaaaagtcaaggatccacatgttactatatacattttcagaaatttaaatttgtatgtgattcatattactccatgagctctctctagcattaggtacactacagatagaatatgtggatgaactgctatgttagggaagacagaggggtgtcaccatggctgacatcttacagagagccacgaaacaccaggtaagcctgggtaacattgaacctctgactttatcatgaactctgtgcatccacatttccctggagccccagagctctttgtttcctgtaccaaacaaatccaaaaccttattattttagttctcccttatccctctcctggactgctccttgccccatctactttagtgacatcaatgtctgcccagttgcccaactgagaaccctcagagatggcttcctccttgctgtggctccccagaccttcttagtttccaagctctagttccaaatcatttccagcatcccctccccgtgacccaccgtcatccccactgccttcagttctgccccctaacttcctgatcatcctctgtgtgcggcactgccatcacctcctaacacatcctcctgcctccaaccactgttccaaggtaagttttgacatttgaaaagtgattattaaatgtattcgaagactccccataaccttcaggataaaatctgaagtctttcacatggcatacaaacctttttcatcactaagcctttttctatctccagcttctgctcttgcttccttctttcttcttcccacactctaccctgtgctgtgagttacctgaagctcatcaagcattccatgactcccctcatatttctttgac

SEQ ID NO: 120720 - DNA, 1050 bp, Homo sapiens
catattttattgttcccacaaccagaggcttttgtattgatctcttcaaaatagtcaataagtgatacatcaaaaggaacaaatgacagatatttaactggctgtcccacaaaatcaaatattttcattgattggattaggaaaggctctctttagctgtcatagctaaggcaacaatgatctttggaaactatagctaatcatatttgttggtaactgctctgtaaagatttttgctgtattaactttctatgacatttctaataactctgcaaacataatgaagaaaaaaattccactgtacccctatgaaggttagattgcaaaaagaatatctaactgacacccagtacttaatcatgtgaaaggagaaaaaggtacaattttatttcagctctttaaggtacatttccaattattagctaagtacaatcagtaagaaataaaaatcattttagttgaacagtagttttggaaacgcaggaaatggaaagtttaatggcaagtttggttctgcaagacatattttagaattcatttgggctggtagagatacatctagaggaagaaaaagaattgagaaagaagaggttattggaagagaaatgtcagatgagaaaatctcctttattgcattgtttactttgttttaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgaggtgagctgttattacatcagtaggcatttccttctttgttgatgtttcttattcatgtgttttaactttttcttctccagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttg

SEQ ID NO: 120721 - DNA, 1050 bp, Homo sapiens
tgtagaggatggtgaccgtttttccatctccagtgaggatcggatcagggaagtaaatgctgattagaacgaaagacagtaagattcattgcaaagtgtttctggaatccccctgtgggggctcaccgtgtgaggactgtgttttttgaaccaaaaacggaggcacatgatttgacagtaaaaccatgggcagtcccagaaaatcaggacatatggttaccatcattaactcagtgggtgacaatcaactacatgaataatgggaccacttaaaagccatcatatggtaaattgtatccctctccagggtgctttcagcctcagaactttaaaaagtcagtgagaaggtgtggtagatagaatagtgtcacccaaaacttcatgtccacccagaaccttagaatgtaattatttggaaatagggactttgcacacattgtttagataaggacatactgaattaaggtaggtcctaaatccaatgtgactggtaactttataagaagaggagaggacacagagatatatatacttatacagatgaatgtgagaatggaggcagagattgtaatgatgaaggaaagccaaagattgtcagtaaccaccagaggcgaagagagaagcttagaacaagattttcccttggggcctccagtagaaaccaaccctaccctgatttgacttctggcctcctaagcaatgagagaatagatctctgttgtttttagccacccaaggtaatgatactttgttatgacagcctttggaaaggaacacagattttgattccaggaagcaggatgctgtggtaacaaatgcctacagatgtggaaggtattctggaattgcataatggggagaggctggaggaattttgaaactgcctaaaagagattgttggtgggaacctggaggttaaggtgcttctggtgaggcctcagacaggaatgtggaagataatactggaaactgaaggaaacgtggccctcgttataaggtggcagggaacttggctagaacttggaaatcatctggtccagcccccttact

SEQ ID NO: 120722 - DNA, 1041 bp, Homo sapiens
acatccccactcacatgtctgaggaggctgagtttccagtgccagaaacgcccacggatttgtcatcttggagatagggacagagccctcgcattcatagccccccatcttgaagaagctgtgaagatgcgggggaattagaggctaaagcatcaaatccctgcaccaggtcaggtggggattttgcctggaaatagagaggaggtgctttaatgaaccggtcatgtcctgggtgagaatgagaggagaggtggctctgtcaggagaaacagggagctgccggcacagcacatgtgtgaagaggaatttccacactccctgacgacacctgttccgtcaaagcagcttataaagaaacaacggtaacactgtcaccctgtcacatcccacattcccaagaagggtgatcttgcaagccccggagggctggaagcaactgtgagctcctcctctccagtttgtttctggggagaatggaatgggttagggtaatcttctataagccagcagcttccgtaaggaattggtattgattcagggtagacagaacagcttcatttcttaagcattactccaaagtatttatgttcatcttagaaggttggatgtaaatcaagacttgagtgttcaaaacctcggttcttatctgcagtcaaagccagatgctggaagatagaaacgacagagttgactagcttttttccacctgctcaagacacaaaagtaattttctgaaggcaaaatacaactctatccctcagaagttgcgaggaaattcatgactctgagaaaaacagcaaagtaaaaggagactttcaggtttcagttgtctttgtgcttggaggtctcttcaaaacctatccagttactgtgctcagtctagggactccctcagccagggactccctctttccccacctctcagagaggacagaaaccacatgtccctctggtgtcttgcccaccatttcggacattctgaaaagctctctacatttcagggatatggagtctgtatgcaggtgtcaaaaacactcttga

SEQ ID NO: 120723 - DNA, 1051 bp, Homo sapiens
taagtgcactggggatcagcatcctcatttgtaaaattggggtaaaaaatgggccgggcgcggtggctcacacctgtaattccaggtgtgggaggccaaggcaggcagatcatgaggtcaggagttcgagaccagctcagccaacatgatgaaaccccatctctactaaaaatacaaaaattagttgggcgtggtgacgggagcctgtaatcccagctacttgggaggctgaggcaggagaatcacttgaacctgggaggcggaggttgcagtgagccaagatcatgccattgtactttagcctgggtgacaagagcaagactccatctaaaaaaaaaaaaaatcccactctacaactcagggttgctcccagggcagggtctgagaagagaagcaggaggtggaggggtagagcccttacctaaagaggcatcctctcgtgatacccccctttgcccccaggacttgctggcagccaggttctcctggcagaaagtggattcctggcccactgctgaggtctctgccttctctcagcagcagatcttcagactgtctggcaagggccagcctgagggcgatggtgagcattagatgaaataacacatatacagctcctaaaacagtgcctggctcaaggcaaatgctcggtaaatattggttcttattactggacccattttataccaaggtttagtgctattaaggatacagagtaagtgactgagatggatttgactgtcagactctaaaaatctgtgtttaggtatgtgtatgcatgtgtgtttatatcaggttgaaaaaaatgctggctctttccttatttcatcactcagaagatgaatgtggtcttgaactttgggaagtaaatgagtttcttagggacatggagcttggaaagaaacctgaactatgcgtgcaagagatacctgtcctggccgggctcagtgactcatgcctgtaatcccagtactttgggaggctgaggtgggtggatcacttgaggcgaggagtttgagatcagcctggccaacatggtgaaaccctgtct

SEQ ID NO: 120724 - DNA, 1122 bp, Homo sapiens
ggtgtctgctcagcctccttccctcccccactcaagcttgggttcatgacgctgcatgggacactggcgtcatcctggcaggcagcctctgggccatctcaactctactcagtgcagaaaatgttcttttaagggatggcatgcagccataccaggcgtcttgctgggcatagctggatggacgacaaaggaggagaggagggttgtttgcacaggggctggtggggagattggccccttatccacagccgctggcatctggctgtcttggtgacttggcctaaagggaagggcccagaccccagacactctggtgtgggaagggtggggacttcaaagaagctctggaaagcaaatgtatgggaacatcacccagaagagcagtccagaccccccaggactagcttggcaggttccagctaggcctctccagggaccagaatcactggccaccaccgggagccacagcattgccacaaaccctcaagggatgggggctccacagtgttacttggatttgtctctttctgccccaacaatctggcccccaagcatcagccctcctgagaggcttttcctgatggggaggccagagcccagcacaacagggatcctggctgactgagctcccctgggctgcacccccatggtcactgcagtgtctctctagatggcatcagttgagaagccctcactggctgccccttcctccctgctgtttcccgtctcagccacattccttccttccctccctcctcccctgtgaggtgctggggcctggagagaagccctcagggagtttagaagggtctgctgtagacaccaggaaggctgggggttgccgtcccccttctcaagcatccaagctgaaactggactgtgcgctgtaaagacagagtctctcttctctctcccatctcctgtctccctgtgtttcaccctccctctcattctcttccgttaaataatactgtgatggattgtaaaaggtacttagctgaatcacagagtttagagatggaaaagaccaattaggtcatcaagctgatctctctcctgaggagctgcagaaaataggagacaacaataaacaattttattgggatattaatttaggagccc

SEQ ID NO: 120725 - DNA, 1262 bp, Homo sapiens
aggcttcccaaaggcaccccttatttgctgtctcttcgtaagcgtgggcaccagtgggttgatgtgggaaacagtgctggtgcaagtgtttaagttttggataaactgaggattttgagaatcattattacattacatagcaacaaagaaacagattgatataatctgtgtgaaataaattgctgaggagagggattgtagggaagaagttgcttagttaggcacctgggaagctcaaatcatttagtttaaactgtaagtagagttgtcttcccaacgagaactggtgattcctgatttcagaaggctcatcagacccctacacccaagtcttttaacacggaggaagtttttccttcatgaatacatacaagataccgaactgaagaaatcttttctttgctccaacccccgctcccccggccccccgaagctattaatagtcattcaaatggcactgcactctttccaagctttcctaagctaaatatggctccaacaggtctgggaactattgaatgcaatgtactctgaaattccagcagctgtttacatgcctgatgcctaatgccatacgcctggaacttgctgagaactctcggctgcctctgtcctggggtactattgctgaccagcagggtgtaggcgctgcttttgtttgagctttgtagccacaaggtctgatgtctgttgtgaacagcagctgacttcagcactctggccagcttcctcaaacttgttagtggcttgcattttgtcaatttttctttgccatttcagtctttcaagcagctgaatcgcagaactgaaacaaaacacttatattgcaaagttccttccctttaaaatgagcttctggattgcagagatgattttttatggtcttagcgtgcctcatgctgtagaccacatcgttggagctctgggagagctctgagcagagaaagaccttggtgatcccccctggcccgatctataggattgaggaatgaggcttgtagaggtggcttgcccaaggtcacaacactagagggtggttgagctgggccaggacccagacaagcccttttctctcagtctagtgaggcctctgggaaggataggtgaaaactataaatagctgttcaagatactctgagtaaaagtcagtggtgttatctggaatttctactgaagaggaaatacagcagcaaaggtagactcatcagatggtgaaagtgtcatctcctttgtaatttatactggtgagaggaggggaagga

SEQ ID NO: 120726 - DNA, 1037 bp, Homo sapiens
cctggaaggaaggcaaagagttaaggaagaaagaggaagtggacggaattctaggcttgagatgaggactgagaatatctttgggtaataagaccagttaagctggagaagaagggtcatttatggaacaaaagattgtggatcgtgttgtcatggaatttcctagaccactgtgacccattagtggatggtgaaattaatatagaagatcttgttccctattaaaaatgtttttaaagtagaataggaaatacaagagaatgtctcagggagggtaagtgttgacttgtgaaactttgttgcatatatgtattctggattacagtctaaaatgtattccttattgtaggtcatgttcaaaagagttccgaaaacagtggactggacacagagctgtctaaatacctgtgtctgccattagcatctggcacaggggcctgtctactggcatttcaatctgttgaacaaattgagggtcttgggttccagcccaaggagtttggattttatcctgtagacagtgaaagtttttgaaggtttgtgaacaggagggtaataggtctttaagaaaattcatttagcagttgtacataggatggcttggggagggaagagataggaggcagggagtctagttaggagacattggctgggccttgggtgagtgacaatgacctgtgtaggttaatcacgggatgggaaggtaagggggcccagtaatggctgtaacagtggtttttgtttgtttttgagacagtgtcttggtctgttgcccaagctagagtgtggtggtgcaatctcagctcactgcagcctccgcctcccaggtttgagcgattctcatgccttggcctcctgagtagctgggattacagtcgtgtgccaccatgctggctaattttcgtatttttagtagagatgaggttccaccatgttggccaggctggtctcaaactcctgagctcaagtgatctgtctgcctcagcctcccaaagtgctgggattacaggtgtgcacctggctgattttttttttta

SEQ ID NO: 120727 - DNA, 1057 bp, Homo sapiens
ctagtagtcatcttgaatttcttcctttccctcactatcattcattcattcaacaaaaatcttgtcatgtgcccgctgtgttccagcttttgttctaaatcctgggagacagtgtaattaagacacacaagtcctactcttgtacaacttgcatttgagcttggggcagcagggaaaggaggacaataaacaaaaccagataaatgctatgaaagaaaaaagataaaaccagtagactgtgatagtgaattaggggtgaggggagcagagtactattttaaatcagctgagcagggagaactcactaaggaggagacatttaacaagaaggaaccaccctggcaaaaacggggactaagccaagggcacatacggtgacatttttgccgtttgtagtaggaggggtcaaccaagtgatatgaggggaagggagcattcctctcagagggaaccacaagtgcagaggccctaaggtaagaagcagcttgatatttgaggaatggcagtgccttccttgggccatgcctgtgtgtgatgtaacagtcacaaacacttcttcacccaggttttacagcagaagggaactggtactccgacaagttccaaatgaggcagaagaatgtccgtatctctcctcttgtttgttcccttcgtcagtttgtttacccccccacccccacacccatctacctctagctccctaacctttctcctgccaccccccataaaggcccctaattaaataaaatatattttggaggagaccatcctaggatccgagactgacctcatctctgcctatcactagttttatggctttagggaaattacttaacctctcagtgttttcttatcagtaagttgggaataataatgcctgcttcctggattaccagagttcatacattggaaggctctcagtaaatggtgacataggaacattcttctttttatactccctaaatgataaatttagtttattgtgaatctcagcatgtatattcagaatgtattttgtgtccatcagtccactatttccatctgactgctgtcacca

SEQ ID NO: 120728 - DNA, 1255 bp, Homo sapiens
acaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatg

SEQ ID NO: 120729 - DNA, 1640 bp, Homo sapiens
gcctcctgagtagctggcccgccaccatacctggctaatttttgtattgttagtggagctggggttttaccatgttggtcagactggtttcgaactcctgacctcaagtgatccacctgccttgacctcccaaagtgctgggattgcagacgtgagccaccatgcctggcctgtcttgacgtttctagttgaggaaaccgagactcagagacaggctggagactgggatggggtcatgaatgatggcaggcccaagcccttgaggaagatgggatagtccagggtctagaacaggcccctttctatcccactgcacccccgtcctgtgctctggcctgacccctgctcagatcacacagcattggccattgcacatttcccgggccctgctaactcttcctgacctctggactgcctgtccgctcaggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatca

SEQ ID NO: 120730 - DNA, 1072 bp, Homo sapiens
ctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctggtatgtcccctaccctgggtgttgggcagagatgggggaaccatgacaggtgaggggaggacaggaggcctctaggaattggaccaagggtgtaaggacagatggcaagaggatagtttcagagctccttgccctcccgggtcaggctgggtacccagctagcttctcctctagctgcctccctggccctctgggtgcctttgctgggtttccaagtctccactattctctgacttggcctcctgctccccatcagcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgagtccctgcctctgcctcccacctctttttctgcttctttggtttcagtgcaacagacctatgttgggggtgccctaggtagggttccatgttctgggcacttctcttacccagtgggattctcaacccactctgccatttgcaagaggaaactaagacccagagtaatgacaaaaaactcttttctctctggttccctttctcagacatggcctttttcctcctcctttcctctctgctcagtctctgatctcctctccctcagttctcccatgactcctgagcttggcttcatgggggacttgcaagtagggccttctgcctgcacggttggtacctgctacccagggagcccctgagcccaccagcacccactccacgccctcagcagcctttcatctttcacaagagtggagggaggtgtcctgaaggcatggctcagaggcctggggctttgttcctgctgtagcagcttaaagacaagggaggcct

SEQ ID NO: 120731 - DNA, 1015 bp, Homo sapiens
gggatgaccagaggtggtgctgcagcctcacctgtgatcagtgattcaattatcatttcaagatgttcttgtatgttcttatatactcttttcttgtaggccggtcccattcaagatcgatatctgaggtagcaaaggtagatgccaaaggagagctgggtggttccgctttctctgccatctgtttaacattaacgtggccctggtacttcctcattctcttgctccaaacagatttgatgttttcagaaacccattggatggtccttagtatttgttttagctctcctgttggcctgttagtatctaaatgtcctttagccatttcacattgaaatggtctggccagctagacagagagctctctgagggcaggggctgccttggccagagtttgatgcgatggtccccactttccactttgatgctgcacagccttcgtagcctcggagatgctgtgaaatgccggaggaggcagcgcagtgagctgtgtggtttgatggtctgacagacaagcgtgccatcatggaaaattctttgcagagtgtgcagatccatttacgcaggccggctgctgcttctgcaaattacactttccttcagaacaacccacccatgccctttttttcccaccaaacctcagtcatgctctgggtaggttagaaacaaggttttttttgtctccctctgtttccatccctcactcttctgtctcttctctctcagtccttgtcttggtttttataggcaatttggctgaatgcctagcttctggtctggatggcctacccatctgcaggcgctccttggggacaggacttgagccccagatttagagtcccttcttatgtgacttctggggtccaggccctgccagctgataaagccccacagataggttggagccagtggtgatagcagaattggggcctagtcagatggaaacaggtttgcagctgtcagtattgtaggagtagataagttccccacacctctgccccaccgctcctcgcac

SEQ ID NO: 120732 - DNA, 1007 bp, Homo sapiens
taacccatgaaccactgacaatccaggagtctagcagaggctggaatggaggaagactgttaaggctgtatcctgcagagcaagaaagagtcctgtgatcctaaagtgatggcggctgtggagctggaggcagggccgggagtagctctatgggtgccagatagctgtgatcccaacaggctaacatcttgactttggtttcccttaccccaccccgtaaaggggaagcccccaccttgccctgcctgcccatgtctgaaggtgggtggcatgtcccaaagccccaatctagatccctctctccaggaaggggatgccccaccactgccaagggaagcctcagatccttgggggatgaggggatgtctgggagtcaagattactcagtcagcacagtgagcacctgggaaggtggggttggggcagctggacatctgaagctctgggcaagggcacacatggctgtttcctcactggagcaacagcatgagagctggtcagagtggctggactggttttagggcactgttttttcagctggtgggaagtgggtgggagtatgcacaggcctctttcctgtggcctttatggggacaggagataggagaacagcaattaggacccagatgggcctgggttctagtcttggcttcactgtttttagcactttcttaacctctgtaagcctcaaatcctcagttgcaaaatggaaaaaaattatagtatcttcccagcaagaatctgtcctctctaaatgagctaaaggcacataaaatgctttacccaactcttggcacataggaagccctccgtaaatcacagctgctttatggtgacggtgatggagacagggaactctactccgttcccaaacaagagctgggcctgagctttgtgcaggctccccttttcccattactctccaggcttgtatggaaaatgaaaatattgtctcgtgtgaatttgggagccaagttaaagaatccagccagtgaacaggggccgcc

SEQ ID NO: 120733 - DNA, 1164 bp, Homo sapiens
ggtgactgatgagctaagtcctgaggatagaaatgcattttcttgaatgtgctatggagaggaggtaggggaggtatcacctgcccaggcagggggactccagtagtcatagtccaacctcctcattgtacagagaagcaggcaggcaaagcaatcaaagattcttcgaggatctcaagacagtactggcagagctgagctgagcctgggtttttaggccctgcgccgacgtcctagcacaccaaagcctccagccattgatttggcctgcctgccttcttctcaaatgtgatccatactccagatagatatcagagcaaatctgagaaaagagataagcaaccacaagttaacaaagtccgctttgcaacagcccagctctggtcttcgaggagacgggtgtggccctgctgcctttcgtccagtatctgctccttccctgggagagacaaagctcaggcgagctgggttggctgctggtgcaggtatcagggtggcaccactgggcccttgccaataccttgctcgtaaactacagctgccctccgagccacaccctggtcacctgacccggggggagaggcagtgaggaaaataccaagaattccttctctctgccctgcatactcctttttagacaggaagatggagaaggcctgagcctccctccccctgtcagcttccactagggcagcccctgcatattagaatcacttctggagctttttaaaagttgtgccaggtcaacagaatatctgcagttggggaccaggcatagcatttatttaacctccaaggggatctactgggcagcctgtaccgagagccactgcccattgtcttgcttcatgttcacgctgggtgggggctgggagggagttggactagagttcagagaagctgccatctaacacctcctggcctcagcctcacctggggaggtactggcggctgccaggggtgatgggggggaagtggtgaagacaggatgggaccagtggtggcatttctttccctcagcagccctgcccaacttgcttggttggacgagaaactggccagggtggctgtgagcctctgaggggcagaggccaggagagatggggcctctgagggatggggtgaggcatcttgggcttgcccgtttccctctgcccctgactc

SEQ ID NO: 120734 - DNA, 1033 bp, Homo sapiens
ggaaatgggcttggactgcagccggagggatttaggttagagtcagacaataaggaaggatttcgggacaggtggttggctctcaggaggatcctgcagggggctttgagaagaaagatgggggcaagatcatgctcagaggccgtgggtggatgagaaaaccagctccttgaatgagctccctgggggcccggtttgggtgggaaggggaatgttgtgtattaagcaggcagggagcttacttcataggggtagagaaacccagtggccccacccctggtacaggattaatcccatcctggttcctcataggcttttcttttttaattaatgaagaggtttacagtttaaccacttgataatcttaaacaaactgtaataaatgggtaggcttaataatctcttatcagaacctcagccctcaaggatggcagttacttattaccctaagctgccagccacaggcacagggggagagggaggagggaagagcaggtgaggaggcccctgggttggggaatttgctaggttgtcaggggcattctgagaggcaagaggtagggtagtgtcagccccaactgtgttcaaggatacaggtgtaacctagagagacaaatgtggcacaagggtcaggagccagcttcctcccagggaggtaggagtctggcggtattggcggtggtgagacttgtccttagagcccccggcaagggggcccagggcaggcagatgtgtccaggagaacaggactggcagccacaaggactaaagagcctcatggatcagagcatccttccttcccactgctggaagggcaggaaatcagcagcaatgcatggggagagctggggccatcaggccttcaaacaccctggtatccctcagctcctaccccccacccccgccacccacctgcctgcttcctctggaatcctgatggttccagagtccgcaggggaactgactcaccagggctagaacctctgggggctttgggcttgcaaacaggtagggtagggaggagaccccgggg

SEQ ID NO: 120735 - DNA, 1070 bp, Homo sapiens
agaaggggacggctaaaattttcagttttccaggtttttttagggcccatggtgggggtcccgggccaggaaaggtggagtaggggaaggggaggaggggcgggcactgtttttaggatgggtggaacacctgactgggaaattgctctggtccttgttcattcatgtcttttgagcctcagttccccatctgtgttttggcttcttgctctgcttcatgctccattgcttgggcttgaaggagcatggagtgagcccctgggactgtcctggcctcgctgttggtttgttggctgctttctctgccatcttctgctgtcatgtccctctttcccgactcctgcctgtctcttgttaaactatgagatcctcctgagcagggtctgtgtcttgcacttcctttattttgcccagtgcctgggcacatggttggtgttcagcaaacacttgatgaatcagtcgaccctggtttgagcttcattgagcaacagaagtttgtccatgactctggccccatcgttgttgggttaataggttgggtgggttgccctgtgcatgggtcggggagctggtgcctggctagatctggcatttatagcaggtgtgcccagctacatttttgtgcctccaaagaggggcatggcccaggggtccctagggggagtgaaggtgacgagaaccccctgttctaccaccttgccctcctgttcccctactcttcctgggaagtagccaggagcctaattttacacatggggagagggccaagggactgtgtcctggcagtccactgcttggtcagttgtttagctctcagcagcccgggatgaagggctctgcttcagcaggcttgaggggagacggacctccctgggcaagtctgacaagtggctgcccctgttaccactcactgaaaacagttcacagggggacaggatgcagctgtgtgaggcatagggcctgctcccctgcctgacttagaaacctggcacattactttcccttctttcattatatcctcccggccacatacaaagcactcttaccccacaaccctggacgtttgtaaa

SEQ ID NO: 120736 - DNA, 1066 bp, Homo sapiens
aagggagatagaattgcctcttagctgtgtttctgtctgacctgccagtcagctaaacccatgctgtgtcacatccactcatttggtttccctagggttaacctctagctggactgtggtctgcaccttgggagggtatcgctttagtcttgcccacatggcttggaacaggttattctgtagcatgccaaggacctcagggcggggccctttatggatgtttattttggcttgggtaccctttgtgtctaatgcaaggttcctgctcctctcatgcccccagtgcgggatggaggtaggcacctattcacagactctctggaggagaaagacgtccatcccctaccttccctatcactcctgttcaaataaaattctcacctcccgggcagtggaatgcatcctgacagtgttagctttggaagggtgcccttctcttctcagcatccctgcccccttcagagcagcgagtggaagggctgcctctcgccaaggggataagtgctgagtgggcgaagtggggtgagccgaggcagtagtgtcttgtcagcaccccccgggttagcaggaaaagggagggtgtcctgattaacagcttttcaacacctcacctcccccatcttccagactctagcctcagccctgcaatccacccaaatgcatggcccagagagttggactcacccacagttgggagactagaagacagctgagtcctgggccagctctgctgacttgctgtgtgtttaggccaggtcactgcacctctctgagctaagcacttgttcaataaggccaattaaacacttagtgcccgctgtatgcccagtgctggattaagggttgtgggaatgaagtactggacatcatttctgcctttggggttggtgggaaggtatcaccatgcaatgcatattatgaattgagtggggttggggcatattgtgagggcctgtgtgcttcaaggtagaaaagttcctgtaggcttgggctgtttaggtggctcccctgaccctggcctgggggttgcctcctttctagctgcattgctctctaggctcccctg

SEQ ID NO: 120737 - DNA, 1095 bp, Homo sapiens
ccagagctttttcattttgcaaaactgaaattatacccccttcaacaacaattcttctccctctctacccagcccctgggaaccaccattctcctttctgtttctgtgaacttaactactttagatgtctcctaagtggagtcatatagtatttcttttgctttgtacagtggtacaaccactgtgaaaaatagtatggagtttcctcaattaaaaatagaactactgagtgatgcagtgctcctacttctgggtgtgtatcaaccaaacttctaaagaactagaaaagggatggggatggtggctgtctcttgcccatagcccttggggaggtgttctgcaggatggacccaacaggctgtagccacaggccagggaggtgagagtcacatgactaagctcttctgggttgccaaggaatttgaactccatcaaatttttgcaattttcaagtaggggagggaacaacatttcagaaagtttcctccacagccatttacagcttaaaagaagtggaacattctactctaaaataacgacatttctgtgggctgatcccttcactctgtgggtgttctgataaggacaccccctccttcctttctcctgctgatgtgatgtagtgtgggttttcccagaaagctcatattgcctacagcccccagaaaaacccactgaccttcacactctagttcttttcctactacgagccccttaggtccaggtctgggtccctggcccagccaaagacattccgtctcccgtttggtgaccttcccagattgcatcttcgctatccctttatgtagaagtgggggtggtgtgctccagttgtagctctgttcagctgcctaaggcctctaggcttctggtgagcagttatcccaatctctgaacctcagagacctggatacagtggagttggaaacacagaacgggccctccctactggctatcctttctgtgcttgatgaaacctcagatattggagagtctttaaccctctggagatcagtgcagctgaggaaagataattgggccgcagtggtgaaatgagaggaaatacagtccaaagtgctcagtggtgggttgtag

SEQ ID NO: 120738 - DNA, 1545 bp, Homo sapiens
ataaatgaggaaaattaggggaaaagccagtgtaacttgtctgggatcacatagagcggagtcagttttcacatctaagtttcatgtttcaaagtacatggaaattagcaagcatttattaagtatccaccatgtgccagacactgggcaagactctcaggatacaaagaattaggctacactccgagctgctggagaaaaggatacataaacccactgggaacaagacagtgggtgtgggctacagaagaggttttcaggaggtcgcttaacgagggtctggtccagcctgaggggtcagggagggctctcaggagatgacctcaagccagagtggggtcttggattagaaagaacagctgggaacctgggaggtcaaagctgcagttagcctggattgcgccactgcactccagcctgggcaacagagcaagagcttgtctcaaaaaaagaaaaaaaagattaaagaaaaaaaaaaacctaactggtaaaggaagggagaagagactcctaacagaagatggagagtggccctttctcctagcctggggaaggcagactgcaggtttcttgctgtggctctagagagtcccttgtctcctgagggtggagcagggttgccctaggtcctgccctctgtctagcatcccagaccaaagtccaggttttgcttgactgctcatatagctgacctgttcccggaagcctcttggatcccactggcctccttccttcctaagctccaaagtgctttcttgtgttctaaggttttccatatgtacctcctttcattttctggaccctttggactggtctatacacactccagtccaaagtagtaaggctagttccaattttgaggttctggcactcttttaacaccaatcctgctccccagatttgaaaaataaaaccatgaaatatatgacaaaattacatgtggccaaaatgcttagaatggggtacattgaattttttggaaagttgagggttaatataaacaccctctttgtctcaggccttgttggaaattgtgaaatgcactggtccacttaaccgcctttgtaagtaaaaggaacacaatagctcttttggttatggaggatcttggaggcctccacagccttgggtccgagcttgagttcttactggctaggactgcagaagtggaaagtggataagctggttttttgagaggaaattgaagaggtcccttcctaatggcttgtttcttatttatgttccactcaaaagttgagggtagccaaaaaaaaaaaaaagccttagtctgccttagttaactgctctggttagagttttttaacagtgaaagtaaatgtttattacattgctttgagcgtttgactagaacccttaggatgattacagatggcacagtaatagagaattattgagggtagaaattagcaagtgttgaaagtttccagtgggggtgggggatgcaaaggaggtgatgattgttgcttttaaatattttcctggggttttgccctatttatagtctggcgtttagaagaaacaaaa

SEQ ID NO: 120739 - DNA, 4296 bp, Homo sapiens
ttagacttttttggaagaaacatcagtaaatgaaaatggaattacaataaaaataacaaaagcaataaactcctgacctcagtcacaatcattttagttaacacgccagtcctaataacaaacacgagtccctgagaccgcaacccctcgggcaccgcagggcgtgcaggtctgggcgggcggcgcagcctcccctggcggctgaccctgggagcgcggggagcgccaagcctcttctagcgctcacctcgcgctcactcctgcgctcgccgggctgcttgtgcggggaaggggcggggcccgcctgggctcctccccggtcggagcccggagcaagggggcagagcgcgccgggcgctggttaaagaggcgtgcggaggcgggcgcggcgcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtcagtcgccgcctgtacccccatatacatctgaagctggcttgagctttagggggcgctgaaaggaagaccccttcacagctttgggtgaccctcagtccctgtggaaggtccagggggtgatgagagagcgtgtctcatcatgggtcaggcttcgaggatctgtcgctcacccgagggacacaggggtcccccaggcgcggagactctttggaacttagtttggccggagacaaattggagttgattcccgggtgaactaggctccacggtgtttcagtgtgggtgtgacggtacctccctccttgggaagaggctgtgggacggataaaggcgtttatctttccctggagacgctcccggagtctgggagccaagcctggtgccatcccctcgtgtctccacctccccgctccagggccagtgccacgcctgccaggcttttcttaaggaacgtgaacccggcagagtggcgggagggtccctcagcccgagcctgggcaaaatcttccgcccccagcagagttccggagaggagctggaggctctgtggggcccgaacccacgggatgagggctggtgcctggaatgctggggacgcgctcaggcttccgggaaggcttatctcgcggagacatccttcaagggcttggagtaaaactttgtgaaagtagcaggttgcacaaacgaataatacccgcgtagtccctttatgatgggggaggagagtgtgtgcggaattggggtgggtgggggacttccctccgtgctgacattgggaaccgcttattttctggtgcacagcccgatgggtggcattgacctcactttggataaacgggctgcctatcctggctgagaccttggggcccatttggggaccgaggccctctaccccagtttctcgagggctcagcttcaaccatcaactcttcttggcctgctcccccagtggaatgaccaggacctgggtgaaagttctagattgcagcaggtagggagtaggggtagattgtccagggtgttaccttgctctcagggtgaaagatgccagaaaggaggtctgatgagaagcaacgtttagtctacagcagcacctcaatactttatgcctatctagtcgtcgctcattttccagcctccgtttccccatgtgagaaacgggaatgagcccatcctcattccttatttctgccacggactgttaggttggaagcatttggaaaacatcaaaatcttgtccccagattgatggacatcacacagataagcatatacgtatttgctggcagccgtgtgtggggagacttgtcctccaaggggtcctgtagaaggggaggtttagtctagcaggcttagtgttggattttagtggagagtctcttgccctgtagcagtttcccgggtagaggcagatgggaggtgatggtggggaggataagcttcagtagatggttggttggtttacctcctaacagcaagagtcctggcatgaagagtctacatggcttccttctgatgggcgtctaccctggggggtgtgttgtggggagggggttgctttatgatttcccttgaggaaacaattcctctagagaacaagtttttgtttagtttgttccagggctttgtttagagggggaagagggcaggcaaggatgataaagccttgagctgccctcgaagtgtttccctctaagctgttgctccaacactgcaggggaaggaaggaaagaattcaaggctaaatgtgggaaaataaacttcaaaacacaaggcaaagggaaaggctggcggggcatacggcggggggggcggggtccaggggttaggcagccgggtgcagctggtggtcatagctttggaggctagacggcttcttaaggtatttgaacaaacaaaatgcctcttatttagcagtcctgttaaatctgtcaacatttacccccctaccaaaaaaaagtaatgggcaggtaatttttagaaaaaggacttgggcatcaagccagtctgctttggaggctattatagataagttcttgaacaaggacagccctgtcctcatccccggccaaagaaactcccaaaccaaccccaactgggcgagtcccttcccgtcataggaaaaaccccaagaaatgaaaatggacaagtagaagcatttgctgacatcagttttaatctgcagaaatctgccttgctctgctttcttgtgacttggggtactgcctcaggcctcaggatattggtttaaggaaaaatgaaaactcaaaaatcttctttcccatctggctgcttgggcattttccacctgacgctctgtgttttagctggttctgaatcaccttggaatcatgaaggagcccctagctaggaattcctggggtacaaccaggggtgggacaaagattgttggaagagatggggtgcagtctgagttggggtttctcttaccctgaaagttgtgtgtgctctttcaaatgtgtgagaaagggagttaagtcaactttctttagaaataccccccgaattgtcagatacttccttccctccgctgtggttgaagtgaggtgcaggctgactttcaagtgctcagtgacccgccagcctgggaccacgtgatcgtcctctttcctgtcttcagaaccatcttgaacccttgctctcaagcaagatctttggtgactcattctcccaacctcttcctaaattgcagactcacacaagggaagttaacatttacagcacacctactctgtgttgggcattgtgggtgctattatcctcattttatgagagagggcacaggctggttttgccatctggctcggccatttacccatcaagccatgtaacttaactttgccttcctttcctcatctgcaaaatgagtgtttggtgaggctccaatagagtagaaacattaggcaagatgtctataaaaagtgaacaggtctcctgaccttagcatttattgaggaaggcagctttacctacctgccttatttcaggtactctttacagtatgtattcaagtaagcaagctgaagcccagagaagatagaatggccacagggacaccacaggaggcacagcctatggggcgggacggggaggggcaatgaccaggcagtctgccccaggagcttgcacctccctcttgggcctgtgaagattgttgctctgtaactgagcttaggaaattggttcagctggaccctgatctgctggaaaattctattttctatttcccctagcacaggtaatggcatacaggcgtctcctgtgttgttgcctggctgacccagcacctctgttactgaagtaatacatcagtccacccctctgcgcttctc

SEQ ID NO: 120740 - DNA, 1065 bp, Homo sapiens
ctggcacgtttctgattgtaataaagtacagccatttatcttctcacagagtgccctgctcttcctgaggggaaggcagtggcagtgagcgcagggtctgtggcagtgggggtgagtgtgcccaagaaattatcaggtacagccatgtgtccgcagggtcattcagcacacccttaaatctgggcatgcttgggtccgctaaggtgttacaaaatcagcaccaggatggatggcagcactgagcacccgtcggcatgtgacggctccagctgacagtaaatttgagccattaaacaggaaatggtctgattgggaagccagaatctttgcctctgagctgctgaccattgtggtaattgagctatgaacaccatcaatctccgtaagaatagacactttgtcttctcaaacaaggtgaggctgaagtgatctatggttgtgtgagacagctgagccccaaggaggcccagagtgggtattcagcaaatgaatcattagttgggtagttggatggccaagacgaccacctggaatgcctcctggctctgatgtcttgtctgccatggtagagccacataactcacttccccttcccacgcagggcactggttaggtgacagccatgtgggccccacagcctttgctctacagaggcccagagggccccttttggctttggtgaatgcttggaaatttcaacatcatcttctttaggattcctagtccagccaagggcatggaacaggctggctgtgggcattctgtgggctgaccctggagagtgggtatatagctcctcacacctagcaggcaagctgcaaatgccatatgggattggggcacaggtcatggatttcggttattaaagggcagacttcacaggccagcaccaggggaagacactaagactgtctctcagccccagccccagatctgaaaggcattcatggaaaagagcaacaccttcaaataccaacgacgagtcaatacagacttcaataatctgccctgtggcttccttcattattggaatcacttacagaggaaagagcaccagctttgaaa

SEQ ID NO: 120741 - DNA, 1186 bp, Homo sapiens
atcagattaatttctttcttgttccaaaaaatgtaaaacacaaaaaagtacagagaataatgtaaccaacatccatgttttccaatccaggatttgcttctaataatttttaactaaatgaaatagaatattgcagataaagctgaagtccctttcttggcctttcatttccatccctcacaaacacaactgctatcattaatttgccgtatgcttctggtccatgtttttatacttaatgacctaagttatagcttcatgaacaatagataatattgcttttttaattatgtaaattctatcataatgttcatatcattatttaacttgctattttttcccagcattctattttagaaatccatttatgtcaatctatcccaagttgctttattttaacatctctgtaatttgaattatctcagtttactaatcttttctgccacagatgtctacttaggttgtgcgtcttgcaccaatttcttgctaaccctaataatgttgcagtgaatgtccacatatatatgtccttatcgcatattgcgcatatatagatatatagatatatagatacacacacacacacacacacacacacacatatatatgtatacctgcccaagatttctctctaggaaatatatctagtagtttattgatggctgtgtgttatatgtatttggaacttcgccacatattatcagattgctctcaaaatttattcttaatttatatttccacaagcagtacacaaaatttcccatttccttatatctccaacaacacttattttgttagactttattttttaaaccttatggttctaagttatgtggttctgattatgtataaatttgagcattttatcaaatattcattaaccatttccagatttcttccttatgagttacctagtcatattctttgcttactttttctcactgatttgcaagagttctttattttatttatgtatttatttatttatttttgagatggagtctcactctgccacccacgctggaatgcagtggcattatcttggctcactgcaacctctgcctccggggttcaaggtattctcctgcctcagcctcccaagtagctgggattacaggcatgccccaccaatcctggtttgttttttgttttgttttgttttgttttgtatttttagtacacacgg

SEQ ID NO: 120742 - DNA, 1028 bp, Homo sapiens
catacaatgattctgtttttcactttcagtacagtcttcaataaattatatgagatattcaacacttcattataaaataaggtttgtgcaagatgattttgcccaactgtaggctaatataagtgttctgcgcacgttgaaggtaggctaggctaaggtatgatgttcagtaggttaggtgtattaaatgcattttcaacttatggtattttccatttatgatgggtttgtgggaacataaccccatgtcataaaccgtggagcatgtgtactagatttatctgagttatgctgatgtgctttgtaagctctcaggctttgcacattagcaaacttttggagtaagttgtatgaccttgtggaagtgcaaataattgggagacagggtgtgagttggggttaataggtttatgtgagttataggaacagctgttcttggacgtgttgtctaataacataaggatagggcaggaaggaaggagtagctttattgtgtgattgtgtttgttaacacaactttaagccccaatctccttgtgggatgtgtgtggaaaacaagaggattttggtttcaattagttccaaaatcattaaagggatactgactaacacatcctcacaaatttttgtttgaaagatatgttagttatatataattagcaagtttgttataaaatttgtgaacctggttagagcaaaatatacaacaggcaaactatattttggccttgatcttattacagtaagaatagcatgtttagcagggcgcagtggctctcacctttaatcctagctgctcagaaggctgaggcaggaggattgcttgagcccaggagtttgaggccagcctgggtaacatagtgcgactccacctcaaataaataaataaataaataaataagaatagcattttcttcttattaggccctgataagtagctagaagccttagtaaaagatatattgacaattctaacctcttttcttatctattatacatacctactaggtatagaagaaaagaaactt

SEQ ID NO: 120743 - DNA, 1085 bp, Homo sapiens
ttctgtgattgagatttgcatgacatttgggtagtacaaatttacacctcaattatgtacatggatagagtcaatgtttacaaatactgaaggaagacttttcccacccatagttcaggtagaaaggcaagtttctttgacattcctattagtgatagcttcaggtttataaagccatcttcaattcaaattacccactccctattggcctaagaccctggtttctgatgtcagccttctttctccatcccacactcctatgtgtgccccaggattagctcataagcttttatttcgattttcatttacttctttgttttgggtccttagatattttccttacatttttgcaaatttatgcattaaaaggagtatgtattatattttatccagaatctctaagtagattttagaaggagagattttaggctttctggacagctatagtgggagaattgaaagtctgagtcattttacatttccctctcctgtactaatgcaattaatttgtttgttattattgtgctgcaagactttttattgatccctgttactttttaaaattgttattgttaggtttggttctctcattctagcttttttgtctttaatcctgactcagttatctagtatgttagttttacctcccagccctgagtcatttgtaaatttgatgtgcatattatctgggtattccataattgtttggtaaaaatattaaacaggagccattcatgtacatagcccaggaataggccactaaagattttcctgtcagtgggtattgatcagaactctttgaaactgttgcagatgtctccaactctgtttgtatatttcagttcacatttccacattttacccacaaggcttgttcttagtcaacttgctcagctcagttcaatttggttcagcccatatttcttaagtgcgcactctgggcctttgtgtatacggtatgcatctgagatataaagaagaaaaagccacagctccttccttcgtgatgctcatagtctggtagaggaagaattcaggtaagcaaaaaagccagtcatatgatcatctctttctgcattttgctc

SEQ ID NO: 120744 - DNA, 1075 bp, Homo sapiens
tagaggttaggcagggccagtctcaaagaagatgaaaggccaactcggaacgtggtattgaataagagccttgatggagttttagaaaaattttgtctagatacagccatcccatccaccaaggccagcatgagatggacaaaatggaaggtggcagtggatgggaggaccagaaggaaccccttgcaagttgggctgaagaaccaaattgggtaccagaaatggggtggcccccctctcagccttcctccttggcaccttcaggtgatgtgctccccagaggatatcagccttcctcctccatccccatctccccagtttcccttgcctgctctgctgttcgcaccatctgaacgcctgagaggaggggccacccttagagacagcatgttaatgtagagggcagctctggccctcagacctctcaggaaccaactccccaacgccagtggacacatggttccaagtggccacctgcaggctggacagaggctgctgtggcttctgccttgaagctagtgttagagaaggggtgggagggcctgagcaatttatatgaagtagagaactatgggatggagctaagcattcaagtgctgccctctgctgaggggctgtaggggactccaaggcaacatttgaggtcactgtctggcttcacaacaatggccaggtgtccaggagatggggacatgggagatgcccaaaaggcatgaggtgtggtgatgcatgaggtctgtcttgagcccctcgccagattcatcaagcacctggtagtgagccatagctgtggaaacccaaggtgagtcttctaggactgtggattagtagacaggatggaggtgagggtagagaaggaagggaaagatacttaagacatgcagggagaggccagaggacttgtgacatgggaaacagacactgctactctgtcctgatggctttggtccctgcatcatccttccaacattgactgttctctggaacctaccagagctgatctaactagaatatataatgcctcctctgttcccattcaagaggaaagtttgcccccaggtcaatgttctgttga

SEQ ID NO: 120745 - DNA, 1020 bp, Homo sapiens
tcagtgaccagggatgggttgagggagggaagaaggggttgggcctgcaggtcgcatagtgtggctcacccactgggtatggctgacctcaggggcagtgagtctaggattatgatgggctgttggtggcttctcggagcccgctgtggatgtgattcaatccaccagttttaggcagagcccccgtccctcccttccaagaggctggagaactgattgctatgctgtggcaggggatggactcaaagaccccggggccccttcaactgtgattcagaagctccccttgccttcccccatcccgaatacaggcaacaagtggaacttcaagaagatggtcagctataaggagatgctagacactgtccggcagcagtggccagagctggagaaggtgccagaggaggaatccagcacagccaaggttagggagcaggagggtgtggggcaggcctggaggaaggtcgtacctccaccctaggatggagagctagcagggagctgcactgtggtggggatgctgtgatgtgggatggtaccatttaagcaggaagcatcagtgctatcacaaccacctccctgtttcatggatgaagatgtgggctcggctagggtggggggctcagtaacatgtcagaggacacactccaggaagtggcagagaggggtgctcatcccgcttccacgcagacttttctaaacatgctgcccacaggtccctgccttagcagcttttatctagggcaagccaggcataggtcaacccatgggtcatccatcctaccagagtcttctatcacctgagggccttgggtggagcttcacgtggggtcctctgggagagggttgaggagtggaggttctgatgtcatggagtgagaaactgggctcagtagcccatcccctccactgcccttttgctcccactctcccctgcccaggcctttaaaatccctggcttccaaggccagatcagcttcatcacatccatgtctgagcatttctgtgggacctgcaacc

SEQ ID NO: 120746 - DNA, 1108 bp, Homo sapiens
acagaggacggcagcttttgccaggccagagagtacctctctctcaccccatgacacacagagagaaagctacctgtttgccatagccagtgaaatgcaggaggatgggtgacaatgccaggaggaacgcccctgcccaggtgccctcagcccaggaagtcaggccaggctctgccctcagcctacttcatctctaacccatgcccttggcctcccactgagggatgttatggccagattgtgtgtgttgggcatagggaaaggtgttaacgtttcagaaatgagaaaggtgaggcctggggagatgctggcctggggtttttccacctcaggtttagtgaggtctccgctcacatccagatgggtttgagaagcctttggcctgatggagagttggggagtggaggcatcacggggctgtggccgtgcctctttcctccctccacattcccattcatccttccctcaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtgggtgagttggacgaaagtcatcgccacttctcccagcgctgcctcatccggctggacactgatgccgatgttaacagtggcagctgacattcatttagcacatgacactctcttggtcctacaacacctgctgagacaggtgctattattatttccatttttgatgagaaaatgaggcttaggttggataacttgcccaaggtcaggaagctcgcaaatgccagacctcagtagcttgctgtcacattgagaccaaggtcctccaggaggcccacgtgacctggctcttgctgacctccaaaacccttgcaggcttctccacctttcccctccttcccattcacatgaccgggccttgacatgtgctgttccctttgctaggagctcagggcactctcctcgacctcattcaggtctctgttcacatgtcatcttctcagcaaggccttcctcaaccatcctgtctaaagtg

SEQ ID NO: 120747 - DNA, 1034 bp, Homo sapiens
tatttagaatgttgatatttcacggacttctgaaaatttattacgattttttgaaatattacattaaaaaattacttactttgataaccgcagtttacctggcaccctcttaaattttgcatccaaggcagtgcctcattcgtttggcccttgtcctgtcctgcctactgtcacaccacgacctaaatctgagactagagcagccagaaaaactggaaggaaaagaaccccgttccttacctgagtttacccttctgccctagagcgctaccccggcccaggaaagtgggcacagggagcgtactacagctcccacaaggccacgcgggactgcgtcctcgcctattggctgcgcgggtcccgccctccccctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtgagcccaccccgcctgcgtccacagcttcccggggcaggagtggccccggcacactgcccttttcccccagtagctcccggcctatctgcttgaccgcttctgggagggacccgttggcactcctcagtggagcgatgttctccagatggaccgcccggtctcacccgctagcccagcgggagaggttcctgggagtcccgcttcagaacctccctgccccccagccacgccaccccttctagccctgagcttggccagaaattcgggtaagcagaggactgggactttgggtccagtgaggtgtcttagtacctttcagccttgccttgcacccaccctctttcttaaacattttccctccctatcccaagagctgagagatcaggtgtccctgtgacacctgcttcatagtgcgactgactaaacatgtcacctcggtgtc

SEQ ID NO: 120748 - DNA, 1094 bp, Homo sapiens
gaccctgatgacaccaggcacaggtcagttgagccagacccttttagggtttcctgaaagctctgcccaccattttttactcatggttagaagttagtcagatggccatcctgaataagagaggtggggataggtaggtggtatattattgttgttggctttttgggggactgggaattgtagttatgaaggaatattggatactggataggcagttagatgtctgtgtcacagaggtaaagataaagagagcctacaagggaagaaacaatattaatgtgtagttaagtagactgaggagaaagggaatatacatcaataatcattgaactctcagcaacacagtcacattttaaaggtcactggcaaatccataggcccctgcctttgaagtgccccaccttaagactttttaatgggcttaaagtttttttttttttattttttacaaatatactggagaatcatgcaatgctgccagcactggacgcaatccagggccacaagtctgcacactcctttgctactggtcctgtaatggcagaacctttcatctcgcctttattgttcactgtgacccctgcattatcttcaaaataaagaaacacgccatcttttctgcggtatgactttcgttgtcgaataaccactgctggatgtaccttttttctgagctctggtttgcctttcttgactgtggccatcaccgtgtcacccacaccagcagtgggaagtctgttcagccatcccttgatcccctttcacggagatgacatacaggtttttggctcctgtgttgtcagcacaactgatcacactcctaccagaagacccaaggaaatctggaatttcacaccagaggacccaccacgtcctcgcttcaacatcttgaaagccggaaagaagaaaaaagcacttaaggcctttttaagtgtgtttttccctcttgtacaggcccatgaatccaattaatttataactttcaccctggaagaatacaaacaatatgcacaattgtttaacttaatattctttctgtacaaagaatgtgaattttcaatgcaataaaatcttatttaacaacaaaaaagcat

SEQ ID NO: 120749 - DNA, 1392 bp, Homo sapiens
aatagatgtaccttagtacccctgccattttcagtcattagtggggagcagcccggaagagatgtgaccctggcacacatgctatgatggattccaaactgtagcaactgggacccttggctagttatgtgctctgcactagaaggtctgccaggtgcattttcatgccaccacacccactctgtgcatgagtaaacaaacacaaagaggttgaccagcatgctcaagaacacacagctggcacgtagtggaaacaggattccaacttgggtactttgactctgggacacaacttcttaacaactatgtcatgcttttttgttgttaaataagattttattgcattgaaaattcacattctttgtacagaaagaatattaagttaaacaattgtgcatattgtttgtattcttccagggtgaaagttataaattaattggattcatgggcctgtacaagagggaaaaacacacttaaaaaggccttaagtgcttttttcttctttccggctttcaagatgttgaagcgaggacgtggtgggtcctctggtgtgaaattccagatttccttgggtcttctggtaggagtgtgatcagttgtgctgacaacacaggagccaaaaacctgtatgtcatctccgtgaaaggggatcaagggatggctgaacagacttcccactgctggtgtgggtgacacggtgatggccacagtcaagaaaggcaaaccagagctcagaaaaaaggtacatccagcagtggttattcgacaacgaaagtcataccgcagaaaagatggcgtgtttctttattttgaagataatgcaggggtcacagtgaacaataaaggcgagatgaaaggttctgccattacaggaccagtagcaaaggagtgtgcagacttgtggccctggattgcgtccagtgctggcagcattgcatgattctccagtatatttgtaaaaaataaaaaaaaaaaaactttaagcccattaaaaagtcttaaggtggggcacttcaaaggcaggggcctatggatttgccagtgacctttaaaatgtgactgtgttgctgagagttcaatgattattgatgtatattccctttctcctcagtctacttaactacacattaatattgtttcttcccttgtaggctctctttatctttacctctgtgacacagacatctaactgcctatccagtatccaatattccttcataactacaattcccagtcccccaaaaagccaacaacaataatataccacctacctatccccacctctcttattcaggatggccatctgactaacttctaaccatgagtaaaaaatggtgggcagagctttcaggaaaccctaaaagggtctggctcaactgacctgtgcctggt

SEQ ID NO: 120750 - DNA, 1079 bp, Homo sapiens
tgttgaaattcgaaaagacctcaggaacacttttttgttaagggatataattgtcagccaggctaggcaacagtcactgtctcaggattcccccttcccaaatgcaaagtaacttttctttaaaagtctgtgagtattgatttttcataagtacagcctgagtacttctgtatcttctgttctcagtgtgcctgcagtgaaggtctcagggcttcagcaagctgggtggggctttctctgttcttacaaccagtgggatttctgcaaactgctgccagaaaaatagacacacttattcaaaagaagagactattggcaggcagcactcaaaacctgcatacaccgttttaaagatcccacctagattatcaaacctagcctttccatgtgatgcagttggcagcaagaagaatttgttgtgacaaggaggcttctcacaggtaaatacctgaggtttctacctttgcataatagaatcaggcccatccaggttactgccccaatatctaaaaggaaccctgtcactttcacagtttaaaaatatctatttgtgctttcagcccttaaaccaaaggttgtagcttccatcatctcaattaaggttctgtacctcacagtcagtcaatgtttacaaggctcgtggtttcccttccctgaagcttctatcagagagaaattggcatgttttccccagaccaaagagagaagctagcttttacctctaaggctatcctgtgacccctatcatagctatttaggaacttctgacaggttcagtgatctttctccatgttctcattttgtataatgtgtgacatctttcttttgctcacctattctgaggaagtaggcccagattacaggctcttccctggttattttcctattattgttgggataattgatcttctggtccctttagccatcagctgaatatgctcctggagccagaattctcctccactatctcatgccggagtctgtctgggattggagcaaggaagatctcatggtctagtcctttccaagatgtcaacagtcacatgctcggtttcctactgatgagagaatggagctgg

SEQ ID NO: 120751 - DNA, 1107 bp, Homo sapiens
ggagaccagtgaggaagccactgctgcccagggctgctgattgaagctgggatgtctgtgtatctcggtgctctgcagatgttttccaaatcactgtgaaagtctctgccatgctcctgtttcactgcagcacctcccgcccacccatcagcctgcttcctgagttcatccctcctcctcctgcccagcattgcttaggctgcatccttaatgaccccctgctgccaccgccacctctccgggccaggtttcctaattggaaaactcacagcctgcatcccatggaaaggcaattcacccaggggcccagaaagctcatcgcagggtgtgtgaggcttcccctggcactctccttgcttctcatgtcagagttgatgccagtacacctggagcaagcatccagccaaaagcagcagttcacttggaaatggagtatgtgtgtatttgcgtgtgtctgcgtgagttagaaccaccaggtctctgtccacatgactgcaagtgtgtgtgtggcagagtctctccaggtggctgggaggacagagacacatactgagctggtggtgtggacctgcatgtggcactgccacgtgtgcctctgggtgcctgcctgacactctgcatgctgctgctatggtgtctgatggatgcaggcgtttgcataacataatgagaatctctttatggcccagaaaccaactgttgggcatgtgtctatggggagggggtgctggaagactagggggctgtggctgccctggcagaggcccacgtttcaggagagtcatgtatccctgcatcttctgcaagtgagaacattcccacgggcggcagctgtgacctgttacctacacctgtggtcggcatgtctgggagcgtgccaatgatctgtatcccctgggctctgctccacaccccaagccttctctctgtcatcttcattctctgggtgggcagaggaggctcctggggtttccactgatgccatcagcaccctgatgtctgcctttatggtttgcctctacccccgccccgtcctggatcttgtgaatacccacccaggccctatcacctcttagggacacctgggaattacggtgaacaaagccc

SEQ ID NO: 120752 - DNA, 1743 bp, Homo sapiens
atttttctttcctttcttgcttgaaaaaattcattataaaaccaattatcattaaaagatttttagaaaaggaaaggaagaaaaacactcatactctaattaccctaccccagcaactatttttttcatatttgcatattcctgccaatctttgtccataagcatcctttaaaaaaatcagttcccatcatgtactatggaattttcttgactagaataattctgtgttggagtgttcttatcctattctcatttatcttaatcagtaaaaatcccatacctaatcatttcattaatatactcagctattcaacaagttagtaagagctacactttctgaaatttgcactagctgatgctttcctggttctccgagcaggtgtgtgcccctcagctctgtctctttctccaacagtcatgcatctcccttcttgttcgctccgctctgcctgccaggtggaggagggcatgttgcttttctcagccacttctagtttctaattaacccacatccctgggagaaagaagcctctaggtggcttagcctgcctttaccacctgactctttaaggaaacttggctatggtaaatatcagccaatgcagatcgacttattaaacaaagcaataatgagttcaacacaatcaattttttaaatagtcaacaaaacctacccagcagaggaaaaacaaatataactggcgtgtaagggcttaaagccacaagggaaactgagtcacgtcaaaggaaagctggatactctctaagtgaaggaagcatttcacacattggacatcttggggagctgagcaaacaccaagttcaggtgacaagtgaaggatggcacttctggacactccatttgtaaataggggaggtctttccccactgtgttctggtggggaaggtctaggagggcaaggccattctgcatcatgttctgagatcagagccagcacatagcaaatgctcagggaattgaataaataagtaacaaatgaaattggtcaatagggaaccacagttcttaatgaattcgcctcagatttaattacattataaagatgaaatacacttatccattatctccgtaagtagtcttacaggtggataatataggctttatttgaactccataggtgggaaaactgaggtgatgccttacttataggaagctggtggcagaggcaggctgaggttccagccttgtgcttctcacctctggggtcttctctgcagatcacactttggataactgatgtccttccagccatgaatactgttactcaaggacccagagaggccgctgtctctcctgtggtttcaggtgcctctctctctcatgggaccttcaaggatttcagagaaggaatcactgtcaacccccttcttcccccacccatctacctacgaccctccattgccaccacctgggaaccagggcttctttgctgagacaagctcctgcccttactcctgtccccccgaagtgggagaggaatgttccatgagatatactaaagcacaaggaaggtgctggtcaagaacaggctacctggaagtcaggatggatgtcaaatggacccagggtttcatttatgagaccacctcagttttggaggcctttatatagtggactaacctcatgccctccttaggggcttctctcgttgggcctcctaaacggctgtctccctgccttggttccactcaggagagagctagaatgcaagatggatggag

SEQ ID NO: 120753 - DNA, 1052 bp, Homo sapiens
ccaggtctctctctctctctctctctctctctctctttgtttctctctctcttacctacatagacacacacacacacacacacacacacacacacacacgcacacactcctactgatgctcttggccaccttctggatggctgatttcttgaactcctgttcccctgtctgagtgaccccaagtttgacccactcacagaattcctgaggccatggccaccaatgctttcatctaccaagacacaaatccagctcaaggcatcctttgattttgtctaatccacatcacttcagacagtgagctccttaagaattagagacataataataaccaggatcataatcaacactcgaggccagatgcctcctcgggtctccctttccccaagtctggctcccccatccccatctgtgtgccttacagcctctctgccacaatgcaaagacttcgttttgtgcaggcctctaagcctttgggatggggcagctggaagctcactgtagagacagtgcctcctcactcacccgaggcgaggtctccatgagtccagcacatggcccaccttttgcggattccaaggaagcagaagatacaaaccagcctggccccaaggcaccgacatctgaccagcagaaatgatgtcctctctcagagataaagcataaaggtcagaaaaatattactagtcaaggaaacagagctatgggggttcagagatggggcaaccatggtggtaatggtggcggggtcaaggctaccactgctggcctttatcctagagagtcacaggaagataagacctacaggcacagtggtcaggggtctgaggattgaatgttccattgggtttgggtcagggagactctgtggaggccctggggtcagagacaggccttgaccctgaaggccagtaggatacctacaaataaagatgagagtggggtgtgcccagggagagaaactatagctgcagagataccacagccaggacccaaaccattgcatccaaaagctcagagatggtcctacacaaatgattaagtgtgcagat

SEQ ID NO: 120754 - DNA, 1034 bp, Homo sapiens
gatgatattggggggaggatggatggccgctgggtgggggtgagagaggctactctgtgtcaagtgcagagagggagacagtgggcctgatggggaggggtcagcctataaatgctcctcctgggaagagcccggcagtgagccttcctgatgacgctgtaaatcagggcccctaagtaaagccattaccacactgagatactcagtctattgccggatgccactgtttgagacattactttgaatttagtttatgactcctgctgctataaattctgcctagagtggatctaaggaggtggatgggtcacccccacaccctgggaatccccagttcagctggggtggtcccaggcctgagtgtggagaggctaagctggccaggagagtctatgggagcctggcctggggcccactatgggggtaggggcagcggagggagggaagagggaccgagggggctacctggcccttctagctaataccttgctaatatcaggccttttgacactgagaaattgtccagcctctgagactggctaggaccagagtccctaaaggggctaggacaggatgtaattcaagcctgccccttccctgggcatgtcctaccctagctgcctactccacccctgcccaagcaccctcccaaaactgaagggcatttcatccgccccctctgactccccatcctggacgggctccccagtcttattcacaaatcttcatttctccttctctgccgttcttccaagtcccactcatgtgggagcagctggtaaatagggctggcctctctccctcttccgttcccaggcacagtcctgacttggccctccccatgccaaggcgagttctaaccatctgcccacacctgcctcacccccaggcctccagctcctggaaactgcatctccttcctctctgcattgtctcggttagccctgggtggagcactttgaggaagctcagtaaacatttgttttgagaactattcatttctatggccttaatgtctcacacaatgtggaaaa

SEQ ID NO: 120755 - DNA, 1041 bp, Homo sapiens
tccctctgctgctctgaaaacttaaaggacccttagccgccagagaagcagcagggatggggcctccctgtcctgccaacacacacacatattaatcagctagagaaagctctaaaaagaaacctagcctatttctgtctgtgcatggagatgaagacattcctagaaattgactcctaagcctccatggtacatgcaaaggcacatgtgagcgtgcttatgtgcgtgcactcactcacacacacacacacacacacacacacacacacactctattatccccaaggggccagatttgggacttgcctgtagctgtggctctcaagaggctgcaggtgaatctgaggtaggggctggccatggcggtgtgggggtcagtttgtgtgtgtctgtgcatgggagtgttataagcatgtctccctgagagctatgttcaagatttccttaagtgctgactgcccattagctggttttcagccttacccatgtcttcctgagagttgacttgaagctgacaggtggcttgagggactgcatgtgtagagacccctccgtgcacacacatgatacccacagataacccaggtgcaaatgggctcctctctccgctctgctctggaaatatctgcctctctgcatccgctcagttgctccgtgtctgtgacttataattctctctctcctgcctagactcacaagcacagcagcagggacagctgccgggccaatgagctccttctgcctcctcctctggggggccctccagggtcctgaggcttgctgaatattcactttctcatcaaagggaggaaaggcacagggagcagcagctgccaggggctccctgtcaatccacagtcatttatcacagtgcaaagaccattagggagcagttgtttttagggggttccatctggatgaacatcacctgttgctatttttaaaacactgtttttagtgactaagctgggattcagctgaggcgaaggtagatatggaagcagctgagtccccagacattctgccttccccctcaacact

SEQ ID NO: 120756 - DNA, 1104 bp, Homo sapiens
actcttggagtctggatcatagtgaaacagagctttacccttcccccatgtcccattttcagctccaggtgggcacctagaagcccccgctcccttggaatctccctcttcagtcactttccccaggctcatatttcattcatggctgctccttgaatgtgcactagctagtcctttttccctgggtcatcgtcatagtcttcagagtggagttcctgaaaggcactcttgctcatgtgccatatgtcattagactaaaagatgccatccccatcagctgagggtaggcaggggcacagagataatgggtccagatattcagatccttggaaaataactgcaaatccattaaaagggtgttttatggtgactccctctggcaaatgtctgcccctgccgcagcctatctctgatgcccgaattttctcttttggggttaaagcactgtttcatgttagactgaagactcttttcacccatcacattaaactatgatcacgtatgatcatctttatgcaaatacatttgtatgggctttcaggtgtacagatgatgagagggaggagggacgcagaagaagcagcagtaattgggatacactgatggagtggagcattccaaagagccagggtcaggctagaggcagagggtgcctagaggtcatggggtagggggaggtgtggccagggagcatgtgaaggggcattctcagtgtcagtcctgcatttggagtgaggggagtaactgagccatgggtcctaggtcaacaagcctcacgcatgcttttcttcactagctcaacacaatttaccaagtgggtaatattttgggtggatcatttattggctaaactgtggcactttttaggatgaaagagggtgttattaatttctacgctgggacaacaggcaaacttggatgtacagtcaccttagtaacatctgcaaggctttgtgcaaaatctgctctatgccagacacctgcaaatgagaggcagaacaatcaaagctaatacttagcactttttaatgcaccaggcactgtactaagtgcttttttgtgactcatttaatcctttctgtagttactgttaataaaataact

SEQ ID NO: 120757 - DNA, 1050 bp, Homo sapiens
tacctgtgtcccaaggctctctgctactgggtttcccaaactttctgaactgtgattaactattaggaatatgttttccattgctacccattacttatacagatatacaactgcaaaacacacacacacacccctcttttctttctttcttttttttttttttcgagataaggtcttgctctgtcacccaggctggaatgcagtggcacgatcatagctcactgaggtcttgaattcaaactcctgggctgaagcaattctcctgcctcagcctcccaagtatctgagattacagccaccagccactgtacctggccctttaaaagaaaatatgcttacccttgtggccagcaatgagccccatctcccagtatttgtgctattttgtggtcccctctcacattgaatctggactgcttcagccagtgagacattagcaagggtccaagcctccaaatgaaggcttggtaagctctagcctattggaaagtgtgtcctcttggaaggtttactcttgtgatgcttcccctgggaaccaagctgtcatatggtgggaagcccaaactagccatacggagaggccacttggagaagcaccaaggtcccagctgagttcccagctgatagccagcaacaacttgccagccctgtgaatgaggcatcttggaaatcaatcttccagccccatttaagccaccccacctgctgcccatgaagcggagatgaactgtccccactgagccctgccaaactgcagaatcatgaacaaatgaatgttgttttaagcccgctaagttttggattgttttgttttatggcagtagacaatcaaacatctttattataagcgacacaccatgatgttatctattatgttgcattctattctatttttcaaagtgcttagttgatttcatgacccactaataagccgtgatccgcactttgaaaagtactactctaattgatgcagacgtgattgagatcatctgtcttccaacctctccctctatcctgatgctcttagaatcacgacatataagaaatgaa

SEQ ID NO: 120758 - DNA, 1050 bp, Homo sapiens
agaaacaaagaagaaagactcaggcaagtgggaggagacaaggaagcaccctaggaacatcatgaagtcacagaatgttcgagccagaagcccatacctggcacaaaactcacctcctcattttcccactgaggaaactaaaaaccagagaatgagaacagttggcatttgttgagcattcgctttgtgtcgggccctgttctaagtgttttttgtgttttaatcctcacaataattttatgagataggtactatcattatacccattttacagacaaggaaaccaaggctcagagaaagaagggtactttcgcaaggaaggtcccacaataggagactggctggactgaaccagactttggtctttccaaacccttcatccagagcggagggaagctggtcatttgtatgaatgaaacacctgtgggagcttttatgccagactttggaaactttttaagagctcatactgtctctttttgttttatgtggtctgttccctttgctgccactagccataaacatccctacaaaatctcaacagactgcaagcttgcctcagggacacagaggtgatggtttaatgaactacgagatgatactccaggggatctgggttgggattattaggcggagggagtgaatgtgtgtcggcagaggacctagtgcccaagggtcccagaagaacagagaggcctgccctggagctggtctgggaccttgcagggccttgcaatagcagccactgctcattttttctggtggaaaaattgaggcagggcaacctgttcctgtccactcaggttagtggtgagccctgcctacctgaatcctttgcctagtcacgatttttcctccactccaggctctcaaatattagacagtagtcctgaggggcattgaactctggagccagagtgtctggatttgattcctgcctctgccacttaatgtgtgaacttggaagaggcctccaacctctctaggctcagtttcctgtacctccaccaccggatggctaaggattaaagagctcgatgtatgctaagg

SEQ ID NO: 120759 - DNA, 1039 bp, Homo sapiens
agaactggtgagccagctccaacctggcatttccaactcgaagttcatggttctgtctcctctcagctccgtgcgccatctttgcctgtttcttgggtactgaaccacgctcagcagcagggctgccagccctgatttcctgggtcagtcaggcaacatatctgaattctaagaaagccacctggagcataatgactttcctctcaaggtgagactgtggccagctagtgagaaaatgtgaatgagggcgaggggcaactctggccaccttttagtcccgtgggccatgtatattagtcacataggctaggttttgctgcaattgcaggtaactccacaacagaacttatttttcatctgggctacgtgtccactgcaatccagccacagctctgttccatgctttcttctcttggggaccaagcctgttggataaggcactatctggaacatgttctggtcattgtgacagcaagagaaaagccagagaaccacgtgctagctcttaaaacttatactccaaagtgacacatgtgacttctgctcacatttcatgggccaaagcaagtcatttggccagagctgcatatatcagaaaggaggtgtctatttctcctgcagggaggggcactgaatatttgggacggtctttttccaggaagataccagctctgcctaaaatatagcagttgcatgcgatttagaaatctgacaaacaggattgtcagaaaagatctgaaggaagctgccatgtggggaattgtaattttttcccctaaagattatttcatgcttgttggatccatcatattctgaaatccttttgctgtccaacaaatattgataagtggaggctattcagtcacatagttcttaggcatatcacgccatagctccctgacatatgcctactggctgccttaattttctcccaatttgtagctccatgtttccccatcttcctccccacaccccatctttttctttttttctttttttttttttttttgcccttcttcatttcttctctggtctccaa

SEQ ID NO: 120760 - DNA, 1031 bp, Homo sapiens
ccactgttgcataatattccattgtatggatggaccataatatattcagtaaagtgtgaacatttagatttttttcccagtctctgtgtcataacaaatcctgcagtgaataactttgcatttacatcattttgtatgtgggggcatatctgtaaaaaaaaaaatcctagaaaccaaaatttagggtcaaggggacacgcgtttaaaattttgagctatgagcacattgctgtctgtaggagttacaccaatttctgtgtccccagtgctccctcctctgcactctgccagcttggaacaggtgccaaggtcaaggaaagcagcatatgccaccgggacctattcctctcattctgctccctcagggagaaccaggtttctggcctttattgtactccacccttttatctcctgggaagtcaccagatgttctgccattggaagaaggggagatattgtctccaaacagaagacaccaatctatctgtttacaatgattcacatccagagaatcaatgaactctaaaatccttggcagactccaactcatggctggaggagctgatggtggaaacaggccgcagacttcagttaaatattaataataatattaaacatttactgtgtgtttattcaattctgggaactgtgctaaggtccttgcatggattacctcactgaagcctcaagatcacccttcaagatgtgtactgtcattcttcccattttaaggatgcagataggaggattgagtaatttcctaagccacgtaattagcaagtgacaccactgggatttgggccttggttgtttgatttcttttctttcttttttttgagatggagttttgcccttgtcacccaggctggagtgcagtggtgtgatcttggctcactgcaacctccacttcctgggttcaagcaattctcctgcctcagcttcccgagtagctgggattacaggtgcccaccaccatacctggctaatttttgtatttgtagtagagacggggtttcgccatgttggccagg

SEQ ID NO: 120761 - DNA, 1009 bp, Homo sapiens
aatggcaaatggccccaaagttcagttgtctcccaaccggcagtgtctctgccaactttgggtgggggaagtagaaagcaccttgtgtaaggaaaaatatgggtacatctcaggtccaccagcaactggtgagtcattaaccgtctcagtggctccactgtcttctctgtgtggggagcgggtggaactagatgctctctaagctccttggaccggttgcattggcatcagctgggagcttctttgagctgcagaatctcaggccccatactagacctacagaatcagagcctgcattttaacaagatctcccaggtgactgttgtgcacattatagtttaagaaactcagatgaaggttccctcctcctcctatctgctattttaataatagcctctggctggggacagccactcaccagcagagggcactgtaaggaggggtttcaaggtgcagcacctacacccaggttgtctccctgcctccctccttccttccagacctagactggaaagttcactgacttctgggatcctcagctaatcccttacctgggctggactttgccaatagacagggacactctccctcacccctctttagacagctgggaggcagggctctgccaggaaatgccaggccactcctgcctggattccccgcccacctccacttgtctgctggcctgccgactgaatctggctgacccttgtttctcggagaaggaactggaccagccagcagcctctaagagctcctagacggtaagttgagcacccccttggggcagctggagaggggatgggcattgtgatggggttacctggagcttcgggggaggagccaggccagcttagcctgcctgctggagtgtagggaccctctgctggaggaggggaggaaaatgggacttggccaatgggtatgaggaccactgggatgattctgtgtcctgcggaaatgtctactatactaacaaatgccattcatgacttgggtttggaccatc

SEQ ID NO: 120762 - DNA, 1021 bp, Homo sapiens
gcagtaacagggcagccagtttgttgatgggatgccagatcagtgctgtgctcaccaccagcccatacagcagcagcaggtgcagcagggcctgggcatagaggccgggggtcagctggctgcccgagaaccagcacctccacctttctgcagtacccagcccagcaacgagctcagtccctggggctctgtgcacaccatgggagtgcagagaagtctgcccacccattacctgcctgcactcaattgctctgctgaattatgtgcttctggagccaggtggtttcaccctctcccacattacttctgctactgagcactgtgtgccttaccagaccagggttgtggactgtgaaaaagagaaccaggacagtccagctgatggtgagctgaacagcatagaggccaagaggcagggccaggggccaccccaagccccctcccaggtccttccacaccaggtaggaggcatagctgtggagacatggtggcaaaaacattcagtgggaggaggttccgtggcaaatggaggaggctctctggcataaggactcttggatacccttgtgggctgaaatgggggcagatgggtttaggcatcatgtaagggccagggagggagttggtgggaggagctgggcatggtgaggtggaggaggggctggggagacttagagagggtggaagaagggctaactggaaccccaggcaggcatagagggtttcttactttctggaggacccactatggtggtgagaggcaagacaaagcgcctacctttggaggccaatatatgggagtaattcagatatagaggacttgttcccaccccattgggtaccagggccatgtgtgagaaacaagtactcaccccacgacagagtagatggctgtctgtacaagcaataagactttgtagaatgggcaccaggacagcatcctcgggccctcacaccaaccagacatgtgatcacgagtgaacagccagaccaggatgggccccaggtggggcaggagcac

SEQ ID NO: 120763 - DNA, 1047 bp, Homo sapiens
tggtgtgagggcccgaggatgctgtcctggtgcccattctacaaagtcttattgcttgtacagacagccatctactctgtcgtggggtgagtacttgtttctcacacatggccctggtacccaatggggtgggaacaagtcctctatatctgaattactcccatatattggcctccaaaggtaggcgctttgtcttgcctctcaccaccatagtgggtcctccagaaagtaagaaaccctctatgcctgcctggggttccagttagcccttcttccaccctctctaagtctccccagcccctcctccacctcaccatgcccagctcctcccaccaactccctccctggcccttacatgatgcctaaacccatctgcccccatttcagcccacaagggtatccaagagtccttatgccagagagcctcctccatttgccacggaacctcctcccactgaatgtttttgccaccatgtctccacagctatgcctcctacctggtgtggaaggacctgggagggggcttggggtggcccctggccctgcctcttggcctctatgctgttcagctcaccatcagctggactgtcctggttctctttttcacagtccacaaccctggtctggtaaggcacacagtgctcagtagcagaagtaatgtgggagagggtgaaaccacctggctccagaagcacataattcagcagagcaattgagtgcaggcaggtaatgggtgggcagacttctctgcactcccatggtgtgcacagagccccagggactgagctcgttgctgggctgggtactgcagaaaggtggaggtgctggttctcgggcagccagctgacccccggcctctatgcccaggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagccc

SEQ ID NO: 120764 - DNA, 1053 bp, Homo sapiens
ctggggccccttccacactctcccccagtggagctagggaatttgggtgggaaacaaaggggagaacataaggtgagctgagagggagagggagaagagagcaggccaagccatacccacctgccaggttcctgtctttgcctactgataaataggggatactaatggccagattttccattcccccaccccagcacccgctgtcactcaattaaaaaaagatagagggagagagcctgggggaggggcaggaggccttggctataaagcctgtggctaagtggggaaagcacgaagcctggcctgctgggtccttttcccgtcatccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacagggtaagcctcagatgtgggtcagggttctgctccctagaagagtgcagccttgggttaggctgtggaaattcaggatggttatattaggcgtcagggacagctacaaccctgcagcagtgagagtgcaccagtgggcccggcaggggtggtaggggacccagcagcaaattctcttggcttctcagggtgacaccttgggctctctaatcagggagaggtaggaggagctccttggaggcaaaagcccagagaataaaaccacccttcaggcctcctggtattgggatggccacctgcctctctgggtagaagcttagtcccagggagtttggcgaggacagaggatgagactggcacatctatatgtggctccgttcaaagcaacccttcccctcaacttctctgttcctgagtgggtctctccgctagccataggcctctagccctttctttagagcttcttcctggagtagatgctcccaag

SEQ ID NO: 120765 - DNA, 1018 bp, Homo sapiens
tcttcatgggttggcaaatgctcagcttgagaatgatcaggtgcccatgtgcatgtctaatagaaaacacctgccaacatcaagctctggaacattgatatttcctaaacgtgtctatgaagcgacatcttctcttaagggtgttaggagtgagagagaccaaaagtaaattatcttcatggaagcttgttgttttcatgttttagtaatatgtgagttgttgcaggattaaagttgggtaagagtgtcgtgagtacccctcctctattactggaagattttgatcagtaactggggccttgcaaagggggcttcgtcatagcatttctgtaggcgcaaactcaatcagactaaatgtaaaaaagatagtaaaggatcctttagccctctttcctgagggtaattagcctgtttctgttagagtttaatttaccctcagcaagaggccaaattggccttaattgtgtcctaattatttgcttaaatagctaatctttctcctatcacctcttgatatctgtaagaggttacttctgagctgctgcctactttacaaatgtctttttaactctttaaatgttcctgcatggactagcttgttgctatattatccccattcctgcattcgacatcctccatgaattctactgaggtcttctcaacataaggaaaatgttcccgtattgtattttcacacagcaattgttggtctccttcaaagtgtagccatttgtttgaaaacatgaaagcaggtctggcttaaaacaagttaaataccagtccatttggggaatttcaaaattaccataagtgaaaaaattgtccctgaaggactaaaaaacattcattagagaaaaatggaatggtaagattgccagtggatatgggagtgaggcatctagaagatgtctggaattagtaatccctgacatgtacacaggggcatactcagaggatttcagtatcttctctgctgtggttcagtagcaggtgcttgcaccatctaaatcttaccaaa

SEQ ID NO: 120766 - DNA, 1045 bp, Homo sapiens
ccatctgtaaaccttaacacaagtcaaaacatggattttctaggcttcctttacttttaaagagattatggttattattattatttttttcttggcgtttgagccttgattctttagacaaaacctagtctcattcaggattggctgtaagtggaattctgggacttagcaggaatgtgataaagcactttgtcatttgccgatagtagtcttgggtcaaattccgacgacttatcacacttgaagcctgaggaaaggaggcatgccctggtaatcagagtgaacacattattcctggaaacctagttagagtttggcaaacacccggaaattcacctgtgaatttttgcttccacataggactcaaacaaacctttaaaaaaaaaaaaagagagacttgacatcatcctgccattaccatcaaacaccatgtattgaatacttttaaatgattgtatatctgaacattaaactactacttttcacccgctcctctctaataaagaagctagttgcttattaactggcatttgggatgtggctaccttagatttctcatgctttttgttccaccttctgccctattacttgccttcagagaagggaaaggccctcacttgattgtcgtaagaagtctgtatgggagagttattctgcattgtctaggcaagtcttggtttaaccatggcttggttcatagcctggagtgtccctgtgtctggactagctcgcttgtctgtggcaacttccagatgttcaagtttcttaaaaatctggccacgggaaaaacacaccacttcttttattaatgttgctgtttttctttttttaaaaaaatacccaacttaacataaaatgcatatttcagaaatctaaacctcgggtctgaggctgtttgtgttaagcagcccccttgggtgagcaattaggaccttcagtcccatagttgactggagcccatgtatggttgcatttctctccttgcaggtcactttcgtccttcccgagagcagcattagagagagagtcacagcctaaataaact

SEQ ID NO: 120767 - DNA, 2919 bp, Homo sapiens
gatgatgaaagtttgaatcctttgtgttcagattacaaagaaaagggcttcgcacaagccaacttatgaaaacttacagaagagtttagaggcaatgaagtctcattgtctgaagaatggagtcactgacctctccatgcccaggcaaggaaatccatggtcctaaatggagatttaattgattggtggggtttactatcttacccaaagacaaacaacttaaaagcttaacccaaaatatagatttaaaggtggacaaaagtcaaaattttgtaaaaccaccagtgaaccagttgtctggctttagactaaggcacagccattttctagcttgagttgaatgaatcaggacaattaccttgaaatatacatctgcctcagcctgcttagcagagagcgaccattgtcattcagctacatttgttgaattctcagcaccctctgcttgaagcttggcctttattcctaaagcaatgtaagctaaagaatcaagactgagcaatggtggttttcctcttggaccacttcccatctcccaaacctattactttgcgtcaagaaagttgtaaattatcattcccttttatactgcacacttgttttggtcagtatgggtaatagccagaggatctgtccctgatgtaacttcttagactttagctattgggaatttagggaatgacattgagggttcagtagtccctttgctttcttttcaggaaatgggcctcacctcttttcttcctgtcaccctggtagttttgagtcaatgctgagcatacatgcagttttatcttgcgccccacattactttgcatatggcctcaaatgtcccttattttacactggtctttgatatatttatggtgtacatacatatcagaaactttttttttaatcacaattccttatggacttaattatcacattatgacatgaaattaccaattttaggtctcttttttccctaggcgtgttgaggatcactagagtaacatcttggaaggtgccaagtagtagagttttatggactgagtttattcttaccagggtgttgcaaagaccttactcctggattgcaactatcttaccatttcccagcattccctcttgactttcttttttgcagatcctgtacctcattcctcttctccttactttcgttaacattctgttaccataagtgcatttttaaaataccaacctttcaccatccatccacagccaattttagtcagtagtcatagagggataatgagtctctaatgtcatgacagttacacatttctaaatgtagcatgaaatagttggaaagtagtatcttattaggcaaacagaagtgatagtttttggatgttagagctgtctaggaatggtcttcggtgactcacaacaagaattgacttccaaactcctaccatggttgcccataagggtgtcagactagattatttgtttttatgctttgagtggatatagcttaaaagagaggagcagtttcctagatactttcgttaccatcaatggagatattttgtctttttcaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaaagaaattaaaaattagctgggcctggtggtgcaggcctgtagttccagctactctagaggttgaggcgggaggatggcttgagcctgggaggttgaagttgcattgagctgtgattgtgccactgcactccagtgtgggcaacagagcaagaccctatctcaattaaaaaaaaaaatttggtggtggagtgggatggccacttttgtgtttttaacctccatagaagatttggatgtgca

SEQ ID NO: 120768 - DNA, 1047 bp, Homo sapiens
ttagacaaaagcaattcttactgctttgtattatagttatttggaatgatgatatcttctctggattgaaaactctgtaataattaattccttttttatatatctgtattcctcataatgccttatacagctctttgtatgtaaaaagataattattgagtaaatacacatttggcaagtaaaaaactacacactataaaacaatttcaaggcaatagagaaagtttgtggacaaatgaggatatatttaaaagtagtagtggtacaaaagatgggttgtgaggaaacatgactgtaagaaagctgttaagttaaggaatatagtatttgggaatgctgataaaaagcaaagtgtttgtgggagacaataggtcttccctattcccttcttcagtgttgaaaattctagttctgaggtaaactcagatctgtaaacattttaaaatctttagagatcagtgtttggttttctttttcatttctactattaaataactttttcttagaaaagaaatctggagaagtggctgttctgaagagagatgggcgatatatatattacttggtaagatggggccaattcctttttttttcagggccagttcttaatacattttaaggatttgtgaacagatgggctgcactgcatttgtgttgatcatgatgttctattctagacaactaagaatgtcaaaaagcttcctatcttatgacaactccagtccagtgatggcggctacttggagcactgggttagaaagaaatgtgaggctgcatcccagctctgtgggaaagtcgtgtatcatgtaccataggcctgttctaagacttgcaaaagttaggaatgcctgccatactatatttcctaggcagagtgagataaaaacaataatgtctcaagagacagatttcccaaaggagcttttctcttattccatgtcaaatagcacactgatagcaagggggtgaataaaaacaaaaaataataagtgcagtcccaaataatacttagctcctctcctaactactgcctgaatgtggggttct

SEQ ID NO: 120769 - DNA, 1025 bp, Homo sapiens
accaattatccagcagttagtatatgccaggtataatccgtgtgttagggagggagtacgtagaggtcaataagaactgtgcctacctgatggaaattgacaggtgaacaggtagttaatacctaacggttagtgctataaaggggccaagttcagttgctgtgaagtatccatgcgtgagctagcctccgtgaaaggcttatcaccaccgcacttttgactggccttgaagaatgatggtaattcttccacaggaaagatggaagagcttgctcgaagagaagaaaagcatgtgcagaggaatcaaattacactgttggaggcaggaagatgggatagggaagtgggcagtagttgtgatagtttaggggggaaagcccagttggtaaaatacttgtatatcttgctaaggaatattttggaaacagttattattttgtatggaggttcaagtagaagggatctagagctatattttttcctaagattgaaaaaacgagtttctgacttgtttatgggttctgccccgtgatagtggctgagttctttggggatgaagaggagacttgtcctaggactctgaaaattatttttactcatgtgaatcatctagtgcattccctggcacataaaggtcttaagtatctggtgcccatttctaaattcacatttaatgttatacaactaataggtttcagaaaactcgtattccagtgctctttcattactaaaacttcggggacaggttttattttcactttttagggtgagtttttcattgttgcttaagtgattttcttaattcatttgattgtcacgttatccgcattagcagatgagatgatagagcttaagtagtctaaaaaacatgtatatttgcctttggaacgtttttttgtttgtttttggatacagggctttcctctgtcatccaggctggagtacagtggcgcaatcgtagctcactaacctggaactcctgggctcaagccatcctcccttcttgttctcccaaaacgttggga

SEQ ID NO: 120770 - DNA, 1017 bp, Homo sapiens
tccagaaatctgtaggatgatggggaagctggacagccctttgttgtagtctagtctttcatcaagcgtctatcaggacccacttgttgagttgtgaaagaaattgagtgagccaatgctgggaatttttaaataatagaatagaaaatatctgccaggcatgatgatggctcacgactgtaatcccagcactttgggaagccgaagtgggagaatcctttgagctcaggagtttgagaccagcctgggtagcatagggagaccccctctcttaaaagaaaaaaaagaatagaaaataccaaagtgcatcttgtgttgtataaaggtaaatgctgtttcatgaaactttcatttcagttacatgctttatacatgtgtgcactgagttgtgataatgaaatgtgtttcttactaagggttgtggtcaaaaaagttaaaaagctactgttctaggctttgcctggtagtgattatcaactgtgataatcctatggcttttcatatgcttacactagttgagtttctgaagaggttttagctttggagtttgtgtaggtccacatagaatgggttcctagtaagtggttggctaagtctcagcttttgcaccttggaatagtggggcaaagagaattgcactgagaagagaatgcactaggaagagaattttcatgctagccagaataaacacttattatttgtttctctctctttgaggaaaaaccattcaaaactttgtgttaagagcaagagctagacagactaaatctggcttagtttgtcataatcttgggcaaagaggcactttgggaaagactatcgaattgtattgcagtcttgctaactgaagctcacagtagtaggaacatatgactttactgaagccagttgcttatagcattaaccattaacagtatcaatatcatgatacaggctaaatcactctgtcattaatgtgagagagaattgctgctagatttgaagctgctcttcaaatcttgatactcttcaaagtat

SEQ ID NO: 120771 - DNA, 1021 bp, Homo sapiens
gacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctgtgtaatttcaatatttgttgttgcttctgataaagctaaaataaccatgtggatattatagaggccagtgaggaattccaccatggagactgcaaactgaccagaaagtgcttttaagaaatctttagtagtgagtttaaacaacaaacatatctagaattcacagagtaaaatgagcaggataaaggtatacatttgacatttcattttagcttgagagactgtagggaaaaaagggtcatcctctacataagcttccagagctgcttgctacccagcctcctagagtcattgctgggtacagtttgatttaccttcttcactttatttagaatttgtactcaaccaccatcaccaccatcacctttccctctcattgccttctctccagccttcactacagaccattcctggattggtttaaacaggcaactaaccttgccattatgattaaatgtttgtcatggatttagcccgtgtttggtgacaaatgccttatatctattgagacttctcaaagactctggatattctccattatgtctgaccttaaagtattgagcttggcatttagtaacaggattcataga

SEQ ID NO: 120772 - DNA, 1035 bp, Homo sapiens
ggagcaaaactgatttggaagagtcagataactgagtcagatatttcatgtatagcatgtatagtagaaaaggggatgaaaaccataaaaaaatatatttttggccgggcgcggtggctcatgcctgtaatcccagcactttgagaggccgaggcaagctgatcacaaggtcaagagatcaagaacatcctggccaacatggtgaagccccgtcaaaatacaaaaattaggtgggcatggtggcgcatgcctgtaatcccagctactcgggaggctgaggcagagaatcgcttgaacccaggaggcggaggttgcagtgagctgagattgcgccactgcactgcactccagcctggcgacagagtgagactctgtctcaaaaaaataatttttttttttaaggactacatcgttctttgttagtatctttgggatctgttgaattgtgtcattacttatttcctccagacacagcagcagattgctgtccagggacagcaagtggcacagactgctgaagggcagaccatcgtctatcaaccagttaatgcagatggcaccattctccagcaaggtaagtgtacccataagcttccctaggactttttggggcaacttttttgtcccttagacaactgacatctttagaatttgagtggtgaacttgacactacatattttttggacaaaaaaaaaaaagatttcctctagctctccattgattgttggtttcttgtcaccatctgtgaccaacagtgattccatgtgtagcagtttctatagtggttgctaatctagggattgtgtaagcttttagggaagaagtgtttctaaacagaagaatagaaatagggagttcattggtaaagagagaaatagatcaaaaatcaagttggctttagagtgctattgctgcttatgtttttttctgggtcattccattactttaaatgactattatgtatacagcacttttactaagaagggtcctcaaagagcctctagtctagtaagaaagacgtgaacaaataaata

SEQ ID NO: 120773 - DNA, 1050 bp, Homo sapiens
gcccttgctggactcctaactttctgaccctgaccctagtccacgcaaatcactttacccatctggccttcagatttatctgtaaaacgagtacattaaagtgtatagattctaatgattctttctagccctgctaagtactcagtatttaaatgatgatcaaaaaacagtgacaaaaatacagcatgacatggtttctctgggtcttttccttagacacctgaatctgaatactcttaacccttaagtatagagaacaacacaaggttcttaggaaagagatacactaacagccctgcagtgtttcaccatggagtgcaggccagactttaaattattttaagaataaggtttattgtctcttctttcctaatggggctacactttaagccatgtatgcagacttaagatgtattacaagcctttgatttacttggtaaagttatgtgtattctcttggggggataagtagtgagagccatgagttcctgttgcttttgcaaaggactttaatcatcatgtcatctttgtctctaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacg

SEQ ID NO: 120774 - DNA, 1364 bp, Homo sapiens
taagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgcttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgctactactgaaagtgtttatcaaaatgtgatgaagta

SEQ ID NO: 120775 - DNA, 1094 bp, Homo sapiens
ttgtcaaacccctccccttggccccagcacacacatgcacttgctcatatactcccgcatacatgcacgcacaccccatccacctcctggcatgcaaatataagcactggcacatatgcacacatgtgtatgtacatgggtgcatgtgcgtgcacacacacacacacacacacagacacacacggctgctgcttgctctctcctgcctccctcagcctttgtatatgttttgctgttatcttgggtgagttcaccttcaaatccaagcctctaagcaggcggacaccttgattttataagtcaccctgaagatcatggttctgaggggtcatagaaaggcactgagctgcatgattcgcatatgggtgtaggagtcagccagcccagtttgagttcctgctctgctaggcagtggtcctggacaagttacttaacctttctgtgcttcagcttccttatctgtaaaatgaggatgatgaaagtagtcacctcacaggggcgttgtcaggattaaacaagacaacacacctgtcactgtgtctggtctgccattggcgatggtgttgaagatatgatgacagacgtgcaggactggcctcctgcacagacaatgcagcatcactgtgagggatcccagtgaaatatatttcccctcatcagtctctgatcaatgtcactatcagtcctttaggtgaatgtatttatcccttatttagctatccctggaattcaatagcttttcatcttcacgtgaatgagttaagcagatcccttacaatttgactctagttaggggaatgttcctcccttcaattcttcaggaaatatttactgatcacttcctatgtgctgagtgccaaagacaaaaaggtgaatgagatacagaacctgctccccagaaacccctgtctagagagggaaacataccatggcagtcagtgagaaaatctatgatggagatgagctcaggggttgagggggaggcagaacagagtccctaagatggaggggaccaagcctgggaatgtgatctgggggaaatgagtgctcaggttcactggaaggaggtgacagacggcactccaggctggagg

SEQ ID NO: 120776 - DNA, 1019 bp, Homo sapiens
acacacacacacacacgcgcacatctctgtgaaaagatgaggcacagagaagaatcattcccagtcatgactggatggcaccaataataaaggctgacacgtccaaagctctaagactgtgctcctcactttgctaagcacgttcgacacttgcttcatttatttatttttatttggcaggtgagaagtaggcatcataattatacctattacatagagtaagaaactgaggctgagagattaacctgtcaaggtcccttagctaagtggtaaagcctggctgtgtgcccagacctgtccacctccaaagcagttgtcttgtaaagactgcctaggctgtccgtggctgatgctacaggaatggagcccagagaggactagggatggggagacttcctggaggaggtggggtttggcttggccttgaaagaccaggtaggcttccacttctacccatccagggcaggccgtatggaaaacagggaaagcttctaggcaaaacatgaagaactttaaaaacaacagtgaggagttgggtccagctagccaggagtgtgtgttggagcaggttgaggccaggctgtggagaccagaatgtcagccagcaaggtagcctcttccccactccagcccaatgacctatgtcagagagagctcaccaggaacaggaatggtgaaggctggggactagacagcagtcctgctcaggcagggagggcagagaactcacacctggtctgcaccccatttcctggccaggcacccctggtctcagtcattccccatttccaagtagtaaatagatgtataaagcaaccatttccatttaaagctctgcagaccgtagggaggagggcctgcaggccatctgggcccttgtttggcaatgtttgtgctcacaacaaacctgatagacagagatttatcgccgttttcattagctggggttggtttggtttgctgcttttccaccccctccccgctacacacacactcccgagttacagatttatggtggg

SEQ ID NO: 120777 - DNA, 1019 bp, Homo sapiens
acgcagagaaaagaactgcagctgggctagctcgggccggcagctggggatccggaaacactggaagaggggacggctcaggcagcatggcagtgtttagccacagagaaagctgcccaccgattgtgctcagagatgattttgtgggtctaggcctaaacagtctgtacccacacgggtacatgatgagggtccccggtaagcccactgctgccaacttcctaactcactcttcggccttaggcatgacccgtcttctctctgggcctcagttttcctaactgtacagtgggtgaagaggacacctgcagccccacatcctcgggctcaccatcctgaagctgtgggttgggagccaggcaagaagagacctgaaggtctcaacgtacaccctctttgttccaagggcatcgggagcctacttccatgggtccttcttgaaaggggtgctgtggagctcggggcagaggacactatgacccatgcaagtctcctccttcccaattaggcagtggagcctgattaaaaggggtgctgcctgccccctcccacccgatccccatcgacgagatttcccttcatcagaatctcacattctccagaaattaatttgatgcctcatgttatcaattaattgaatctcgttgggagagagagctccgcgaggtgaggcgagcttcagcttggcccttgtgtgccgccatcccccctccccctcacaccagggcagccttctcctcccccattcctttttttctgcctttcttttaattgcacttattttctaaaataaaaccactgctctgtgcccctttgcccagtttggcttggatggatacccatggactgggtactggctgggatttgccctttcagaggtgggggcaggaggacttcccctcccctggaccctgtctgatctctccttaagtaaacagaatctcaccctttgggaatttggccgtgatcctgtgtgctccaggggcttctggtgagaaacttaggaggactaggggagg

SEQ ID NO: 120778 - DNA, 1023 bp, Homo sapiens
cccctgccagaactgatccattaaaacacagggcagagggcataggtgtgtggtacctccaagcctcccaacagtcaggtcagatatctgcaggaacaagccctcagcattttcaaggacacttggaagcccttgctctgccccctgcatggaagatgggggaaggaagttctaataggacatccctattaggaaacctgggaggttgttgtggcaggtagagctaggtagtcaccaggccctgactgaggaactgtgctttgccgtttcacatacctccttgttcttatccccacaacaaccctgaaagattctccaggcagtggtaattatcactctcatttgataggtgaagtacccaggcccagagaggttacctgacttgccccgagtcacagttaactggaacttgcctttctgaaatgctggccataagggctgaggtcacaagtggactaacttcatccctgctgagttttgttgacccacacacagttcattacaatggtaaatttcacataaatatccccacttctgctccttttgaaaaacccaagccctgtcaacactgagcctgcatttctgtgtggaaaggatggactgggattgagtggcagctgcctcctcgtgccctcctcacctggcctcctaagtgaccagcctagcccctgaaggcattttggttagcagctttgacatggagattcacctgtccccagtattcctcaaggagaatctagtgtgggacagtgtctgaaggactctgcagggtctagccaggcacagtggctcatgcctgtagtcccagcactttgggaggccaaggcaggtgaatcacctgaggtcagtggttcaagaccatcctggccaacatggcgaaaccccatctctactaaaaatacaaaagttagccgggcgtggtggcaggcacctgtagtcccagctactcaggaggctgaggcaggagaattgcttgaacccgggaggcggaggttgcagtgagccgagattgtgccactgcac

SEQ ID NO: 120779 - DNA, 1017 bp, Homo sapiens
gctccttgctgaggaccttggtggctgggggaggagcatggattgggaagataggggtgtgtagagaagaaaggaggacctcttggagcttgcccctcattaccagaggaagcagctcagatctacactgggtggagtccactgtgaaagggacccggctgtgactccagcagaccgaccatcagtgcctaccagtattcacttaagtactgtggtttcatgtccacatgccagactgagagtgagaagagaccttcaggaccacctatttgtatagagacagggaagtagaggctcagagaaaagggaaggcagaggattcacaatggtgtgtggctgagcccaggcccctgcctgctcccctagccagggttcaggctcctgtggacactgacttctcctccataccccacacccttgtagttacaggggactgataatcaaggcctcccgccagcacccttccccatcctgtctttagctgactgggtcccaggcacccagagcctgctcacccacagtgcagggagcacaccggtgctgtcgcggcgccctgtggagaggtgggcaggagacatgaggctgctggtgtgctcatccttggcgggcaggtatcccagggcagaggtgagaattcagaaagcacttcggagtgcctgtcatgcaggtttggggggtatgttgttaggtgggcgggagcatggaaggaggtgtatgggtgtgtgtcagtggggtaaagaccctggagggggcagagcatgccacatgggaattaatgccattcacacaccctgcggaaatgacttttcaaatgcatataatctcaagcatgcaaatgagaggcttgcttcaccctgtttaatatgaatgatcggcccctgaatagctattattatacaccacattgcagcaattatgttgttcactgggtgttactctgtatgccccccccataaaaagaaaagaaaggagcacctctgtctgcatcctcctccttccttctttctctttttccaa

SEQ ID NO: 120780 - DNA, 1014 bp, Homo sapiens
ggggacatcgggaggagccacattccatcaggcatcccaggagcagcctctgggaagttgaggagaagtagatgcccagctactcctgtggcgatggttatgtttttgggggtcagcagtcactgccctttcagccttcagcctcagcctctcccctgtgtctctcttcctcctccaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggtaggaactggtgcgccttggggtatctgggagcgggagaggggcactaggctgcattccacttcatcctggctgctggagcaccactccctgccaggcagcctcactttaccattcttaagacagtccagcctccaaggactccctgtccacccacccattctggtggccaccttgagcctaggctaccacagcattttcaagagatagaagtgggactcggaggtctgagatcatgaagcttgaaactgtcccagaaatgccaataagaagagacagacacacaactgggcagcaggcttgagattggcatgttggattggtgggcactccactcttcacctgcacactggctaggaaactggctaaatgaacagggttaagagggtgctgtgcacacagggggatcttcacattatttctgttgcaaaacattatctgcctccgagtcagcttgggcctccatttccagcagtgaagagaggcccaggcagctgggtaaaggccaagagaggtaagcaaagacaggcctccatttttagggctcaaactgggaatccctgtctgtgtcttatatttcctcttccaccctaaagtgcagagttcgggagtttaa

SEQ ID NO: 120781 - DNA, 2342 bp, Homo sapiens
aaaatggggcaataatccctaccttacagccttacagaggaagattaaataagctcttgcctgtacagtgcctgacccatagtagatgctcaacaaatagtactgatttactaatgccctgagtcaaccccctttattttcctctaagagtccctttttgaccatgggcccttccatttgctgtccccattgagtcctaacaaaacttcactgggtcccaggctgagtctgtagaggctctgatccctgaaccccaacagctcttctcagtgacttctactacccttaccccaagcccttatggacccatgaccctctcacccccaagaccttccaccttaccctgatctccttctccttactgccccaaacactccctaatccctggatcccacccagcctcccaggccattgctgactcagcccctgtcttgcaggctctccaagtggcccggcagttcctgctgcagcaggcctcaggcctgagctccccagggaacaatgacagcaaacagtctgcctctgctgtgcaggtgaggaagagagcaccccgctggctctgggttgggctggagtgtgggcctggcacagagggagggcaaggacccgttggagaactgctcttgccagttccaacaccaaaaagtgggcaacttttcaaaggaaatacagtcactgcaggggtggggcaaaaaggcttcccactttctctcgtctccacctgatcagccagaccttccgctagcttagcctctttgtccctgtcactcaaagtttgtctgcagctctccctgtctctttgtacctctctcactgtttgttctcccctgcctcttcccttcagggtctctcttggtcacttctcatgtttctgcgtccctgtcggtcactccctctgtccctctgtgttcctgtgtctggggctcagcccctcccaggccatctctgttgctgcagtcacgtcaccaagtccccccttctcttatcctccccccttatccctcatccaccagctctctcgcagtctctccatgcttcctgtctcttgatgtctctctgtctcttttgttttcctttgcacaatctgcccttttttccccttctcccttccctccagcttgccagcccatctggctggctgggggaggggagatctgtggggggtgggcggggggtgggggagccaggccttctgtttaccttttgtgtcacaaagaacttgggagaattgcagtctgagtccgggttgggtcactactcgggcagccactcccctccccctctgcccagcagcccgggatccatgctccccccacccctcccccagcagagggaggctcagaattggggaagggattaagccaggctttgaaaggaagtttatctaagggaagaagggtgagtatggttggttctgagctggaggtgctctggagtctggggctgggtgctgagggaagtgaagaggagggtggggtgggtgcagggtgctcagagaaggacccaggaccaggctttgtcctgggtggagattccagtgctctgacaaagtctgagttttatgtaaaacaagtttatgtttggaaaaagttcaaggtgcccaacagatgtgcagccttaacagtaaccctcttaaaattcttgaccctaaggagacaaccctcaaaggggaggagctgggcaaagatcagggcgtggcctggggtggaggaggggaagacacaatctggaaagtcaataaagagaggaagagaaagatctcatcagaatgagatctaaaaggttctcatacccatgctggtcaggattgggcctctttaaattaatgatccccacatacaatcccagggtttgaagtggtccttgggcttccactctgaatcctgcccgccctggacccagcttagaacaggaaggagtaggctggacaacagcaaacgttcccccaaaccagaaaggggctgctgacccaggggtaggagggtaggagcttgatggtagtgggagggactggggtaagacatctagaaggactgctcagctggggattaagggtcacagatctgaaataattgagagctgaagggagactatggaatcttccttaggaaactccctccctccaaaataagagaggcctagaggtttcagagtcagaaagacagataaaatgatgtttttctcaggccttctctctccttgtctcattacttccaaaaattcattgattgattcattcattcattcaacaaatacttactgagtacatcccaaactaacaactgacatatacagagtgcttaccatgaagtgtagacactaagcgctttacagctatctca

SEQ ID NO: 120782 - DNA, 1051 bp, Homo sapiens
tccagtcagaccgtccagccgagcacgctgtattcatgggtgggtgcagggtccctgagggaggggctggaggcagctgccggcgtttggcccagggctcacactgccagggcttaagttagcacttagctgcccagctactctccagatggtgactcatgggccctgctgagcctgctagctgcagagcgcccatcctgaggcatctgagcctggcaaggggccagcgggacaccagaggagctccagctcagttctcagacccccaaggggcacaaggagaggtggatgaggtcaaccaactcaggagatcagcatgcggcagccacttcccagaccctttgtgaccccagtgggccacctcgagacgagtgcacaccatgtaatccatccagatctctgtagcagcctccataggcagctgctcagccaagtggcaggaaaagcaagtgccaaggaggccttccaaggtcatctcttccattcccctgcttccaaggaagaaaggcccgaggaaggaaaggccacatccttttttcacatgctcctgtcagtgactcacagtcctggtgcctggaaagatcttctgagtgtctggtctcagtctttcctgttgcgggccacgttcgtctctagttcagctctcacagcagtgagaatgagtggcctagtgccttggtcctcagtgacctttgtcaggcagcaccctaaggcacaccaggggaggagacagagaaggaggggaaagggaaaatccagaatgttttaaaaagtgattttcttcacgtttacatagaatttaatggcgtacaagtcactttcacccctgctcccactgtcccttccgggtcagggtcagggcaggttatttaacctctctgggcctcagttttcccatctcatctgtgagatgttaatgatgatggcaccatcctcacagggttgccgtgaagattccatgagatacacgtgtaaagggcttagccaagtgccgtgctgggcacataataagcagtcagcaacgtctgctaatgatgcagggagggcaggt

SEQ ID NO: 120783 - DNA, 1064 bp, Homo sapiens
gtgagcgagaggtgttgggagccatgggattccccaatgtccttggattcactgtacctccctggttgcttctctgcctggggatttcctaatccatggcttaaggggtggttcaaggctgagtcctgcctctgccaggcattgaaaagagatccaactcctcctcccctaccccacaggtgaggctgaggcttgggagagggtcccctgaggacctagcctgtcacagcctaggacaagtccctacacagcactcctctctgactgggctagccctgtaaccttcccttcctgcttccgggctggcagaggggcctctgaggtgccagggaaggcatttcagctcaggggggctaacacttagtgtacctaccatgtgccaggcactctgccacaacttgggagtgagagaggaaattagagaagagtcctgtatgcatggggtcacagagtggagggggcggcagacagccccatcagagcacctgtcctgctaatacaggaacaagacaaaatagcagctgagacctgcctgtccatgactgcacaagcctggggggttcaggggaggtggggctgggaagagaatgatgtcattgcttttctctgaatcttttccctgtagctggattctttgggccttctatagaggcctgacccagggcagggggtagaaagctgttctactttgagaatcctgaatgttccagcctagaaggaatcatctcttacagcatagtctcttatgttttatgtttgaggaaaccgaaacataagagagggcaagtgacttgctagagtcacacagccagctcagtgcagagttaggagcggaagcctgccctgctaactccctgcctgccattcttcccaccccaccctagacatagctacacacatgcacacacattaggaccaggatggcaccaagagcgctctgtgggcttcacctctggccactgtgtgtgccgtccaggcaggtgtgccggggtgtgtgagaggagacaaagtgcaggtcctcgtgcaaggtgggccacgttttgaatccttcccatgctgtagac

SEQ ID NO: 120784 - DNA, 1043 bp, Homo sapiens
aaaagcagggagggttcagagctgtgggaatgaaactcctccatcccttgctccctccctccgcacccagaccctgctcagggcccctccaggctgactggggaaagccagaccatgttttagggaaactcccttctcctgcccccaggagcccagatgggacagggctggggttgtggggatagcagtaccctgccagtggtaaccctcctccacccccccagctacaggagtactacaagaagcagcaggagcagctccacctgcagctcctcacccagcagcaggctgggaaaccgcagcccaaagaggtaaggggctgtaccagggcccaccaccgccctcaccccctgcccagagctgggtgtccagagctggtcaggagggaattgccttgcaggaatagtagaaaaatctagaaaaggctgaggaaggggaccaaggatcagtgtgggggaaatggggatggtggttcttacgtgtctccatctcccctcatccccattcattctttctctccttgcctcgtgttgttgtctctgtgcacatgggtgtagacaggtgtgtacgtgtcacccccgtgtgtggtgtctgccgggccacgctcatgtgccttgtggtcgcaccatcttcctgcccccttgtctctttgtgacccagcacctcagccctcccctccttgtcctgcgaatctctgagtccctcagcaaaccacctccccttacctcagcctgcccccagcttcttccccttcttcttatgacttgcccagccacccctcggtctcctctcagagctccccagcctacatcccctaccccatcggagcttctataccaggccctggaggcccttctcccctgggtcccagacctgtgcatctctcctgctgcccaaccgcagccccaagctctaagtttcctcttcccagaaggctgccctgacacccaggaattctccagcacccccagtctccccctcagcagtcttgtaattgctgtgttatcagcaggtaaatctctaggctaagtttatcctgtgtc

SEQ ID NO: 120785 - DNA, 1021 bp, Homo sapiens
ggtttacttaattagttcatttgcaattagatctctctgtagctgggattttagcaaagacatcaaaggaggctgacgagaagggagaagccttcctccattgccccgtttttccacctctttctcttctttgtatctcttggtctgtctgcttttcaggccatgggtgggattagaggataggatgggaggatggtggcagcagggaaaccggagccaactttctctcctcctctcttccccttgaagacacctcaacacagagcacgccctggatgaccggagtacagcccagtgccgggtacagatgcaggtggtgcagcagctggagatccaggtgtggcccggaagatgctggggagggacatggtgggctccagcccctgcccacccacagcactgacttgctaggtgggctctgttgggagggtctcatggaagggtcctatggtcaaagccaccatcttatgctttctaggtcctaatgaccatggttgtgaggtgaggacagctggattctgaggggtaaaccaaggttgggggcgtctctgctgggaggtccagaagagactcacgctacatagaaacatcaaaaataattattagcagctaacatatggagcacttactttgtgctgtgctaaatactttatatagctcaaggaatcctctcaacaaccttatgtggtgggtaccattattctccccattttccagatggagaaaacaggcacacagagctaaagtaacttgcctgtgagtggcagagctgggattagaacccaggcagcctggctttcccaagggagtatcccagctacttgagaggggacactcagcagcacagggttcccaggaagcaactcagggcagctcctctgtgcttacccatctccctccagcacctagcagagcatcctgctgtgagagggtggtcatgagagacccattgagtttatgaatggggtgtctgagccattcatcagttcctgcatctgcattcagtatgcaaggccctcac

SEQ ID NO: 120786 - DNA, 1093 bp, Homo sapiens
ataactgggagctggccgtgggggcagcacagctgagagaggagggtgcagggacaggactgagggacacgatgaggtggggcagactagggccctagtccgggctcccatggtggtgaggggggaattgggccaagcaccccgccctcgcccaagcgtcctacaaaccagatgacctcaattcttgaagttatcctgccaggaggaggtgggacagacaaggtgacttatcttctttctctcctctttctgcctctgggttgtcaacccacactctcctctctccctgtttatttcaacaagtatgtatgaggcctttactgtataccttgtgctctcaaaatataagctgcctgttctgagccacagccaaagcatggctcccagactcctgtgggtcagtggaggtggcagtgagggtttatgagctctttcccaaacttttaaaagctttgtggaaattctgcatgcagctgagatgaagcatcctgggctcgcagagatgccggggcccgaatgtgatctgctgctgatccaaagccctgagtaacaattacatgtgtctttgattaacgaagatgatgaaacagattattactaactggatagcatttagttagtagacagaactttccaagatgtggcagggagagaggaggcagctaataaaatgggtcatccatggtgaagaggctgggaacccctggctctatggaaagggtaggggcccgccttccctttggctgggtctcctcccagcccacccccctcccctgctcatccctgagctggggaaggtgggccgctgctgcgtgggacatgggatgggatgaggactatcatgtttgtgcttggccaagcaagccgcctctgagctcctcttcactgcacccacagaacgccgtgcgccacaacctcagcctgcacaagtgcttcgtccgcgtggagaacgtcaagggtgccgtgtggactgtggacgagcgggagtatcagaagcggagaccgccaaagatgacagggtatgtgggtccagagctggatgggctgtacctgcccagggggcaggagccaactcacccccaccccctacctc

SEQ ID NO: 120787 - DNA, 1075 bp, Homo sapiens
ctatctttcttctccttcctccgttcgctcatctcccctctgctcccctcttctctcctccccaacccagagcagtctctgccccaggaccagcttttctttgaagagagccctaggggagatcagccctcaggtctgatgggatcctggggagggggctgtgggcaccccactgtgccccagagttctgggtgagtttggggggcagggggcagagggcatcagaggacagccgcctggtgcccatgccatacttttgcctcagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccagg

SEQ ID NO: 120788 - DNA, 1051 bp, Homo sapiens
tctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggac

SEQ ID NO: 120789 - DNA, 1096 bp, Homo sapiens
gtatttttaatagagatgggatttcgccatgttggccaggctggtctcgaactcctaacctcaggtgatccgcccacctcggcctcccaaagagctgggattacaggcatgagccactgggcccggccgacttctcttaacctcagtctcttcatctgtagagtggggctagtaaaggcccctgcctcatagattcattggaggcctaaatgaatgtaattcatgcacagcactcagaacagtgccaagaacatgtatcactccatatgttggttaaacaaataaacagagggtggctaagagcaaggatgatccagactgcccgctccgatgtgcttaactgtctgtgcctcggggtcatcacctagaaaatggagctgtggggacggattcgtgagcttcaggcacacagtgaacactcagcgtccctgctgctgccgctgccgcaggcccccacacccccggctatttcacacacgctcatccctcccctctctcacccgtccccctctccaccgccaccccgcagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgca

SEQ ID NO: 120790 - DNA, 1036 bp, Homo sapiens
ctcctacctcttggggcccaggccccatccccctctcagacttctccagcctcatcttttttttctttgctctgttctttccaaggggggcagtggaatttatacaatatttaagcagccagagccgagtctgggaagatattattaatgtaaaagggacgggctgcaaatgcttttggacctggttacaattagagggtgatttttctaaaggtcaatgaattcagataatatccacaggggggagagaaatttaatacctttttagtgaattaattaattataatattatatcggcttggggttcttttccagagtgattaagggagctatctgtcttctgtgaggccggagaccggcgcctgccgccagcgaggaccctggcgcagggctcaggatggggggcccttccctctcctctcacccatgcagtggccaaggagctaggggcttgttaggcatgaaagaagacaggccggacctggtcagggctgagggtggtgcaggtattggcctttccccttggcctgtgtcttccacccccgggtctggccctcctgctgccatgtcaccaagcctcatgccatggtggcctgaagagctgagatgtggggtatggcctctttctttacacttggagaaactaaggctcacgggcttcagggacatgccttagctccactgtgggttaggacagactgaggtggcagagctggctggaaataccgagaagacaagaaggacctccctaatacctcccaaaccaggccttctggaaaatctccaccagccagaggtctgtggagctgcctgggaagcttctccatctctttcagggtgtatagtgtgcccagcctctgcttataaaatgaaaatgccccaggagtattgatacctccagttgctgtgaggcctaagatttctgtccctggagggatctgaaagtggccagggagtggtgcttttcacccatttattcatttattcatactcagtcaaatgttcattcaacaaacatttgtggcacacctgctct

SEQ ID NO: 120791 - DNA, 1028 bp, Homo sapiens
actggtctagactctagagctaccctatgctttcttccagcggaaacactttgggtcttgggtgccgtagggcaggggcaagtgctgtgatagaggcccaggggaggggtcctggtggctggtgcccataggtgtgttccccagccttctgtctgctcccctgcaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatct

SEQ ID NO: 120792 - DNA, 2627 bp, Homo sapiens
tccagaaactctagaattgattagatgacctgctctagggcttccataatgcctggggcctaatcctatcacatattattggttggatcactctctcagacactctaggccaggggctccttgagggcagggactacatcttataatagctctggactctgcagaccttcaggttgaattgctgggtgaaagggcccaaggtgaattttgacactccaggtgtccccaggaaggactgctcctgggatgataggccctagagggggctccccgtggagagggggatactcatgggtctccctcaccccctaccccacagctacccctgtccagcagccacctgaatgtgtacagcagcgacccccaggtcacagcctccctggtgggcgtcaccagcagctcctgccctgcggacctgacccagaagcgagagctcacaggtactgcctccctctacccctgtgcctttgaatacccgactcctccctccttttctccctccctcccagctcctctctccttctcttttggcctccagatgctgagagcagggccctggccaaggagcggcagaagaaagacaatcacaacttaagtgagtcctgccccgcccctctccctgcctccctcttccttgttctcacctgggctggctaaaaagccactccctgacctgcactggtggaaggcttccctgctcaaggccaattcacttgcagatggcttaagccctcccattgctgtcgctcagtggtgcctgggactattagtgctgtctttccactaggcctctttaggagtgggtaggaaggattcctgtaagggatattcatgaaacccccagtttatcaggttgttttctgggttaaggcatggaacctggggcatcagagttctgtgtagcagggaagagtcctaccccaggcagctttgctgtgctacgagcatcaccatggctgattctacctttcagtgctcttaattgtgtctggcctttgccctggaccccctaattcctgtagaaatcccaatctgttggtcacctcttacttcctggaagaactaaatctaagctgcaggctgccctgaagcacccctccctgggctgggtacttctccccatggggtggggggtccccatccctctaattgctccttctggaatctgttacctttagttgaaaggagacgaaggttcaacatcaatgaccgcatcaaggagttgggaatgctgatccccaaggccaatgacctgtgagcaggtttctgagggggagggtgatgggtctgggtgggcagcagctgacaagtattatctgccctcagccccatgctagttactaggatgggaggagaattccttctagaagttcatctatttgagaaaagatctctccctctcccaaatcaggaaagaatcaggaaagctcaagacagatgagtttctgtcctggaagtgaggctgaggtcaagggaggcttcttggaggagcagtcatgctgagaaagttttcttaaggccattgggctggcagacaagaggccgggctcacgcctataatcccagcactgtgggaagctgaggcaggcagatcacttgaggtcatgagttcaagaccagcctggccaacatggcgaaaccccatctctactaaaaatacaaaacttagctgggcacagtggtgtgtgcctacagtgccagctactagggaggctgagacaggagaattgattgaactcaggaggtggaggtagcagtgagccgagatctcgctactgcactgcattccagcctgggcaacagaacgagactccatctcaaaaaaaaaaaaaaaaaaaagaaaggtaggctgggctggagtcttggtagtctgggaaggaggctgctctgaattgcctggtttcatgagattaatgaagtgggcagtggcaacagaagtcaccaggagggcccattctgtgcaaactgagatcagccacctccacctccaggtctggggttgctgggtaagactgggacaggccacataagctctgcaaccagagcagtagcaaggatttggccactcttctgagcatgcacctctaatttgcctggcctgctgctgcagggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggtctggtcctgaacttggacttctttggtaactctgacccttaacctggctcctggccctaaggggcagtacttgtacttctgaagttggagacacaggaataatgcccattaggaaggaggatgtatcagttaggatgttttgctttggtaacaaacaatcctcagcatctttaagcaacacatatcagctggaggttctgttctgtgagaccctcattctggcacccacgctgctggcacccagctctctgatggcacatctagagctggctcttaaagccattgtcactcttaaggtgccacatgtcacttctgttcaatgggcttggccaatgcaagcacactctacaagtactctaacctcaag

SEQ ID NO: 120793 - DNA, 1029 bp, Homo sapiens
tctcctctaaaatggatgcggtcccagtcattctggcctccccctgccagcccctgtgctttgaggaggacacgtgcctcatatacctgctgccccttctcatccacagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtagggcctgttctggcctgccccccaccctgtccccactagtcccagcctcccctagagcccttgccttttccccctcccaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggaggtgagtgaggagctggccagtggccatgctgcttgcagagctcgtgcccactgctgtgcttctgagactcccagtctaatggcagaggcaggggtgccttcagggagactcagtctgaggtggggacagagcccttctcagggagccccaatctcaggggggaagacacagccctgccctcagggagcctcacagaggaaacgccatccttactttcaaaagctctgctaggaagtcaggtgccgtggctcacgcctgtaatcccagcactttggaaggctgaggcagccagatcacttgaggtcaggagtttgagaacagcctggccaacatagtgaaaccctatc

SEQ ID NO: 120794 - DNA, 1011 bp, Homo sapiens
ggcagtgggggtacaaagacagggataaccctctgtagcagcataggaagggggtgggcaaaggcatgggtggaggctgcagctgtgttcctgctgcaggatgggaagggagtggtgggcatctgctcctttctttctggggactgccccgttggtagctgggtggagagacccaaggagctgagacagcccctttactgattcatggtgtagaggggcagagaaggaaggagggtggggtgagggccactgcctgccttcctaccttgtcgggaaggcacagtggtggtgggaggagccctggctggcagtcaggtggcatgggctccattcctgggcctggcagccaggcagcctgcaataagcttcctccctgctctgtgtggagaccctctcctccccagcatgggctcagaggccatgctgcctggggctgggttccagctctgtccctttcactgctgaaagacacttaatctcctgtgcttctgtttctccttatctataaaaggagagtaatatgcagaactacttcatagggctcttccaggtgaaggagtctggaacattgcctgacatacagtaaatgctcaaataaattcaagttattattatttctattatctggtgattttcactgaatatttgccagttctttttgctaatgctgactaagtccagtgtctggtattagccagaacatgtcagcctttgctgcttccctttgctatcccctgaggtctgggcctcattgttaggagcttgagacacagctctggcttctggtccacactgatcagttcgcctgccagtcatgtgcccatccatgtctcatgcactcagcctcccaggtgctacatactgtgcaagacctattaatttcatatagtgctccaatcttctgaagcagagaccgtttactaatgagaaattgactctcagagaggttaagtgacttgcccaaggtcacacagcaaagaagtggcagaactaggattcaagcccatattt

SEQ ID NO: 120795 - DNA, 1092 bp, Homo sapiens
tctgatgccccctccccaggccctacagtgactcatgaccacctccgtaatgtggaatggctttgtccatgaggattatgtgatgtccttgttctgtttcctagttcatcaggacttcctctgctgcctcctctgccagagggggctgagaaaaatcccaagtttggtatttttttctctcttcccttccctaggctgaaaggttcctaggaggccacaaagcccttcctttgcctccaggaatctcgaacctgttcaggaagcttttgtttagcggtcagtttctttccccaggactgaccgggcagctcccccacgactgagagtgtaacagactgaatcagaagaaaacttcttccgaccacagaggtgcagagcgtcatcaatggcttaaacaggcctcccagcctctgggcttgcacactttgttgtttcagccgccagacatatgtttttctgggaatacaggaaattatctctgctctttgaggaagggtagaatttttttttctgcctgtgtttggggattccagactgttccatcatcccggacaccctctggctcctgggctggatgaacgagatcagccgctgaaactctttgatcgcagggaggcttcttcagtgagaatttctaaaacaaaacgtggccgccctcaccctgaatgcaggactgaggccaaactcccagccccagggttggggcggtgcagccagactgccagggtccagccttgccactcattagctctgtgaccttcagcaagtgaccacctctctgggcctgtgtttcctcattccttgaatggggacaataatggtacccacgtcactcatatcatgaaataattatgataattacataaggtgctttgaacagtacctagcacacagtaagcattctatgagcattagctgttagcataaaatatttttttttcaattagaaagatatacatcttcattctagagaaagaataacattccaaaaggcttttaaaaccacacaaaatacttatggttacatcatccaaagaagtcagtaataattttgtatatttcctcccaagaggtttttctatacatattttt

SEQ ID NO: 120796 - DNA, 1020 bp, Homo sapiens
ttcaccgtgttagccaggatggtctccatctcttgaccttgtgatccgcccgcctcagcctcccaaagtgctgggattacaggcgtgagccaccgcgcccagcctcttttgtttcttgatctttattcatcacaaataggggttggtcagtcctcagtaagtgtccccacttggcagagcggttccatttcatgaaatatactgaagaccacatcctgcatgacagcctttgtgtgctgttggagaccatagcactcagccatggtgatgcaggacagggtcccggagggaacctgccagggtgatggtgacattctccatcttgatctaaacagtgattatacaaggccacacacctgtaaaaattcattgagctgtacactacaaatctatgcattttgctaggataagttacacttcactaaaagggaaaaagaccaaaacatggcattaaaactgttaaaagcatgtgcgtgtcccattgacctcatttctgcttctgatatcaaggacctttcaatcaaacagtgcacacttaccaggtgtcctgggtttgctatgtttctgtatcggaagttgccagctaatataataaaaggctatattatgaagtatctccagtgtgccaggaactgtggtaaacactccgactacttatcccttagaacccaaaggagtggacattgttattgctcacctgcctctctcatctcctgcagtgaatgacatgatatacaagctctggaaaagaaaatcttaaaagacccaaggcttttggagaggaaacagagggctcctggtaataggaaaagctggcctgaggccttcctgcccctatctagtaaggagagactgaagctggggttaccactaggctgctctgccccagtctgggctttcagatggtgtgtatgtgtgtatgtgtgaatgaatgggtgaatggatgggacactttccccaaaggaacttatgcagggatgcccccagtgggcctggacggagcaacactgaacagtgacc

SEQ ID NO: 120797 - DNA, 1156 bp, Homo sapiens
cccacttcactgtgctcttgcagtgtgacttctgacaagctgcttaatctttcttttttttttttttttgagacggagccttgctctgtcgcccaggctggagtgcagtggtgcgatctcagctcattacaacctctgcctcctgagttcaagccattctcctgcctcagcctcccaagtagctgggactacaggcatgtgccaccgcgcctggctaatttttgtatttttagtagagacagggtttcaccatgttggccaggctggtctcgaactcctgacctcaagtgatccacctgcctcagcctcccaaagtgctgggattacaggcatgagccactgcgcctggcctacttaacctttctgagtctcggtttcctatcctgctgtgttgctgtttatcccatcaagtgtttgtgtggatgaatgtgattgaacagaggccccttgcgcagtgcaatgtgggagggactcggagcgtttgccaagtgggtgataactgagtgtgtgggggtcactggaccagcagcccttgagggccgtgcatctctttctggaaagtctgatgggtgggatggtgtggaggttctgaagaagaaaagtgatttctctgaaacttccttgtagctgaggagactggtaggtggcaaggaaacaactagagaacaaagcatggcagacacaggcaggaggctggagtagatggagtgcccaggaggcgggtgcaggggcacaaggggtgggggttcagtcccaccactccccaacccaggagaaaggtggctgcctgctaaggggatccttagactgcaagcggcagctgagggatgcggctacacgtgtgtgcacatggacatgtgtgcatgtgtgcgtgcatgtgtgtgagagagaagagagaaagagaagcagacacggagagacagagcgtccacatgggtggctgggccggtccgtgcatatcacaggggtggaatccttttctagtttctcctttcatgttcctattagctacatgtccctcgtccctgtcctgccatgcccagtggcagtcgtctttgccagggcccagctggtcccagtgggacaggacagggcgactccctggtctgcaatggcctttgaagctgctccccctgttgtcccgggccaacagtct

SEQ ID NO: 120798 - DNA, 1785 bp, Homo sapiens
gttcctttcatacctgggtgtgggcggggggagatgggggcaggttgggggacagctcactcactccatccggtgggtgggtgacttggtgggctgttggaatgttgccataggaggccatttctcctctatggggggagatggtggcttccaggtcaggtctcctcctctggctccctgacagagatggggtgggaatgccagccggagcgcacatggacagggcaggagcaaagctgaattctgggtctagggcagctgacagcatttgggaatcctggggtgggcccctgttagctcttcccagaaccccaactcttgggcaggatgggggtgggggggtgtaagggtggttgggggtgggtgtaggtgtgtgttgtgaggggagaagagcccccgctgagttcctgggccactgcctgtgctgtctagtggcctctgccagcactggctgccccgtcctgcccccaccaggcgtgactcagatcgaaagcagaagctgccagacactgcacagggtgaagtgaggcagaaccaactctgctattttggaacctggttaattcccccttctgccccccacctccctgctctcagggctcccatcccctccagctgtctggcacttcagcttcctcaaggggacagttggggcaggccttggtttcccctggcatggacgtggaaggccatgctgaggcccctgtccttgctaggcccctctccctggccagaggtgctggattctggggacctgcgctctggggttggggaggaagagcgccctctcctggtgggaactcgtgggcagggcggccctggcgagatgacggtcaccaggcctggcacccactctcccccgcccatctttggccgctctcaggccagctgtcagctgcctctcccaggggtgtgagctgacgagagcttcaggtgggagcctctcccggcagtgaatctgagggttgggagggatttccggacccagagggaagatattttggggccgagggcctttccagaacccatgaaatcacacaccctgctgcgaccagactgaccctccctagttgatggttcttttttggacatcctaggcctgcttgggattctggccccatgatttagggtttctttggagcccatctgagcctggggggccctgtggtggtggaagaggtccagcctgcggtggtgaaagaggtcagtggatgtgtgtttctgagctgaaaatgggtgtggagttgagagctgtcacctcttcatggacagggtggatgagggtccctggcccttcagaagctgtgtcgttgggaagagggtggactttacagctgtcccgtgtgagtgtacatgggagtgggcacaggccttgcggtatggctgcctctcagggaaccctgaagtcagagctccactctgctgattaccccccagcaacctggtgaggaggatggtggtatactgggggagaggggagtcagcaggcaggtgaccaattaaaatttgggtccttgccaacctcaggtgggcaggacgtaggtttctcattgttcagatggagctggggtttaggcaggtgggaggcagaggcagagccgtgtggaggagagagtgggctcctagacctgctgtgggagcctccacactcccaggcctcctgcggagcacacaggcccaggcacacactgtcccaaaggttgtctgctctcttctggagctgctctttgggcaggcaggcaagtcctggtgcagtgtgtgtgtactggtgagtgtgtatgtgtg

SEQ ID NO: 120799 - DNA, 1118 bp, Homo sapiens
aatagctgtgttattgaatgaacaggcatgccaaggttctggaatgctggagctctatagctctatcctaggagcagcctgggggcagaaggcaatgctgggcttctagtcctactggcatttgctaccagcaacctaatgttgccatcactacccccggtatggaggtttcttctccatgcaacttgcaactctggcaagtcctgttttcttctctctaccatcccagctctccttctgagggcagtcttaaccttccgccaagtggggaagttccaagtacacatttggccattgcatccagcttgaccagtctccccagtgactggtcttcccctagctcacacctgcctctctccttccctgtagggtgggctagcttgcattactctgacccttttattggcccctatttctaagctttagagttagctattcagtatcaggtcataactgcctcctcagggcccattgggtgaggcaaggatatgagtgcaaacagtttatttgggaggctcccccagggagcaccagtggtagagtaggattcatgagacaggaaggcaaggaagctgataaaatgtgtgtgaaggagcaaggtgactgtgggcatctgaggctcactgccattggaggcctctgcagaatatgctttagagttccccagtcaagtgataggtgtctttggctaagaggtggtggggaagggagggagctaacttcattggttcaggcaccaattcaggtgctggcacctggaaatcttcaggtgggcacttttgacatcgtgagggcccagagcatgtggctggggccctgatagcttttgccacctcatcaagcccagccctgggggtctgccaagccctcttcccacatctccctttctatgtccaagaggcttccccaggcagacccttccccagtcgccagttccacgctcactgtgtttcacagatacttagggagcatctacaaggtgccatggacaaaaagaggaagctgtcaggatgcctccaggcactcacagcagaggaaggtgacctgtgcggctgaggcgcctgccatgtggcagacactggctcgcccatcccaggccttgtgcaaggccagcaatg

SEQ ID NO: 120800 - DNA, 2101 bp, Homo sapiens
cacttccccaatgtgagttacagtttgttcatctggaaaacaaacacgatgggctcaggttccgaaggccctttggttctcaccgtctcttttctcagggcatgggagtgatttctcagagtaggggtggtagaagcacatgcatacacacacgcacacacacagacacgcacgcacatgcacgcacatgcatgcacatgcacacacacgcacacatgcacacgcatgcacatgcacacacacgcacacatgcacacgcacacacacacacacgtgcacacacacacgcacacacaggactcagtgcagtggtcttggctgggaaaggtccttgccctctgaccaggaaggagccctcggagctgaggtgctcccagactcagcactgtttggggcctacaggatgtggtgtggcccactctagctcaggctggggggttcctgtgggtgtcaggggatgggtggccatccaactgtgtccactgggctgggctgccacagtgactttgtgtatgaccttcagggagtgtgggtggcatgcatcaggacgcctatctgtgtcgttatgactgggcgtgagggagggtgccacatgtctagccagccagggagcagggccagttagctcctgttcctgggtgcctcctggctctggggagaatagaaaatgattcatgcaaaggggccctccctgttttggccacagcctgaggagtaaggtggcctggctgtctgcctttccctgctgcccaccaggtgcctgagttctcccctccttcctcgcctcagaccgcgtttctccctgggggtaggtggctgcccttccctgcagcctgacaccctctcagagacaattagaggagtaggctgcccatgcctacagctataagagtgagtcagcgtagggaccggaggggatcaagtctctctgaatcctgcggccagacggtccctgcaccagaagaagtggcccagtgaggcctgggctgggatgctgtggtcagcactgataccagctgagtggctttccagcttgagaagacctgccagggacaggagaggacaagctccacctgcccaccacccgcctcgccatcctggctgcagccagctggtgactcattctcctggggagtgagccagctcctctcctggggtaccccagcaccctggtgcaggctgggtggccaggagtcctgggtgcctcagaaaacctgtgctgagcccagggccctggtaagctggggagggaggactgaggccctctgtatggggtgggggtcgcagccagacttctcttgctccttctcctggcccccgcagacttcaccctccctctggccaaagaggaggctgcaaccccagattacgtaataggtccaaaatgcctcgcaagcgagcagcccagccagtggctagactcaggagtccccatttcccagtacctgccaccagagcaagttcccattcccttcctaggccgggtgggggagtgggtggtgcttgctcacccctggaaagagctgtgctgcctgggagggggtggggaggctttctccagagacatgaattcttggcctgaccccagatgccagcctgcctgcccagctccactccagagtaacgctgggtgcacacacagccccattgtgtgcctgggccccgtgcctgcccagggcctggcaccggctctatcaacagcagtggctccgtcagctcctcagcagcccctgccagtgcttgagcccttgggcccctggtgaggaggaagagggaggactagtgattaagggtatgagtcctgggtggggtaccaggaccttttggatactatcaactatgagagacaagagcagggagacttagtcctgttctccgaggaggaaactgaggccctgagaggcttcagtaacttgcccaaggcctcatggctagtgagaagcagagccggggttggagcccagagctgtggctgagccccttactggtctcgtcacccaatcccagaccaggactcaggaaaaggcacggtgccctctttccacagccccactttggggagcctctttctcgaaaatatatgtccccagggtagaagagg

SEQ ID NO: 120801 - DNA, 1002 bp, Homo sapiens
ttcctagtttcctgctgggagttggtgttagagtggggaaacaactcaagtgacttggtgcctcagtacagctctgcctggagcagggagttcccaccagcttctgcccagtcctttgatgcccccacccttcatggagggtggccggtcacctggcttgtgatgtagggtgcacgcgggcatgccgatgcctccatcaacacagcagttaggttcgaaatgctccaggtcctctgctagctgtgggggactctgagtgatgggccagggggtaggccaggctgggttgtgaggtgggaggaggtggtggctccctgtcagagagtgtcctctcctggagggctgtttgcccaagttattcttagcacagactcattatagagtctatttttagccctgtttctaagtgttgccaacatctggtgcagccagcactaaagggggtgggggtggcaggggctactcctttggacatttctggggactggagcctctggcaggagagcaaggacagaatcttctacttcctgcacctgccacagcttgaagcttggcatgcagtaggtgtcctattcatgcttgtgcgttgattgctctcccaggatctcatccttccagctctagctcctgtgagtgggtgggtggtggggatggtgttaccacagctggagaggatgagctgaaggtgctcatcagataggtttcccacatccacccctcaggggtccagttggcctcagacccctgcagagaggcctcagaggagggaggcaagccccaaactatggtgcttgtgacagctaccgctgaaggaggagccagcagacattatagggagggggtgtaccactggggtgagactgcctggggttgaatcctagctcggctctttcctagctgtgtaaacttgggcaactcatcaacctctgtatgcctcagtttcctcctctgtgagatggagatgggagtgtagtgttgtgaggattaagtaagataatactg

SEQ ID NO: 120802 - DNA, 1270 bp, Homo sapiens
aaatgcacaggacagcccctgtaactaattacctggccctgagtgtctggtgttgaggttgagaaactctgatctaggaaaagagccaggaaacagatttgccataaacttgctgcatggcctcgaggaagtcacttaagtgatttgagcctcagcctccttggaatctgaaaaacggatagcaagcgttgctgcccttccccttcatggggctcttgtcaggatgggggagatggtgaatgtgcaggcattttgggggaggcgtccctgcaaaggggccttgtggctgttgcgttccagtagagccaggccttttcagcactggcccttcttccttgactgtgttccctgtccaccaagctggaggcatcaggtgaccgctgtgaacctcagtcctggttcgtgctgctgcaggggctgtgaggcgcttcccccacagtccctgcgggccccagccttttgatgagggctgcagaaatgaggggttctctgggagccttggggcccaggacaaaaacatttccaactttgtccttagctggatgggagtccaaggttgtgggggtgataagaggtatttatcatgttccttatctgaggccccattgcaggtctcgggcggcaaggggcgggagccagaggtcctccctgggggctctgcacacccaggcctggctcctactcatcctttgtgtccttccagaatttgccagcccagggaggcccagggttggaccagagtctgggtccatcctccctgggcctctctggcctcactgttctgggcttccctcacattgctggcatctcctgccttctccaggagccacggcctgcctcatctcctctctgctgcccgcttccttcctgaaacctgcactcacgaaagggcccagtaaactcatccaccctgagacgcagacgaccgataatagcttaacctttcttaatacagggtatttgcttatcaacgatgggaatcccttggccaccagaaagaagcactaagtgaaatctctgcccagtctctttggcaggctgctaaaaaagtgctggggggctgaggaaccactgaacttgcatgtgtatcaagaacagtttctgcacaagtgaaaagtgtgcggtggtgtggatcttcccggagctgcccagggctctgcttgatctcaggctccatttcaaggtgggctgtagtacggcctcgacctgggtgtctggaggccctgggaaggcccaaggccaagactgcaggtgtatggccagtcaggaa

SEQ ID NO: 120803 - DNA, 1103 bp, Homo sapiens
ctgtttatgactgtaattgcatcattagccagagttaatagagttacttagcacctgcccccacagggagtagcccagccaccccctgggttctgtctcttccttttcaaagtcaactcggtttctgcaggcaacaggggtttccccaaccacagctgtcatgaaaaccaggttgggcctttgtcctggggatggagggcagtcagcacttggggcctggcttggggctgccctggagatgaccatggaaattgggttggcctcctctgatcggagggtgggagttcagggttcccagagctgccagaaatgttcacgtcccaggacgcagtgaacatatatgcatgtacagtgtggatcctcatctgagaggagggagatgaaaacacacccacctcacaggctgttgtgaggactaagggtgcggcagtgcctggtacatggtgagtacatgatgttgctttctgggttggtgtggggtttatgtaatggttgtgagtttgtgtgtgtggttaaagtgtctaggaatgtgggtagagatgaactgtgcatgtgtgtctatgagagtgtaacaataaaacaagattatattaatagaatattcatctcttcttttatgctatactagaacaatattataataagattgattatacaatagttgccaacatttattgtgtgtttagagtgaggtgggaattactgtttgcattacacttacttactcagagaggttaagcaagtcacttaaaatcacacagcctggaagtgacaggattggaattttaacctaggtccaattgactccaaagtctgtgttctcagtccctaaagaagaccacttcttcaaggggtttcccaggagttctctcttaaaaggtgggggtgtggtggtctggggaccttcttttctctatccagggtttcctgctctaagcagatctttgggaggcctaggtgggaggatcactggagctcaggagttcgagaccagcctgggcaacatagcgagacctggactcaattgaaaaaagaatttgtatgaaaaaaataaaaataaaaaagcagggtgggaacttgctgaggcccctgtctgagcacca

SEQ ID NO: 120804 - DNA, 1050 bp, Homo sapiens
ctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggtaaccgagcccgaggaacttggtccttttctggcccttaaatccgtatttcccctttcttgcgaggctggcgcctcagggttttttgtttttgttttttaacattaccagcattgtggcgtcttcgtagctctggctgtgcctcactgagatccctggccaggagagttcccgtgtggcaaaagcgatctttctgtcatgtggctgtatctgtaatgtcaccctgatcaagggaagaagtgctagcacgtaaacaggctttttcggccctggactagtgctttagctgggctttgcgtttgatcttacatttcttttttgttttttttttttttttgagacggagtctcactctgttgcccaggctggagtgcagtggcgcgatctcggctcactgcaagctccgcctcccgggttcacgc

SEQ ID NO: 120805 - DNA, 1124 bp, Homo sapiens
gggttaataaaacacattgtttttccaggaacttgatactaaatttgggactctttgctgcgggagtttggctggccaggaacttgagtgacattgacctcatggcacctcagccaggggtgtagccaagtaggtaagcactgaactacacccatgcgtgtcttaggagacctagagactgggtgaagcaatgttttctgtcaagtattcatgaaatgtacaaaagaatgtgatgtaaaacccttaactattcctagttaaatgtgttttcagatgttgaaagggatttaagtatctcttaccagtttccctcccatacttttacagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcag

SEQ ID NO: 120806 - DNA, 1026 bp, Homo sapiens
agaaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataa

SEQ ID NO: 120807 - DNA, 2270 bp, Homo sapiens
aagggtttaaaacaaacttccttttttggggatagcagctgaagagtggagtgagatgcatggaacaaatttccccatgcaaagtgggatggttttcatatgtcataccctccctacttgctgctgtcatataatcattccatacttctgagactggcatgaataccccttcattctaaagaaggggcaggtcatataaagaagcaatagactagcacatgttccatgctgagccaaaggacactcctggctatctcagttctgtagcagatccctggttcaggtctagggcaagcacatggtttggtttaaattgattcttaggttttctcagaactcaattgagggtgggcagagatagctgatgctccagggcttattgaaggcctgtcacccgttctcacttcagtgcggcatgcagcttcttagcctgcagcttctttcttgctcctggagagctagaacattcatgttcacagggtttgggagcttttggttctctagggtatgttaactgcttaggagtccacctcgtacatatctgaagagttgattaccaatggccttgacctgtttcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttacagacacctcaggtacccagaggcggcagcactggacacttaggacgttagtatttaaggagatttttattaaagaagagttccctgctgcataagccaatggctattgtgagggaaatgtccctttgcctttaatttatttacgtactgggtatagatgaatgtctcagttgcatctgaaattgaatcattctaaagagaagaaaataagaaccaggtaaaaactgactagatgctgccaaatcaaacccaaggtctcctaaccgaaccttaatgggcctgcttctctcccagggcaagtagttaagagtctcattccaggaaccctttgtagttagttggctggcatgtttacttgctgctgtagccagccaagatgagtgcacctaggccctcaaaaaggatttttttttacctcaatctagcctgaccc

SEQ ID NO: 120808 - DNA, 1092 bp, Homo sapiens
tgcttgagctcaggagtttgagaccagcctcggcaacatggttaaaaccctgtctctacaaaaaatgcaaaaattagccaggcatggtggtgtgcacctatagtcccacctactcgggaggctgaggtggggggatcacctgagctcgggaaggttgaagctgcagtgagcctttatcaatcacaccactgcactgcagcctgggcaacagagtgagaccctgtctgaaaataaataaataaataaataaataaataaataaataagtgtgaacattgattaccaccattttattgatgggaaaaccaaaaccagaaggttaaattttctcagtttcctgttttattaatacctacctctacctacgattatatatgccagtttttactagtaacaagcttatatccatgttctaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaa

SEQ ID NO: 120809 - DNA, 1010 bp, Homo sapiens
tgtgggaaacctgttccgctctttgaagaatcagaacaaaaatcaaaagtcaggcttgaggccaggtgtagtggctcatacctgtaatcccaacactttgggaggccaaggcaggaggattgcctgaagccaggagtttgagaccagcctggtggcatagcaagacctcttttagggaaaataaaaacaaaaacaaaaaccacaaagttatgctcgatatcattttgccatttcaaaacaaaatttgaaattttatacctggttaactatagactcacctatcctgttccattttgagatacagagtcaggtgaatcaaattgtttcattagagtaatatttaaaaaaaaaaaaacagtgattcctgaagccttttacttgtaaggaacaaaagaatattaacagctttaactccatcatttttggatatgatagattaggcaagaaataacttttgtttatctttacaagaaaggattgttctttggttgtcagatatgccaatttatcaggatttctctaggcaagtacaaataatggcagagaaggaaacctatggtgaggggatgagatgcattgatctgttgcctgtgaagtttcaaaactgtcagtcttctacctgtcttcctggccagcttaatgaaatggagacagaactgatcaatctcagttgaatcagtaatttctttttctttgtgaatttcattttagggaaacaaagcctgactctatattgtcttcatcttagctcacatactccctctgctgaaggtggcagtcactgccaggattcctagccagagctgcagtaattttcaaaaaaatggtgaataggaatataaaataaggccaagcccctctgtgaattccatttctgttcatgcccccacgtattgtgacgactacaccctggtaaaagcttctcctatggcacactcattctgatgcagtctattatgagaagttacacctccacatcctattgtcacagaaagctctgtgatacatca

SEQ ID NO: 120810 - DNA, 1083 bp, Homo sapiens
tagttctgttaagtttctgtgtgaatggtaggtatagtgatgatacatattttgataagttaattgtagctaaattaggtggtttgatgagactgttgtcctgtcttcaaacaggctattctttatttacccttggctataggctgtctgtgatcactaacttaaaaataataaacattcaatggtaggctgtcttgagggaaaaaagacaaaaataattttaaaatttactgagaaatcaggctcacacaacaccttgttcataaactaaaggttattattctaaaggttagtttagaataattacttttctagttatttgtatctcttaaaaacttaataaattacatatatactttgttttattattgaatatttgctaaggatatacctcactgatataataatttcatgggtatgtacagtgttcagcacatttaccacaggcaacataggagagatgctggaaaaaattatgaggtcagtgagacttatttttcgtgttctcatatctttttttttttttcttttaagtgacctctcttgttggtgtccattacaaccttaaggctcggaacttccttctgtgggatctcaggcaatgattcatgcttttcccttcctcttcagtttctttctgtcaacatttacttaggcagtatcatacgcctgagctctgctttccatctcctgctacagtaaattaacctgcacttagttattggtagttgattggcttagggtgtttcccttaaaatatttgcctttaatagggactttgatgtcttaattcaaatggtgagacttactggcacaccaggaggttgatattttaaaacagggcagaggtagctaagatttgtgggacttaaactgtagtaagttcattgcctggatatgcactggcgctctttttgtggtcagcctgtttgattcttgtacaagttagggcccagtcctctcacctcttgtgcctgctcactatagttgagttcccagaagtacgtctgctttattcttgtacaagagatgagggttcatgcacagtccacgtctttgaaatgccttctatgccttatttga

SEQ ID NO: 120811 - DNA, 1156 bp, Homo sapiens
gactatattctacttggagaaatcttaaataaatggggagtaacctacctctgaaaatgccagctagctagcttcttactcagagccctcccaggtggcattaccttggtgaagtcataactagggtctagaccttatctctaaaggttctcagcctcaagtttgtgagaataacgtatgatgcccagtttcttgggaactgacttatatgatcaacatcattggagtgaagattcattttcagtgagaaatagaactgttaagccaactagtatttgagtttggttgttattacattctctccctgtagccgaggtatgtggaaaatcaattttggttttctgtgcaaggaatcagtgcagagggagtctgctggatggttttagtgactgttggtatcaggcccttatatgatatcaacaggcttgagtagttgtattttttagttgggggacttgctgtctttagctgaaggaagaacactgcctaaccattggtcagaggatgctcgcctcttactgctgaccttcaatttgtggtcaggcagtcctccacagtcctccacaggaggctggcagtcctccacagtcatattctctttggctctgtgaggttgtatctgtcactttgattgggtttggggggccccagaactctgcagtcactcaaacctcagggttttagtatttttagcagatggattattgtgtccactgtatttttttttttctaacttcaacctcagaagataaaaccttaattgctgttttggagacattttatatcattgtcatgtgacaattccttatttcttgaacctgctcaatgacatcatcacctcaacagtcctgctcccaccttcccattaaggagcaaatcatgtctggaacaattctatggcatattttctttgtcagcagacttatatatgttggcttcttagaattagtaatgcattaaatggtcccttagagatctattgtttggtctcttggaatgcgtaatatgtattattttgtattttgcttctgccagtattagataggatgtttcttattcatagttccttcaaagcagtttagttcttttttttctttctttcttttgagatggggtctcacttgctctgtcacccaggctggagtgcagttgcgcg

SEQ ID NO: 120812 - DNA, 1053 bp, Homo sapiens
tactcttacatcagttttaaggacttgtagggagtttaatgcattgtaatttactggtccttttttgaatttgtattacaattaatgaaattgcttttttcttgccatgtattagcccaatcttacagattgtttcccacttgtaggtaatagagaagaggaaacctaaccaatgactgtggaataatatggaagaagatggaaaaaacttgtttaatgggtaagaaataaaaactgtaataaaacattattaatgaaagctatttataataatagtattatgtgtggctgaggttggcatactatgagggtaattgatcagttactgttttgtctaactccattctgaactttcaccgcttgctttcatcttaaccttgtgaattttttagtaccacgaattaacttaagctaagaggggacacagccatatttgaagttaaaatgggacctaaagaccagcaaccatactgaaacaagtctagggtaggtcttgaaacttggtggtaagatagagatcgtatctgtcatgacctgtcaagagtaattatctaccccttctttttctccaaatatgtcagttgctatgatgtttgtcccaccacgaggatcccgttcatttgagcaagtgcagatgtgtgtctggtggtaatcaaatagaattctgctttgggaggttgaggtgggaggatggcttgaggcccggaattcttttatttatttatttagttttgagatggagtcttgctctgttgcccaggctggagtgcagtggtgtgatcgtggctcactgcaacctctgcctcccgggtgcaagcaattctcttgcctcagcctcccaactagctggaactacaggcacccgccacgacacctggctaatttttgtatttttgtagaaacggggtttcattatgttggccaggctggtctcaaactcctgacctcaagtgatctgcccaccttgtgctgggatatgcctcccaaagtgctgggattacaggcgtgagccactgtgcctggctgagaccaggaattctagccagcctgggc

SEQ ID NO: 120813 - DNA, 1045 bp, Homo sapiens
tacaaattgtttggaaagcattctttctagtcatgtgttattgtttcggagacatgggctatttttaaagactataatactgtcccttttccattcacatgttaatagaagtctggaaagtaaggcattctcctgaaattttcagggttttttattatatgtcaaattgtaaacagcattctgtgacaagtattttctctctgtcttttattgagctaattagtgatttacactctagtagcatctcttccagctttactgtgtgaaaatgtctgctactccgtgccttctatgcagccagggctggcaaatgattgggggcagatgttggttagcacatcagaaggatcagggataaaatttatttttcttttgtggttttaaagatatgttttaaaggcttttgtctatgtctttgccccactccattattccctaccctcattcaaataggaatgttatgacctccgtaacctagagctactgttcttgattcagttttggattgttttctatcctgttccccacccccactgaaacgttgtgttgtgggatttggggaggattagcacggcagtctggcatagtttagagcccaggaagctggtcttcactgctccctcccatcatcagaatacagagctttcagtcattgcctttagaacccagcagtgcttcttttgctgggcaaattgtgtgaaagatgggagggcagcactgttgctagtgagttaggaggatacttttgtatgatgcttgtatctatccaagggaaggatgggctctactgttgtgttagctttttcaaaatgcagcagagaatggccaaaaggtaatttatagcttggctttagcattttgtcacattggtgtcctgctctttcctgcctcctgctctttctttcagtctctgacatgggaaagaagatgtgtaggatatgtcatatgctcacttggatggaccatgtgggtgcattaaaatagcaagaactttgactttgaaataaagtctttaaggatcaatttgttttgtagatatacattg

SEQ ID NO: 120814 - DNA, 1338 bp, Homo sapiens
cgggttgagaatgagatgaggaggattaaggggagaaagggttagaagccagggagaggaggagtgagaaaaagccagccaaggagataggaaggaggcaaaagccagggtgggcgttaaggaagccgggcagggaatgaggttagggctggggaaagggatcctggggttaggtgtaagagcaggggtttgaaggggaaatcttcgtagcgggtggtgttggggtgaggggtaccggggtaagtgttggaagtggaagacaaggaggggcagagctggggtaatagttgggagtaggaaagagagagtgattaagagccagacgtgacgagggtgtgaactagtgcggagcgagatgagctgaaggactgggaccaacggtgtggtgggaactgctggcgaggttctgagaaaggaatgggttagtgggtgggcgatggatgtaaattctgtaaagtgagggagggcaaatgagacctggactggaaccaggtggagtcaggaataagagtgtggtggaagggcgaaaggaaacagataagagatgggtgtctgtaggacgattctgggaccagaagagctgaaaggagactagagttagggtgtaagaagtgatggccatctgggacaaggataactgggtaattacgttaattgaagaggttcagcaagatccaaggtgaaaacagtgaggtaaagagacagggctaaaagcaaatggtgagaggagcaggaagagatgggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatggtgagtgaaaggggacctagagacaggggtaaagactaaaaagtaagggcagaggtggggggtgcaggaaaggaattctttgttgaggagagaactgtgtgttgaaactgtgaatccttttgtccctaaaagtaggaaattccagaaacctctttctctcaagaaatcttgaatctgcttccacccttcattgcttttgatttgactttcctgtccactttgaagaaatgagactcattttgatttgatttttttcttgtatggatgataaagtataaactctgggtgttgaaaacctctgcatttcactagtgttgtgataattcggggaaagggtgtgcttatttagggtgtactcgtgtgatgtga

SEQ ID NO: 120815 - DNA, 1093 bp, Homo sapiens
gaagcagaccttgtcttagccttcattcaccctcattctctgtgcttttggttcccaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactgg

SEQ ID NO: 120816 - DNA, 1013 bp, Homo sapiens
tgcctctcctgctatttccccctacctttctagaaaaggctgtcagtgagaggattcccctcacccccaaccaagaactgctgaggtagtgccagattgctgtctggcctcattccggggggagtcatttgactctactctggggtttgccagtgaaagtcttgatgatgaataggatctctgtcccttgcaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtaagaccttggtgaaaataggagcaggatgttctgagggggctgcttagcaaagggctctgaagattttccagttcttctctttttttttttttgagacagagtcttgttctgtcacccaggctggaatgcaatggcacaatcttggcacactgtagcctcgacctccagggctcaagtgatccttccgcctcagtctcccaagtacctgggactacacccaccgaattaaatttttttttttttttagtagaaatgaggtcttactatgttgcccaggctgatctcagactcctgggctcaattgatcctcccatctcagccccccaaagtgctggggttacaggtatgagccaacacacctggcctccagtcctcaatttaaacagatatttatgcctacctgatccctgactccaaggcatctatgcttcctcttcgtgaatcttttatcctttctttaattattcagagactctctaacacagctggcaagtaggaagcgggaagctgggttcaaagcaagcagaaagcttcattaggaagggtggcttgctggagaaggg

SEQ ID NO: 120817 - DNA, 1052 bp, Homo sapiens
actttgggaggtagaggtgagaggattgcttgagcctaggagtttgagaccagcctaggcaagatggtaagacctcatctttacaaaaaaaaaaaaaaaaaaaaaaggtgggcatggtggtcccagctacatgggacactgaggcagaaggattgcttgggctcaggaggttgaggcttcagtgagctgtgttcatgccactacactccagcctaggtgacagagcaacaccgtgtctcaaaaaaaaaaaaagaagaaaaggaaaatgttattgtccataacaactagaagtgccttcttcattaagcgcacacacacaccccttagttgacttttaagatatttccaaggcagtaacacttgtagactcatatagtatgaataaagtatgcaattacagtgagtagacagaacagaatgacgaggtcggctttggatggatttttttcttcagagtcgagaagtttggaactggatttagaatgaggtgacaggtgtgaattgtcagcaagcagtcaggaggagggatgtggcctggaggatctgtgcagagcctgctgtgttcacgcacagcagcctgtatagggaagccatatgacctctgctctcgccgccctcgcacccttttcagttgcacactcttacccccgtctagaatgtcttctttcctttgtgtggctggatcctaccttctcttcatattgcagttcaaatcctacttttttttcctgctgacttgttcattttaatcttttcctatcctgaagtctttcctttttccgaaagacttgtggtctttcctcggtaataacttgttttattttgtggtctttcaaaaagtttttagcctatctcagctgggcgtggcggctcatgcctggaatcccagccctttcggaggctgaggcgggcagatcacctgaggtcaggagttcaagaccagcctggccaacatggtgaaaccccgtctctactaaaaatacaaaaattagccaggtgtggtggctcacacctataatcccagctactcaggaggctgaggcaagagaatc

SEQ ID NO: 120818 - DNA, 1050 bp, Homo sapiens
gattctcctgcctgagcctcccacgtagttgggattacaggcgtccgctaccacgcccagctaatttttgtatttttagtagagacggggtttcaccatgttggccaggcttgtcttgaactcctgacttcgtgatccacccgccttgacctcccaaagtgctggtattacaggcatgagccaccacgcctggccaaaaaaattttttttaattaaaaataataataaagttgcagggattgggagacggtcagagtaggtaatttccaagataacttttggccctgatgagctgtgatgctgtgggcgagtgaatggctcagtgagcacacgtgtgtctctggataactgacgatttggtgctctcctttccagtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagtgagatgggtctgtaggatggctggaaccaggcttggagttaagagacatttgagttaattgaagtctttctgcttttctgctaaaggtggtattcttaaacatgtggcgagatgtgtttttgacgtcattaattcttggttctttatctcttagaatagggcctttgaaagctttattttattttattttatttttttgagatggagctttgctcttgttgcccaggctggagtgcaatggtgcgatctcagctcactgcaacctccacctcccaggttcaagtgattctcctgcctcagccttcccaggtagctgggattataggtatgcaccaccaagcccggctaattttgtatttttggtagatatggggtttctctgtgtgggtcaggctgatctcgaactcccgacctcaggtgatctgcccacctcggcctcccaaagtgctgggattacaggcgtgagccactgtgcccggccactttattttattttattttattttattttatt

SEQ ID NO: 120819 - DNA, 1012 bp, Homo sapiens
ttatttatttttttgagacagagttttgctgttgttgcccaggctggagtgcagtggcgcgatctcggctcacctcacctcaacctccacctcccgggttcaagcgattctcatgcctcagccttcccaagtagctgggattataggcatgcgccaccaagcccggctaattttgtatttttagtagagacggggcttctccctgttagtcaggctggtctcgaactcccaatctcatgatccacccgccttggtctcccaaaatggtgggattacaggcgtgagccaccacgcccagccaacttcatgtatttaaatggactggtggattgaaatctgaactctactgcctgaatttaaaggccctccagtctggcttcacctttcccacgtacctagcattatttcttgctattgcctaggagactcttatatccaagccttattttctctgcgtctggaacacactccttctgctcccaaactgcccatccagctcctaactgtcctcaccactcatcctttaagtgcatatgttgtctctactactcattgtggcatataatcaaacccgaatatgtgtagaatagtggtgaagaatgcagtctagacccagactacctgtcttgggcaaattacccaacttctcagtgcttcaatgtcctcatttgaaactgggtatagtaatagtatccacttcttgggtttattcttatttatttatttatttgccattgttccataagaaggtttattttattttttttaattttatatatattttttgagacggagtctcgctttgtcaccaggctggagtgcagtggcgtgaccttggctcactgcaacctccacctcctgggttcaagtgattctcctgcctcagccttccaaatagctgggactacaggcgcccaccaccacgcccagctaatttttgtatttttagtagagatggggtttcaccatgttgaccagggtggtttcgatctcttgacctcgtgatctgccc

SEQ ID NO: 120820 - DNA, 1522 bp, Homo sapiens
tccctgtagagatggtgactgaggtcaagggagtataatatgattgtgtaggtgagaaggtccctggggaataccatagtgtaagggccagcagaggggaagaaaaaaaggggaaagcatagagggagaagtaggatccttcttccaatgttttccctgcttactctaccccacctccctttcccactagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaagatggtcgtgtctcagcagtggatgaaaggactacaagagaaaactccttggggaaagcagagataagagtcaagaaaggccagagaggctgggcttggtggctcacgcctgtaatcccagcactttgggaggctgaggtaggtggattacctgagttcaggagttcgagaccagcctggccaacatggtgaaaccccttctctactaaaaatacaaaaattagctgggtgtggtggcgtgtgcttgtaatcccagctacttgggaggctgaggcaggagaatcgcttcaacctgggaggtggaggttgcggtgatccaggattggggccactacactccagcctgggccacggagcaagactgtctcaaaaaaaaaaaaaaaaggccagagaataaggctgggcccaagaatggttagatcagagctagcatca

SEQ ID NO: 120821 - DNA, 1071 bp, Homo sapiens
caagaagccaaagccagttttatttcacaatcatctttattacagtaggatgatggtcctgggccaccagcctaaaccttgcagccttaggaaagacctgtgtcaacagggcttgcctccctctctagacaggggctcagccacctccagggcatccctgctgcattttccctgctggaggatggggcagagggacaatgggagaggagggcatgaccccaccccaggctatagcagctccttggccacaaagatccttttgccagtagcagaagggaggaaaacagcaaccaccagggttaccaccacttgtgggatggccaggaccccattatgtcctcttaaagttgtgctcaaagcaattaataaattaaaatgagccttcagcagcaaagctgtcaatcacacaggagaagctgagcagaaagcaaagcaaagaggaatttatagcttctctggctgaggcctaggcccctccctctaggagcagctgtcagcacggactacataggggcctccaaagtactgagaggagccatctagactattccccctcatatgtgtctatcatgcattaaattttagagggaccccaatccaaatgcaataaccctagaagggacaacacctttagaaggcactagagcattttggcagttgaaaacatgagagcccccaggggtgggggggggcgttcaaaaggaatgctggtgtatgtatccaattctgtcccatcagcctggcccacccccagctagagttgggaaaggcgctgctggtcagatgcagggaggaggagcttgactagccaccgaaatgcagacatggctggccgggccccttagtgcacactgcggggatgggtaggaccagatcccttgggctttgtgaagggggaacagacgccccttcaggcttagatgtggtgtggttcctggaggcagggaggtgggtggcagcggcccctcctctgcttagtggccactccagagggcctctccagggctacaggtgtatggctgtgacatctgtaggagtgctggtctggctgggcccttggctgctggagcc

SEQ ID NO: 120822 - DNA, 4947 bp, Homo sapiens
ctgtgtctttcgcggggttctggcggggaaggcgatgggggtggcgcgcgccctgttccggccgacagggaaatgaaaagtgcaggaggcagcggcaggagcctcctcccttcccctcgggtgtgtgcagtggtggcggtgatgggggtgaggtcccagctctctggctaccatgggtgacccttgcgtcccacttcccctcgctgtgggggaggggagtctccgtttggaatcctccgtgagcaagggctccttggctttaccactcccccgtcaaggggagaggggaggaggccgcgcagaggaagtggggggcgtcaccttggggagggcgcatcctcctcctttattggtccttgtctctctaagtagcttaccctctctgccgtttttgctccctatcccacctcacttcagcgctcccacccccccgctgctgtgttccccacgctccagacccagcagtgactgtgcgccctcccccaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggtgcgtgtgtaactccccccacccccgacacgtattgtctccccactttccaggaaaaggaaagcttgagatatcagaggctttctgccccctggagaggaagcaaggggatcaggacctttgggaaaggaattggggtggaacaaacgatggggcattgtggtgtgatggttagtatcactcccgcccaggcttgagctgcaggcaggcattaaaccccctcctcctgacctccaggggatgccactccttcctggtctttcccccagatagcaacaagtcaaattgcatgtctacactcactagtactttgcctctgggtttacgcagccaccatgagttatttattggcagcagaagggcatgcctgcacacccccactggagtaggggagtggaatgtgcttcatgtgggggagggggttttgccttggttgagtctttatcctcatgtggactttgtgatagaaaagcctcccagagccaattaaagccaggccctgattgctttaaggaagggctgatgtatttcatcccaccttctttgcttcctcttatatcccggaagaaacagcttcttcctaatccttcctcgtcctcattctgaggaactggagcagctgctttgggcctggtggaaacagctccctcttccccccttagcccaaggcccaagctgagggacagacagggaggtgagctgcatctgcttccgatgtgataatggtgccccctcccctggcccgccctctctgaccaaggtctttcataaccctgtggggagctgctgtcactcctgtggtttgggaagtggctccctgggcctcttgctggaaacttgggctgggctcaggccgggcaggaaagtcaccggttctgtcccgcctcagaaggagcctggggaggaggcgggggagctgctggatctggaagaggttatttaggacatgcagattgtctcctagggaggctgggggagagggtgggtgagctggcaccttcctccaccttgctctgtggcgggccaagtcttctgctgaccctgagaggagtctctgggccccatctcccagggaggagggcagcaagcaggctgctgtgattggctggcagggaagccagggtactggggcccccgactgctgtgagtcgaggaacaggattcctcttcctgccaagtagctcagagatgggagtaggaggccagagttgggaatccaggaggcgccacagctctttgtgatgaatctggtagtttttggcaagtctgaaggtggagctagtttccagggccagagagcaagatgtttttggaggggttggggctggaaggtagaaggggaacttcctttttgtgaaaagatggaggtggtttgtgtgcccacgtatgagggtttttcagtacaggcaaaaagtactcttccctctgcctgagctgggggtggagtgcccaaaagacttcctagaaggtcaaggttggaagggacctctgagaactccagttggtccaaatccgtgtgcagcagaggaggctgaggcccaaggaaggagggcaaggtcctgcctcagcatcgcactgagcagatgagtgtagaacctgggtcttctagctagaccaggttgccttaaaagtcaggaatgtgatggccgctgccacctactgaagctaagcactcccaggggtgtgttctccaccagttaacactgggattctctggttgcctggatatggggaaaggtggccactttccctcaaacacaaccccttgcctccccatagggagagtcccactcccagttgccttccagatgcttccttagaagctgagtcccttctgtttactgctgagttaggagttggctcctgggacatgcactaggggtagcgttgtaatttatctgtctcacttctggctccaggccaggctattttctctggggctctgtgagggtaggggttgatttgagaggctgacacctaagctggggccaagagagagacagctgtggctggggcctggaagaggttgggtggggttgccatttctgcctcaataaggagtcaaacccacaagttccttcctgagataaaacaatgaagaaatcctcatgtgtgcaactcagaaatggggccaggtctgggaacccatgacgagtggactggggtggagctcccagccttctcccgagacctagtactggcaggtaggcttgggtaggtgaggatagggcttgatccctctggaatcatttggagccatcctgtctggcttggcctctacctatcctcctgaaagtcaagtggcatggggcactacgggttccagctaaagggggtggggtggggtgctatacctcaggacccatccctgatatcctaccaaggggatgtggcttgggttgggcaatctcccctttgaggaacctgagaaaaggctctgtggctgtcattggaggagtcatactcccttctgttgattcaagaagtgtggacttggctgggatgcagagttgcaggggaagctagtggtgatctcccctttcacaaatccttggggttgagagagtctttctgcttcatcccagaagagagcccagttcatggtgatgctgtggtatctgctgcttccgtctttcagccctggctggagaaatcctcagagccctgaatgaagtcaggagaaggcctggattattggccccttaaacataaccagacaggattaaaagggataatccatgtaaagcatgttgtcctggcacctagtaaatgatcagtaagtgctcaaagcacatgcctcctcctcttccctgccttgaactccatggtgcccggccttaaaatcagaaacagaactggggtcttgggctttaaaagtttgatgggcttccctgcctgagactttgagacttctgctttgctccctcctcttcacttctccagccactgaccccaccctttccccgctttttcaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacaggtaagagccctatgcacatttttgccaaattggaaaaatcagaagacttataagggtgagaggtaactgaagattctggtttatactgtcaaaattcctttgtgaaaattataccccctctgagcccccagtctcaatgcagaaaagcaggttataatcagctatatgggatctcagacccctccagtttgtagtggggacactgagggtatagagagaagtgacttgcccaaggtctcacagtgaacaggttgggaacagaaccccagtctcttggccctagttgtgttcccatactagggagtgtcttgtctattcccgggacctatggaaactggcagttggttctgatctctaggaaagatactctttcctgtcttcctcccttgctgatatcttgccccacccactgctggagttttccagcatgtcctctgctctactcatgctgcctggcactttccaaggagtcggaagtccatgctggccgttatccttcaggtttccttctctcatggttccctttcctcctctccaagattatacctttgccatgtacccgccatccatgatcgccacgggcagcattggggctgcagtgcaaggcctgggtgcctgctccatgtccggggatgagctcacagagctgctggcagggatcactggcactgaagtggtgagtgctgggtagctgggcagcagcctctccattcataaagtagtgctatgccctgagcctccagtagagggaaacctccaaccccaacctggtcccaagtcctggtttcacaaccttggggctttgtggctttttatctcctgccttggtctggggaagagcaagtatcttgggtggggtgaagggcactggccctaggggttcttttcttgccaagtggtgtgctggagtgggggtggggggtttggtgtcagatgcagggctgctctcacactcccttgccacatcctcttgctagtttctgagaactaaagagcgattcctggggccgggctgtggcctaacctccccagacttccccatgtgttgggagctgtccttcccctgcacctgctgccagatgctatggggggagtgtttgctcctcactc

SEQ ID NO: 120823 - DNA, 1076 bp, Homo sapiens
tttggggagcaaaagaagcacatgtgcattcctgaagtctttgaaagactgcttgggcagccaggcgcagtggctcatgcctgtaatcccaacactttgcgaggccgaggcaggtggatcacctgaggtcaggagttcaagaccagcctggtcaacatggtgaaaccctgtctctactaaaaatataaaaattagccagggtggtggcacgcacctgtaatcccagctactggggaggctgaggcagaagaatcgcttgaacctgggaggcggaggttgcagtgagccgatatcgtgccactacactccagcctgggcgacaagagtgaaactccaactcaaaagaaaaaaagaaagactgcttgggcagttgtggggagcacaggttagagatggtaactggtggaagagaggctattgcaggagtccaagtattagatgggagcacctgagcactgagtggaaggaccagattccagagacattttggaagtattgatgacaggtcctgcttacaggttgatgtggaaactgtaggagcaggaggagctgagaaagaatgatgtcagcattttcagcttgggtgactcagcagatcactgtgaactgacacacaatacacaagagaagggacagggacaggatttgagcatcttgagtttgaggtaccgggtgtgacatccaggtggggatgtgggctgggagtttggggtggagggtagagctggagcaatgtcaaagctgaggctgaaggaatagaggaggtgtatgagcagacagggacttggcttatctagagggaggcaatgaaggagctgtggaggagcagttcggaaggctaacgtaagcgaggactgttagttgttgttgtttttgttgttgttgttttttgagacagagtctcactctgtcacccaggctggagtgcagtggcgctatctcggctcactgcaacctctgcctcctggcttcaagcgattctcccatctcagcctcacgagtagctgggattacaggcgcctgccaccatgcccagctaatttttgtatttttagtagagataaggtttcaccatg

SEQ ID NO: 120824 - DNA, 1127 bp, Homo sapiens
tggaaaaagttaaaatttccagcctttgccttctacctacacaaccttttaataaactgttttttgtatgtcaatatatagatttcttaaatgcctatgtcacattccacccatattttactcaggtcatcacactatttccatagacacttctgttttgggctaggtccatgagacacaatgcctgccttctgaagctcacaggctgattgggaccccacaacctgaccagtttccacttagtgcaatacatggcagtagtggatcttgtgctggatgcaatggaagcttgcagggtgtggggtggctggggatgcagtcaaggaagcctttgtggagacaagacatttttgcagtggatcttgaaggacaagcaagaagtcccagatgcagaggccagaggactgagtggagaactgccagcagcaatgtgactcattatcagccagctcccctggttctgtggtttgtttctgcttttcctttagagatgacagattctgtgaacaagagctccagctgtttatcaggggccctcccaggccccaagtgccaggggctcccactccctgctggagaggctgtgggcccctgattagggagacagctgaggcaggggaccatgggcactgcaggcgggagtactggcagggcacagtgagggacagaggtggagacctgcaggatgctgtgtgggggagggccagggcaagggacagaaacagaccttgtccctctgtacttccaggacgtgcccctgccctcctctgccgggtgagatgctgctgtatcaaggccccttcagacgtcactcctctgtgactccactcatttatctaacgtttccccatggcatcattcagaattaatttttctcctttgcccacttagcaggtcattatgttgtagttgagagtgtgaactttggaatcaagaatagtaatagactggttgtggtggctcacacctgtaatcccagcactttggaaggccatggtggttggataacttgaggtcaggagttcaagaccagcctagccaacatggtaaaaccctgtctctactaaaaatacaaaaattagccgggcatgatggcgggtgcctgtaatcccagctactcgggaggc

SEQ ID NO: 120825 - DNA, 1034 bp, Homo sapiens
atcccgctcctaagtgctagagctgggaacggaacccagctcatctgtctttggagcctgagctctttacccatgcctgtggacagcttcagccttcagtggcagggaggctgctggcggagggcagctgcttcccttgccaccttctgccatatcatgagcaggaaggaagatgaggcaagaaatagcagccgacagtgtggcaacggtgaccgtggtggtaagggtgtccaacccggcagaggcgatgggcagacaaaaatgagatgggcacaggaattgtctgagctggaggcagctgatagatagcacagctgtgctctccacacctcgcccagcatggccatcgccgaacccactcctctctctcccctgatgtcacctccagctctgcctctctcttcctctttatggccacagtttcctctccccagctctctcttccactccttccctggccaccctccaccagggaggtcatcaggtctcctctccagctgtgtcctccgtattcccatgcttagcatcatagtaagagcagccacgatttagtgagcacctaccacatgctaggcacagtgctagggactttacaagtttgtaatcttctctccacaaacctgtaagcaatttttacccccatttcataacgggcggccgggcgtggtgtctcacgcctgtaatcccagcactttgggaggccaaggtgggcggatcacctgaggtcgggagtttgagaccagcctgaccaacgtggaaaaaccccgtctctactaaaagtacaaaattagccgggtgtggtggcaggagcctgtaatcccagctacttgggaggctgaggcaggagaattgcttgaacccaggaggcggaggttgccgtgagctgagattgagccattgccctccagcctggacaacaagagcaaaactcttgtctcaaaaacaaacaaacaaacaaacaaaaaaaactgaggcttagagaggctaagagatctgtccagggttacacagctggtgagcagtgaggaggagat

SEQ ID NO: 120826 - DNA, 1029 bp, Homo sapiens
attgagagcctggtggctgaaataactctgacctcagtcagacttttcttttttgttgttgtttttgtttttgttttgagacagagtctcgctctgttgcccaggctggagtgcaatggcacgatctcagctcactgcaacctccacctcctaggttcaagtgattctcctacctcagcctcctaagtagctgggattacaggctcccaccaccatgcccagctaatttttgtatttttagtagagacagggtttcgtcatgttgtccaggctggtcttgaactcctgacttcaggtgatccacccgcctcagcctcccaaagtgctgggattacaggcgtgagccactgtgcccggttcagacttttcatgcacactgtgtgcaccacacacgtgtgtgtgcacatgtgtatccacctaccagggcaagtgtgagattacactgggttccctgttgagacattgtcacgtacacagtctcaggactagtagagcaggctggtaggcccctgactgcctgtgtgcgtgacatgcagggatgcacggagatgtgatggtgttgacacgaatccccccgggcaagcccagagcatcctggatcccccagtgccttctggccagtgctttaggattgtccactaagccaagaaggtggaagggagggagcaagggtgccccagccctgccacagcaggaagatcaggtgtcacacacagccccggaagcaggagtgggtggtggtgaatgtgagctctgctaggtggggctgggccctaacctatctggggagctctggttgaatcagcccaaccacagccaccccaactgcggcaatggtgcaaacaagcttttcctccagctgcccttcaatgctcattttcctttcctcgctcttgtatgagactcaggctttgggaggagtgtgcgattaggccagcagctgagagcgtaagtctggagggggtggttcagctgggtcctagtgcaggacctctcaccttggccttcaagtgacacctgagaccttca

SEQ ID NO: 120827 - DNA, 1023 bp, Homo sapiens
ttgtacatttgataaaatctgtggacccattccccaaaaaatgctttttttgtgtttaaaattcagcacagcttcagagtattcatgaaacctcctgtccaccttggaagctcattcacagagccgagcttcaaaaactccatcttagaaacctttcccctttccccaaaagactttaacgtgactcttaaatagaggttcagcttcaggcagaagaaagaaaaattgcccatcagagaataagacctttttgtgtgtgtggtagtgagatattcataaaaaaatttatcattttaaccatttttaagtgtacaattcagtggtattaagtacattcacaatgttgtgcagccatttacattatttccagaactttttcatcattctaaacagaaactctgtacccataaacaataactccccattctccctccccctccatcccctggtaacttctaatctactttccatctctagatacctcatataagtagaatctttatttgtctttttatgtctaccttatttcacttagcataatgttttcttttttcttttctttttttctgagatggagtctcgctgtgtctcccaggctggagtgcagtggtgccatctcggctcactgcaaccacctccacctcccaggttcaagcgattttcagcctcctgagtagctgggattacaggtgtgtgccacctcacctggctaattttttatatttgtggtagagttggggttttgccatgttggccaggctagtcttgaactcctgacctcaagtgatccacctgcctcagcctcccaagtgctaggattacaggcgtgagccaccacacctggccttagcataatgttttctttttcttttctttttttttttttttgagaaggagttctcactctgtcgcccaggctggagtgcaatggcacaatctctgctcactgcaacctcctccttccaggttcaagctatttctcagcctcccaagtggctaggattacaggcgcctaccaccagg

SEQ ID NO: 120828 - DNA, 1068 bp, Homo sapiens
tctatgtttaactttctgaggaactgagaataagttttatgcctttaatcccctcttagacatttcagaaattgggagaagtgccaagtcttactgtgagcacacagccaggacccagcccacactgtccgatatcgtggtcacacttgttgagatgggtgagtataccttcagtttccagttcttcgatgcaactgggagaggagtccctaggaatcaggcatgtctgctaagtgttcttggtttccctcatggttctcttgaattgctttgagcttgagagagttatcaagagagattcctctgaacacatctaagaggcctcataattccctgttagggaattctgccagagcttcttttgcgtggctgcaaggtcattgagttgagagtttaagccatttgtccatactactactattctttctgtattcaatatccagtggtctgggcagtgatttttgttttcctgtctcttaggtttcaatgtggacactctccctgcttatgcaaaacggtctcagaggatggtcatcactgctcgtaagtgactttgaactgaggtacttagcaatttttcaattaatgcttgtggaatgaagtaattgaatatggtagggattggattagtagctacttccttgttgtgggctctcttccaatgtttggggctacctacaatataatctttatttgggctagtctgattagcatgtgaaattcagtcaccaaaaggtaaaccatctttgagatattgctgtgtttcttgtgttctagccccagaagggcaaatgatgctgcttggaaaaatgaaagtttttgttcttcttagattaagggttggtaaattgtggcctatgggccaaatgcagcctgcctcctgtttttgtaaataaagtcttatcggaatgcagccatatttacttattatctgtggttgttttcatgctataatggcatagtttagttgtggtagagactgtaccacatgcaaaacctaaagtatttattatatggccctttacacaaactttgatgacctctactttaagtaaacctgggtgccat

SEQ ID NO: 120829 - DNA, 1054 bp, Homo sapiens
tttgagatggagtcttactctatcacccaggctggaatgcagtggtgtgatctcagctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcaagtgatccacccgcattggcctcccaaagagttgcgattacaggtgtgagccaccacgcccagctaatttttgtatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaggaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaa

SEQ ID NO: 120830 - DNA, 1083 bp, Homo sapiens
aaagcgttgtgtttcctcctctgagtcttttgtgggggctttatgggaaagggaggatgactcacttactctgaaatctgggcttccaggaagggcctctcccatccttggagcctcctcattctcctgtctctcactgtccccccacctctaccatgatgtcctcattctggaaaccccgagcagggatagtggcttgggcccttcgtctggcttttctccccacacttgctcccttctaacattttctccctcatctgacatggaaggggcaatggttaacccaggagggagggcagagaacaagggccccacatcctggctctgcctctgacaagctgtgtgaccttgggtatcagctgactcatcggagaagtgaggaggacggacttgggccgtgtctggatattaaactttgttgggtccctgacctctttgagaaactgatgcatgcttctcaagaggccgcaagtgcattttacacactatttcaggcaccccacagatcccccagattcaggctccacaggcttcatgttgaaaactccttaagtgacagtggtcaaggtacccaccaacacttatttaaccttgacagtttgcaaagttccttctctctctcgtttacctgtgacagtcctctaaaatgtgccagccgtgtaatactcctaattgcattttgttgttgaggaaatgaaggccccgggaagagacgtgagttgctcagaatggcccctctgactggaaaccctgttctttctgcgtgaatcatcacagctgcctcccttatagctgtaaccactctccccacccacttatcctctcccggttgtactccccaaactttacctctattagagtggtggagaagaggctgagtaggctaaagctaccctggtgccaaaaaaggttaatgggcatgggcggggcagatgttcctggatcagattagccacaccttggtttctgaagccgtttcactgttccctgggccagaactccaccccacctctcttgtgaagcccagcctggccgaaagcaacagctaggacaggtcccgggaaaagctgagctggaagcctg

SEQ ID NO: 120831 - DNA, 1006 bp, Homo sapiens
accagaatgggagccctgtttgtgatgtctgcggtccctccctggggtcgataagcccagggcttgtcggggcaaatacagaagtatgagcagcatcttttcctctcggtccctcggggagatgagagacgtgttggctaaccagctgcagatattcacctcacatctcttgctctcccccaggtctccctacaccaccacccgctatggaagccccatcaacacgttcaccgtgaggcctgggacccgccatcccatctcctatgtctgctcaggggcccatcggaaagccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagccct

SEQ ID NO: 120832 - DNA, 1052 bp, Homo sapiens
gccagccataccacccaaggctacactttggccagccacaccacccaaggccacacttgggccagccacaccactcaaggccacatctgggccaaccacaccactcaaggccacatctggccctgccatagcatctacagccacaactctgcccaccaccacatcccaactgatggcagagaaggactcaggcccagctggccagccagagaagccagcatctcaagaagtttccactccctcccaggcaaggggagaggggtccccctcagaggccactaggctgcccacacagggagcccgctcatctgcagccttcccaccaaagacatctcctggtggaggagaggtgccatgtctctacaagccccactgccaccagagcagcctcagccgtgaggttgctgtggtgatgcccaccctggccagaggaggggctgcagggccaggggagcccgtggaggtgaaggagcccccagggctgccagccaagcctcctgcctcggcccagcccactgatgaactcctcaggcacccggtgactggggaggtggtggagcggggctcgccgatggccctgctcctggcggccaggcagagggctcagaagggaaggtctgtaggggctgccctgggtcggtcctctctgccaggaagtctccgtgaccacagccaccaagccgaggccagctctgacagcatcttccacagccagggcacgcccaactccttcactgtggtgcccaagttacccaaggaggctgagaaggactccccgctgacgaccgaaatacccaataagtgggggccgcggctgggaagagacgcagagggcacagagctgagccgcaggcacaactggacaaagccagagccccaggcccctgtggcctgggaaagagtagctccctccaacctcccccagggccacccgctgcccaagtccttctcctccccaccttctccttcgaacaagagggaggaggaggaggaggagttcaacttcgaggtcatcccaccgccgccagagttcagcaatgaccctgagcccc

SEQ ID NO: 120833 - DNA, 1019 bp, Homo sapiens
tacgctgcaggctgtggtctttctgcctttgaaagggtcagctgtacttaaagggactgtttcagctctgcctgggtgctgctctgggaccccctgctgccaacccaccactcccccaacaatcctctctttccatccatatcccccagtatggaccttccacaactcccagccataagctgaatgtttctctttaaaggatggagaaaacttctgtctgtctctggcaagaattgggggactgttgactgggattgtgggctgggcttggcttctaactgctgtgtgacccaagacagccacttctcctccctaaccttggttatgtcttggcagcacagtgagcaggtcggactaggcgaacagttttggattattgtgtttttagatgtggaattattttttgttatataaactcttatgtgtaaccccaatatagaaactagattaaaagggagtctctctggttgaaaggggagctgagtaccctctggaactggaggcacctctgaaaaaagcaaactgaaaaccagtgccctgggtcactgttactcctataagacagtttaaagtgagacctggaaaaacatttgctttaccttgaatagataggtttttatgttggtatataagaaataaaactaacctattaaacctgagactttacaggtgtgttatttcatatgatagtcatataaaatttcctttagacatcaattttaggtaaaaaataattgattagaaaaatattggccaggtgcagcagctcacacctgcaatcccaggactttgggaggccgaggcgggtggatcacctgaggtcaggggttcaagaccagcctgaccaacatggtgaaaccccatctctactaaaaatacaaaaaaaaaaaattagctgggtgcggtggcaggcgcctgtaatcccagctccttgggaggcagaggcaggaaaatcacttgaacctgggagctggaggttgcagtgagccgaaatcgtgccattgcactccaacctgggt

SEQ ID NO: 120834 - DNA, 1052 bp, Homo sapiens
cctgcgcagtccctactcttaaaaagaaaaacccaaattttatccatctttgtctgagggaaacgtctctcatagtacacacagaaaatcttatattaactatatcttataatttagtccttttgtcttcagttgttttgtgagcctgggattttatgttagattctttaggggaggccaggtgcggtagctcatgcctgtaatcctagcactttgggaggccaaggcaggcggatcacttgaggtcaggagtttgaggccagcctggccaacatgatgaaaccccgtctctactaaaaatacaaaaaaaattagctggacatggtggcacacacctgtagtcccagccactcgggggactgaagcaggagatggcttgaacccaggaggcagaggttgcagtgagctgagattgcacacactccagcccaggcaacagagtgagactccatctcaaaaaaaaaaacaaaaaaccgtgctttaacaaacagcttacatgaaacattttcatgtttgatgttttagttagaacatctaactggaagcacagcagatgtctacttggaatatattcagcgaaacttacctgaaggggttgccatggaagtaacaaaggtatagcttgaatttctgcctctttcggtggggcggtggggagtggtatctgtattgttgttttgatacattgcagcctggtcctggcccactgagtagagtttgccctaaactgtggcaaactgggagacacagttgccacagcggttgggggctacccaccccttgcaacagaatcctgccatttcagcccaagtcctccgtgaaccacctatgaagttctccctcctcaatatgagttgtctagacctggggatcccattaagtggcaatccatgaagatcattgaggatcaaatcgattatgtatgtgagagtgttttatagaccatcaagtttccttctttccatttcaaaaccctatagaaagactagggggataaaagaaaaagaagtaaagaggatttgaccaaattaataagtccgatttgtagtcaa

SEQ ID NO: 120835 - DNA, 2649 bp, Homo sapiens
actagctgggattacaggcacacaccaccatgcctggctaatttttgtattcttagtagaaatggggttttcccatgttggccaggctggtctcaaattcctggcctcaagtgatctgcctgcctcagcctcccaaagtgctgggattacaggcatgagccaccacacctggccagtactggatgtatttctatgatagtacatttaagccccagtctgcaactcacatgcctgcaggagccaggcctataagaaaaggtggcagaattggcatggtgtgccactgtctttataagcaagacagcagctacttattctagccacttgttgccctgtgggaaatcagacctagtgatgccagcctgtctaaatcttccaagctaaactgaaatccagattttcttgtgaaatcttctgatttttaatattcctaacaaattcaaagtatcttttaacaccctgtagggatcagtcagaacacatcttgaggctatattcccccttctcatccctcaacttaggacacaggctatcagtatattctgttcttccaacaaccctttttggagtaattgagagtggatatctagctttctggctagtaagtaaatctttcaggagtgaagtgatttaactctgaatcattggattagtagtataatttactggtttaacggatgaatgaaatgaaggtaattcaccttttggaagaaagtcaaaaatgtcaaacccattatttctaaggtctttaggtattagggtggaagaggttgaagttataggtatagtcagtgtcatatcatttaaattagaaatgagtaatttgtttattagggcagacaaaacatacgcgaataaaacctaataaaaaatatgaatagaactaacttggctttgtataataatgttttataattaataagcactttaatctgtgttttcttatttttttcttagagaaatactatgagcaatagcataggtttaccctctttcatatgtgaggaaactaatgtgcagtgagacgatatgatttgtccgttgtcattcagctaccattagcagagcttaatcctcaatccaagtcttctgcccaggctctttactagcagaccctggagtcctttttcattgtgaatttgaagctgaatcgttattttaagttggaaagttcctttagtaattttgtgggttgccttgaaaattcttttcatttacactgtattttaacagattctgaggctcatagtccagatctgaacatgaaagtatctagacacttcagctaacactgccgtcactcagtgtttttctcctcatttattagtaaactctgaagttgttcaattgaggctaatgttttaaatttgctagttagaaatagaagaggaactaaaactgaaacttttcttttggattttaggtaacaatctctgatgaaccagacatattatataagcgcctctcggttttggtgaaaggtcacgataaggctgtattggacagttatgaatattttgctgtgcttgctgctaaagaacttggtatctctattaaagtgtgagtatggcctttcctgacccgacctgttcgctgctgtaatatgatcaaccaggaaaatagtgctcatcccaggaaggtctgaactcttttttttttttttttttgagacagagtctcgctctgttgcccaggctggagtacagtggcacaacctcagctcactgcaacctctgcctcctgggttcaagcagttctcagcctcccgaatagctgggactacaggcgcatgccaccacgcctggctaattttttgtattttagtagagatggggtttcactgtgttgcccaggctggtctcgaactcctgagctcaggcaaattgcccgcctcagcttcccaaagtgctgggattacaggcgtgagccactgcacctggcccagtctgagctcttaaagtgggatagaaactcttggtgggtagagcttaagtttgtcatatgttatcctaatcaggatcatgccttcctgccatgtttctgggatctccatggagcagggaggtagagtaggtgaatgaacaatcgttttagaccctttggatgtgatgatttttggctaatacatccatcatttcaaatcttccctaagaaacaccacttacccagtaatttcttgcttgaacaaggtaagccttggagtcactgcagggtcaagcataactgtctcctttgtcttgtcatctgctccttctgctgttgaacgaggccccatctggggctttggcagtctggccttctgacaaaaacagaaggccacggtttcccaaaacagactatagttttgttattttgatttatctgtagattttcctaaaacaacagacatacagcaggtgttacaactatgtctaccacactggtgctgctcttcacaattaatatatttggtcaataaaagactaaagggtgtaaaagcagcaggtgtgtgtgtatgcttgcacacttgacatgccagggcttatttttgagcctgtgggaaaaagtttctattgctgtctgcagtgtttattttggcttgagttttatgatagcagttgttgttccagatgacagttttggcaaatggaagtctgtaaatggtagtta

SEQ ID NO: 120836 - DNA, 1068 bp, Homo sapiens
gagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattccttaaaaaaaaaaaaaagaaaaaaaaaggaaactggggcattctaggttgtttcccctccaagtgataagctttttttttttcttaattatcacaatgcttcttcaaaaagggaaccagggaaattttatttaacacattctaatcattagcctctcagaaagttattacagttcctat

SEQ ID NO: 120837 - DNA, 1061 bp, Homo sapiens
catgaatgcttgcacttgtgaatatgataattacgttaaaactgtacctaaaatttgttgaatgctcactgtttcccagcgatgatgctggacactttttgtgcattatcttctttaaccttcacaaaaatcctaatcagtggaggcaattatagttattcccatttgtaggtaacaaaacaggcttaggataagtaacttgccaaggtcaaggccatagctgggacttgaacccaggtgtcagagctcctaaccattatatcacactatctttttgttcaaatgggagtttgatatgtattatatcacttgctctgtagttgtattttgtaacttaactaaatgaaccagcaactaaaagcagggggaactgtgagctgttcttatgatgtttgtgttttgttgtaggttcggacaagtggacctccctagaaagaaaactgtttaacaaagcactagccacttacagcaaagactttatttttgtacagaagatggtaagcatgatttttcccattgcccccttgaaattaaatttgggaaattgtacacaaaaatatttagaaatatttggatactggtttaagatacttacaaaaaggatgtcttccacactcgctggtgaggatggtagtggagataggggtggtatggccccagtgttaggactgtggcagggagaggacaggggaaagaaggcgtagattatctggacactgcagtggcacggggttattttctatcttaataaaaatgtgtaattcataattctgtcagaataactagaactcgggttcctggtccacaatttacataatttattttatttttattttttattttttccaagacagtttcactctctcacccaggctggagtgcagtggtgtgatcttgactcactgcagcctccacctcccgggttcaagcgattctcttgcctcagtctctagagtaactgggattacaggcatgcaccaccacgcccggctaatttttgtatttttagtagaggcggggctttaccatgttggccaggctggtcttgaactcgtaacctc

SEQ ID NO: 120838 - DNA, 1045 bp, Homo sapiens
tgccaagacctgggtgacagtggacagtgcctgcacgtgtggcaaggagacgagtgcatgagaccagagagagccacagaaggtacaatcagcagccccctgcttttggaatcagtagccatgggtttagattctaccgcaccccttggccaagtcccatggtcttctgcagcctgggttttctcacctgtaaaatgagacttgtattccatccctcgtagtgtttttgtgagattagagatggtatatgtagcccaatgcctggcacatcctagtagcatttattactcatgtatccaacaattattttttgaacacttactgtgtattagggacttgctaaacactgagatgcatcagtgactatgacagacatgggcagagtcctacgtcgtgcagctcagaggctctgaggaggaggcagttattaaataatggatcacactgacaggaaagtcttcatacacgcagggttttgtatgtgaattaatgacaataccacaataagagggaagtagaagacacctatgagatttaaatggactgagaattgtgaaaagtgaaggaaataggtcggagagcctaagaagtgaccagtgacactgaggtcaacattttcatttccatgcactaactgttccttctgagggtctccacaaacctaagttggttctttattttggagggggctgaattttcagtgcctcttgatttttaatcacttgagggtttctttggtgctctgggcagaccctgcctaggcaggtgccaaatatgtgggcttggggacctagctatacgttttccaatctttagtccgggcagcccagtgagggcttctttacaaatattggcttgctttctccaccaacatttgcctcacctactgtgctcctcctctttcatgaacgagccttcctgcctgtcatcacaaggcagacctcaaagcccctcttccaagcacagtaagcccaagatgtctgcctgtaggtcactcctggaactaggccaatacagagtggacacatggaataagaaattcatc

SEQ ID NO: 120839 - DNA, 1184 bp, Homo sapiens
ttgcttatcactacattcccatctgtttgagtggaatccagctgagtgggctctttaattcccccattgctccccagggacggacatcaggaacagataccacatgttctgagaaggggacagaataatctcttcagggaagctgggaccgagacctgtgaggcaggaagtgggggttcaagcctagccaaggttcctaaggccagcgacccacaccgggctctcctgggtcactttcagcagggggggagagccttcgatgacctctaagggcccttccatgtgctcacctaaaaacggatctggttaacctcccccgtcaccacccctcactattgctcccagaactcgtagcttatttgtagcaaactcttctctgaggttggcttcctgtcaggagagttagtttattttaatggcagcggaaccaagcatagtctggaaggaggatctgccacatggatacatatatactaataagtaaacataggcacgtaaacagatgagcagggcatgccaaagccaaacagaaacagactcgggttgtgtggtagcatcagcccagaaaagtcgagagctgggtgtggctgcagaggcagtgtggttgggaggggccacggggatacctgagggaaggttctgggcagtctggggtgccctctcaggccctgcaggccaggggccagtcacagctgcaggtcctggagactcctgagcccagggtggcgcctgggtaggaagcagcagggggtgatgggaagggctggctacggtcatgtgaccatctgcctccaggccatgtgacctgccccatgggctcctctgctctgggctcctctccctccagagcttcaggctctgcccccttctgtttctccctcagcttctctgccttccatggtgccatcctggcctctaggagaggagtctagggaggcagagagtggggaaaggaggagggggcagagggtcccaggctcccggctccagagtgaggttcctaactacccccgcccccacccctcccctatccccgcgcctcacccccaggggaccctccttaggccagcgcgctcaaccgcctcttttctccaccagagggctcctcagcgcctgaggctgaggcgagagaggggctgaggagaatgggggaaggaggcctgtgccccccccaaggggagcag

SEQ ID NO: 120840 - DNA, 1048 bp, Homo sapiens
cttggatgatcttatctgttacccgggaacagagtgtatcttcagggctgctccccttggggggggcacaggcctccttcccccattctcctcagcccctctctcgcctcagcctcaggcgctgaggagccctctggtggagaaaagaggcggttgagcgcgctggcctaaggagggtcccctgggggtgaggcgcggggataggggaggggtgggggcgggggtagttaggaacctcactctggagccgggagcctgggaccctctgccccctcctcctttccccactctctgcctccctagactcctctcctagaggccaggatggcaccatggaaggcagagaagctgagggagaaacagaagggggcagagcctgaagctctggagggagaggagcccagagcagaggagcccatggggcaggtcacatggcctggaggcagatggtcacatgaccgtagccagcccttcccatcaccccctgctgcttcctacccaggcgccaccctgggctcaggagtctccaggacctgcagctgtgactggcccctggcctgcagggcctgagagggcaccccagactgcccagaaccttccctcaggtatccccgtggcccctcccaaccacactgcctctgcagccacacccagctctcgacttttctgggctgatgctaccacacaacccgagtctgtttctgtttggctttggcatgccctgctcatctgtttacgtgcctatgtttacttattagtatatatgtatccatgtggcagatcctccttccagactatgcttggttccgctgccattaaaataaactaactctcctgacaggaagccaacctcagagaagagtttgctacaaataagctacgagttctgggagcaatagtgaggggtggtgacgggggaggttaaccagatccgtttttaggtgagcacatggaagggcccttagaggtcatcgaaggctctccccccctgctgaaagtgacccaggagagcccggtgtgggtcgctggccttaggaaccttggctag

SEQ ID NO: 120841 - DNA, 1645 bp, Homo sapiens
gcccaggatcaaagcctttattgtctgtgtaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgtgaggatgaccctctctcccccacactcaccccaaggggctgccccccgcacgcctgctgtgagttgctgctctgccccacctgcctgggtggggacatccctttgctttcttggagatggggcggcccttccagagtcactgacctgagcttggatacggcttggtctctcagggctgaacccgtggccacattgggaaccctacccttgttcacactgcctgctccccattaaatgccaaactaatggcctaggttagattctgagagacccgaaagtgttcccaggtttaaacagagacgatcattcagctgggagtcactgagacaatcatagccattattgaaatatggaagtcctgtatcccagaaagtaagcagctgttgccccaggccctggccccttccccaggatctccagacctcccaaatccacaaccaaagaggtaaccactggcgcagcaggcttccaggcaatagccctggcatccattctgacaagcagccttaccagttgcttaatatttttgtctgcttaaataccctggagaacctaattcgttaaagttcccaaagtagttccactgagagccacccacccctaatctcaggaaagcaaagagatttgtttttctcactcactgttctcctttctccaattttaagtgcttcactcaaacagcttaatttgcctctgggaagggtttccgtctgtctgtctctctctctctctctctctctctctctctctctctctctctctctctctctctctctctctctctctctctctctctctctctctctctctctctctctctctctctctctctctctctctctctctctctcctctctctctctctctctctctctctctctctgcccctagggaatttgtgacctgtgtggttggcaatatcaaacctaccccctccccacaaagtggcatgttgggtcatatttgtccttaggaataggtagctgctgggaatccaggaggcataagggtaggctgggccagggtagagggagagaagataatgaatacaactagaaaagtacagaaaaaaacctttatggtgtaatatcaagtcctcaaaagaagagaaactgatggagaactggggggaagattctcataagccgtcaggacttgggggtcagcaacaggcagagagatgaaatgacacatccaagctccctctttgcccagggaagttcgtgctttggcaggagaaacagtgtttccttggggaaatagttcccttggggaactctcaattaagagttcatagtcacatgggggtcagagtcccaggcacaccccccccaccccttcaagatggtaagagaaagacag

SEQ ID NO: 120842 - DNA, 1010 bp, Homo sapiens
aaactgctgaagcgtgcagtacggcggctgccccaggaacttgcacaaatgtctctaagtggggaggcttttggaggagctgggctcaggctgaccctggaagggtaataagctatcgttcccaagtcaaaatccattgcctgaagccttggtatgaagaaggacattttgttcaattcttgcatgactttgagaaggccttttcccactctggagcctcagtttttcatctataaattgaactttgttctctaaagggcactggggtgatacaagtggtgccatggacaatgggatcattggatgaatgaaatgggtttgtggtgggtatgaggtcttgtggcaagtcactgtttccccttcctcaacgtatgtgtcctctccatttgactcttcccttgagcagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggttagcaggagccagttcccggtcctttctaggtcgtgtgctgcttgctttgctttgctgccgtcagacagagagtgatgtgagccccatgcgggacctggcgaggcacagtcctcccttgacaggaatgcttaggctttggcgctgggagccagccaggtcaagcagccccacttccccagctttatgatgagcaagggtcaaaatcagaggcgctagaaagccttttagggcatcccagcttctctctctgcctcctggagaagacagcaaaggaaaacatgtaaatgcaatattatttttaaacttctgctgcttgacacacccaagaccaggcccactggggccttccagattagtggtcaattgccagagaaagctaatataatcatcaggctctcagccagaattttctatttactgatgcagtggtgttcagctcaacatccaaag

SEQ ID NO: 120843 - DNA, 1075 bp, Homo sapiens
gtcccaagtgatcctccttcctcagcctcctgagcagctgggactacaggcgcatgccaccacacccagctaatttaaaaacatttttgagacgggatctccctatgttgcccaggctggtctcaaatgaacttcatgtctcagcctcccaggtagctgggattatatgtttatttttatcactggtcatggtggatatcaattgctcatcacaaaacatccaaataaatcctttcctgtcttttgcatcttgccttgcaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgt

SEQ ID NO: 120844 - DNA, 1122 bp, Homo sapiens
atatggtctgtggccgctttcacgctaccgtggcagcgttgtgacagaaaccatatgtatgggccccaaagctgaaaatatttactagctggccctgtatagaaaaagtgtgctgggaggtctctgtagagccttgttattatctacagcactccataaatttggtgctttagggcactatgccctcaacagaaactagtaaattctgtcccttagtccatgtcagaggcatgggacctgcagaggggaacaagccactctaggtctcctttgcctagcgcagtgttgcagttcagtgagcgtttgttgagcatctgctatgtcccagtccctgaggacaccacatgggcaggctgctgtccctacatcacagtgactgggcagccagtgtgcagacaggcacggaagtgggtcgcctgactgtgacatggtcagtgcagaggaaaagcggtcacaggctctgtgggagcgtggagtggcaccttaggttctgagtgggcatttatttgttgagcccaccctggaatcctggagtcctgctctaaggaagaaattgaccgaagaaatgggaaggtagcagttctgttaattagttcatgaatgaaaaagctcctggtacaaattacccagtagaaattgttacacataatgagcaaaacagttaccttgttagaaaaataataaagacttgaatcctgagttggtattataagaattctgtgagattgactaatccactaagaagaacagttttcaggttttaaatgatatgtttaaaatagccttttggcaagatgctaaaccacggcgtagcacgctaccatctgtataagacgggctgtgcattagtgttcttgtatgagcataaagtgtctctaggaggatatataagaacctgattgactgtcccagaaggggtactgggtggctggggatgggggtggaaggtggagggagacttttcacgcccgtatttttacaatttgcatgcttttcactttatttacaggcatttatttaggataatttttgctgttttgcatgtccattttaaccttttgaattttgaaccatgtgaatatagtacctattcaaaaaatattacatttaatgtaaaataaa

SEQ ID NO: 120845 - DNA, 1076 bp, Homo sapiens
gtgtgaatgcatttgatcctcacgttaaccttataaaagaagaagactgttactctgcagacaaagaaaccaagtcctaagggaggttaatgggatagctcggcactcggagttatctattcagtaaacgtttatggggtcctcattatggactaggctctgtgctaggatctggggatacagaagtcatcatctttgcattccagtcatcagcaaaccaacgttccaagaccagattgggtcaatgactcctctctgagaccccggacaaattgcctacacagatacctgtgctttattttacccatctgtaaaagggaattaaagggacaacccccagctcctcctctgggttggttcttgtgagatatatgggtgaaaccactttgggacatgcacagtggggcacagatgcaggatgtcactgggtatacttattctgggaccagggaacaacaagcacatccccttctcctacctggatgaaggaatggtggagaatcagccactattgacctctatcctggtggtattaagtttatcagattccccccacctcccgcccttacttgtgggcattgtataacatcagaggattcttagatgtctcaaggattctgactagaatctcaaaatcattttttggcctgctgctagaagagatactatgcttctacacctggccagtaggattatggcatttgaggcaacagtcccgtatgattggaagtggttggttatattgtttggaagaggtgaccacccaaaagtcccttgtctgttgatggcaccttttgaggaaactgttctgattcattattaggctaccagtctggctgtttaattttcaacagttccaacagctgttgttattctggaacctaatacaagagcattgttttgctttctatcatttttgccaagatcattagttaaaaacaagcttgtggtaatagatgatacattggtgcatggtggagaaacagccccatggaaagggagtcttgctccttgtcactctcctgagatgggctataaagaatggaatgatcaaagcttagagcaaagcaagccag

SEQ ID NO: 120846 - DNA, 1051 bp, Homo sapiens
ttttcgtgaaacaactggcaagtaaaggctgtgggctccatggctttggaagagggagccatgctaggggtagacctggggccttggcatcattcagacctttgctaacccactgaattgtgatagtaggccaagtctcccagaaaaagaacaggcacccatctctgaggtaaacataccttcctgggttgcattgtccaaaaccttgctctacgcctgctccctcctgttcccggggccttagactccggggcagacccatgaacagatcctcggcagaatgaaaatccttagcagacatacacacagaccacccagtgcctgtactttggtgtgattcagctgtcacagagttgaatgtgattcttgagtgttttcactatggtgataagaatgatgctcattgatatttggccagtactgaggatcttgtttgggccagaaacttcttacagttatttgtaatccttgaaacacccttgcagggcaggtattaatctacagatgagatggccgaggcttggaagagttaagtaatatgcttaacatcacacagagcggggttcaaacctagagctttctgtctgtcagtcctcttgtttcttccactccttgctccgctggtaagtgatttgaggtcatgaaaaccctgcacccaaatctggaaggatgtggggggaatccaggctgtgttctccactgtacacgggggactgttttggaacccaggaagaaatgatgggcccttggccccttagaactggcagggtccttggagtaactagttctaaacaatttcccagcacccataggcatgaagatcaccccttaaaatccaatcagctaggggtgttatggaggaaggagaaacttcctccatcagagaaagttctagaaagaaattgatcatttcagaagaatcctctgagaatgttaatttactgcgatctgagaagagttttcttttttgccgctgggtgcggtggcacacgtctgtagtcgcagctactcaggaggctgaggtgggaggatcgcttgagcctaggagttc

SEQ ID NO: 120847 - DNA, 1037 bp, Homo sapiens
ccagcttataaagatcctgcttacaggctcagagaagaacaagacaatttgtgacttttctagttttacatttctgactttgagaaatacccctatcctcatgtctgtagtagattgttgaaaaacagcaccaccacaaacacatacaaccaaaccccatacctgttatcacttgcctccttccagaagttctcttggctgcagcctcacagctcactcaggcttgtgcacatacgctctgtccttaggataacacacttcaaaggacctgtggcctgaagggggttgggaggaccagtgtctagagtcagttctcctccgaggtcagcaggctccccctacaacctcatagagcagcgcgacaccaggtataccttttgtgtagttctctgaaatggatctcagagtgcatgtcaccgtggaaaccatcttataaatggtggctacatagagttaaaataacactgttagttttatgcggcaggtacattatgagttcagaaggcttttgtgggctgacctgggagtctaaccctcattttaaatatggtttcttgtggctacatgctatcagcattttaaagaaattacttttaagcaaacctttagagcgagttgtttgtaactgggaaattggcagtctataatttatattatgttttcttaccatcttgtgggtttctcatatcccaggactctccagatggagtgtaagctcctgggaggcccagtgacagatggatggagttgtggctcaacagtaacaggctcagaaatggcatcagggtgttgatatgagtcaatgtgaggtggggcagccagatactatagcagagcatagaatccaccaggaacaaggtgactggtgtgggagccatgtgtgagtacctggccccagagaggccttggatgggtcattagattaggatggcatgccaactttaaaccaaatcatgtgagtaacagttggagaaattgggcctagaaaagagaagacttgggagcaatttaataactgtgcttcgtcacttgagggg

SEQ ID NO: 120848 - DNA, 1042 bp, Homo sapiens
cctgaggtctccgacatgaccagcatttatacatggttttgcagttgttccattacttatctacattctctcagtacagttcttggcacatattaagaggaaagtaaatatgtgttgaataattgaatgattctcacctctacaccatccttgcccacacctccactccctctccccatcaactgaaccataaattcttggaaggcatagattgtgtcttattgtgctttgtgttctgaatcttgcctaacaaactttctgccacatagtaaatgctcagtaaatcctcgttgaatgaacagattatgtgggtggagtactctcttagagcctgcctttgggagaggtgggtgggaactgaagctctaagaaggaagagggagatggagaatgaatggagatggcttcaagagctgagtgtgccaacccctccagcttcttctgatttccaagtttgttacagataaggtgcttatttctccaagagggatacatggggtcctctcccaactggatggctgataagctcgtgtctgtgaaacagtggaataaaggatagtggctgtgattctaggttttattttaagaacagcaataaagcattttattctacctgagcccctttggaaacctccatggttgagatgagaggatacaagccaggaggacagcaggaaggacacagtagtcacctccctgggttgaccacttcttcctttccattggccccaggggtgctaacgagcaatgacagttccacaaaggatgggagaaagagtacccagttatcaggcaacttcatagcatccctgaggatggtatggctgggttgaccaactcgtcctggtttgcttgggactgtcctggttttagtatgaaagtcctgagttctaggatggttggtctctttagatgccacttgctctcttttctgccccctgcaaagccatcttttgaaattccttttccctttgcaatgtccttgacttggcctctttcctcctctttctgccttctccactgcttctacctgagccttgct

SEQ ID NO: 120849 - DNA, 1055 bp, Homo sapiens
aaccatccaggtttttttttttttttttttttttttttttttaatctctccactccttcctccctgggtcagttcatcctcaggctggcttctgcaccagactggctcctgcaccaggctgtggggaggctgggggtgtgtagagttctggacactttgtcagggtaggagggaaatagaacttgggagccgcagctgacatccaccatactgtaccacccatagaagtagaataataccttactaacttggaccagtcattggggataatagtgagaggacactcaaccttaactagtaaaagtttgaatcttcaagtgttttaatgtggtatagtgtcaggcaggatcttcccaaacacatcctgttggaagcagttagcatctgtttttcagtatgtcttaaaacgtacgaccttctagtaggttaaatatatcttctgaaatcccgtttaatttctaatttgcttattcaaccttttaatagccagagtaaacactgaactcaaattctgggttggtgaagattaaattacagtaatgaggttcctcatttataagctcatctataaaatggaaataagaatagcacctactttataggtttgctgtaaggattaactgaggtgatctgagtcaagcgcttagcccagtggatagcccaataaatgttacctttattagtgtcatatattgccaaatattgtcacctttatgtttttatgtgcatgtttaactagaaaattaattctcttcgtaacaaatatattatctgctgctgattagttctgttagagaggaggtaaataaaggtattaaaatatttagtgtttatggattctttttttaccgaagttttttttttctgttagaattcattttgggggaagcctaaatacagataagtttaaggagcatacaactgaaaatagatagaacctctagaatatagggattttaaaattttatggcaatatgttcttatattcttagttgaaaaatctcttaaatagttgatggcctgtcatgacctcatgacctatcccagctgatttt

SEQ ID NO: 120850 - DNA, 1130 bp, Homo sapiens
ggatggtagttctagaagtgtttagaaggatttaaaaatgtctgggatgcagtggaggtgtagaaggccactgtgggaagctccacagagcctgccagaggcggattgctggactcaggagccttagctggccctggggcattcctcgcgtttttatcaggtctggcctcatgatcccttccattctcagtttgtccctccataaaatgggcatacagctatgattcctctgccgggcctcccacaagctgtttcaagggtcagtagtttgtgcataaatagaattttaagcttttatttcaggtgtaaaccctgatccggcaagagatggctccatcctccacacattcttggcgacagtggggaaggggggtggtatctgatttgattatttcggtgtgtgtggttttgttttcttggcatgtgccacgctttccattcctcctgtatgaggctcagaattgattgcttcggtttcttttttattgtgcctgattctgatttaattttaaagccattgtgtctcggggttccagtcggaaacacgtggctcgtgcaaatggggtaattgaagagcgtctactgaagggagtctttataaggatgcaggcagagttaagagaagccaagaagggatgctgaagcacccagggccagcagtgtcagggagctgttactgtgcctggaaggaagagggagggactggctgtcgggatgggaaacaggagctggagaggtgtccctggtagaggaatgcaatcaacctacagcagcatggccaggaaggagccaaaagaataaatatccttattgaaccccttggatctcccatctcctgatgccagtgcctcccattaggcagcctcagtcagagccagaaggcaagggaactgggtggatgctgtccacggagggcagagcctctgtggggcagagctgcctgaaggaggatggagggtggatctgcggagcgaatgggaacagtctcacagagtcaagagttgcaggtcacttggattataaggacgtttctactttagaccaaaagaggcttttgtgtatgtttgagtgaaactttgcattgtgaggtcagctacgtagatgtgccggctgtgagggatggtaggagc

SEQ ID NO: 120851 - DNA, 1063 bp, Homo sapiens
cctggtttgggcagatcctgatttcttatggggcatcttggtgacagcatccccttgaaacctgtggttttctctcagccccatgttacccagatctgcctgtctgcctggggtgatcagatggcccttgagtgttttgctgattttcacctttcccaggcatctccctcttgtggctctgggaatcccagaattgttagatggtggtccatagctggtgatcgaagtggatcagtccagctcctcatttcccaaaatagaatattctttttcctgcttctggttgcccagtcctgactgttctgccagtcaccatgagcttctccacacagctggatttctcacatttcaagctctcccttgaagaaggaagaagagagtatatctatctatgtctacaaaagcatgtgaaagggtggtaaaggaaggacaccaagaccttgaatatgcaggtgcaggaagaggagggaggagccaaacccagccatcctcctccccgttagagtggatgttaggaggtgccggactctggtgcctcctgcacaggaagaataggtatgcctcccagcttcaagaaggccctgtgtctcttcacttggccatcttggttctcctacattttctgaaaaacttctggaatcatatcacctgagcatcagaattgttctgtggatcaaataactgagacactgtgttgagcagcgggcagttgcaagcattgtcaatacacgattcattgccctcaagaagctggcagtccacatgggcacagggagctcttgcccagagaagctagatgcagtgagctcagaagagccaggagagcttggtaagctgggttggtgccacccagcagactgcaggagagggctggagctgggtggccagagggcagagctgcaggggaggaatgtgctgggtgttaggaccttgacggggtgcatggactgggcaggggattacagatggggtgagcagaggtacgcatgggaaacaagattgaagaaggagatgtgcaccatttatgaaggatcccaagggatggctgtggagcttggaatgt

SEQ ID NO: 120852 - DNA, 1083 bp, Homo sapiens
agtggaattactggtaaaagcatctctacatttgtgatactgatagacatactaagtatcctttcaaggaggttgtagcaatttacaccgaaaccatcaatgaatgagacatcctcaccaacacagtggtgaggatgtctcattcattgatgagttaccagtaagttatcagacttttttatctttgccaatctgatggatgaaaattggtatctcagttttaatttgtatttcttttatgagtatggttgaacatcttttcacaagtttaggattcatttgtattttcttttgattcatagtctgtccatgtttctgttgagttgttggtctttccaagtcttttagatttggtatctctttgacccatttctgtattttgtgtagcccactctggggactggggcagcctgtgcattcaaatgaggctttggtgagtgggatggatcaactctctggtgatgaaaacgagtccattttcttgggtgtggccattgctgcattggaggctgctgggggctccaagcttggtggtttctggtcctcacccctacaatgctcgtcggagcggggaacagtctgactcatatggagagcaagtgcctcctggtgggttgaacacgtgaggaagggttggtggggagatggacacaaatgagactaggaaagccagggttgggaggaggaagggggtgttagggggtatccagagcacggagtgtttgcatttaggcagcttcataggaaagaggcatgatagtgacactggagattttcaaatacacagtgtcccagaagtcaggagaaataggatacatttggatgtaaacagtatgtgagttacattttcaaaactatgctcaatatgtttttgtttttgtttttcaagacaaggtctcactcggtcacccaggctggagtgcagtggagtgcagtgacagaatctcagctcactgtagccttgacctcctgagctaaagcaatcctcctacctcagtctccctagtagctgggactacagctgtgcaccaccacactcagctaattgttttattttttggagagccagggtcttgctatcaa

SEQ ID NO: 120853 - DNA, 1506 bp, Homo sapiens
ttattcattcactcattcatttcttcattcatttagcaggcatcacacccctgccatgtgccaggtgctgccctggctgccaggatagacaaagccagcccctgccctcatggagcattccttccaatgagcaagacagataataagtatacgtgtacacatctactacaatgtcaggtgtcgatgaggtctgcgaagaaaatcagtcatgggaaggagatagaggctgatggggtgaagctgggcttcagctgtttggattccaactctggatgtctttctcccagttcctgagacacagcccagcctgaccctggccaagcacctggcacatacaggccttcatcacattttaagttttattttattttgggagcaaagctttactctgtggggaggattccagaagacacatcgagagctcatggtaaactcaaattaggtagaaatgtacatagaaccctccagcccactgctccatgttctgagggcccacagatgttctaggcaggtagagtaggcgggaaggctgagggtgaaggtgggggcagaagaatgagctctgtggtggccagcagatgggagagtataggctcttaggatccgaggcccacaggaccagcagcttcttagagatcgtgttcaaagggtacacgtggatgcaggaaggcatgggggtggtgggtgtgggcaggaggactccctgaggccatctgctgagactgttcaccagaggctggagcccagcttttcattccctgccctgtgacttgtgcaatatcaccctgtctcccagaattgttccccccggctgggaaataatggcagatgggtgcaacagtctagcttagggacctgttgaagggcagtccttaaccctaggcatttaagagccagagtagattatgaggacaggctactctaacccccaaaacatcttctggaagatgggacctcctggtatcagacaaaaagtattttagggttgcactctccacccaccatgcattgcagtccagtgtagctgagccaacatttattgagcacctgctccatgttcgtttgagaagatctcgaaaagccctgttctgggagatgggagaactgggatccaatacctggtctcctgtgagtaaattagctttgtgataacagctcttggtcctggtgtcctctgtaacaggaagggtctggccaaatggtgtccatgtcccccttttgttctgacctctgttctaagctggagataagacagggtcccactcacaaagcatttcagtctttcagttccttttcccagtggtgatccctccctggagtgcagggcttgggcaggtgtttggagaggccctagtaacctgcagagccggctcgtgtatttcttggtctgtgggtgtcaagtgttttttccccttgcccccagctgtaagccacttggtactaactaatggttaagtgaccattgcccacacagtgtgctccccacaaagtaaagctcgcccacaa

SEQ ID NO: 120854 - DNA, 1055 bp, Homo sapiens
tctttggagtatatggggaaagtatcagaggcctgagcacctggaccttcaccctagaggggtgtcttcctgggcgttacctcactgattctttgtagtcttctcaggctttgaaaatccagatttaaaaatctggtccgtttactgttttatggtcataaaagcaacctgttaacagaaataagttggaacatataggaaatcatagagaagaaaataaaaacatccatctttctggaagaaaccagtgtgaggatttggaagtttacatcccagtctttttttttttttttttcctgcatatatacattggagagtttgcctgcttgttcatttttacagaactggaatcatattgcacatattgttatgtaatgtgctttaaaaactctattgtgaggatttcctagttgtacactgctcttttaaaacctgactttctgtggtggcacagcattctattatgcggaagttctataacttatttaaccagctcccctatatttagtcatctaaattgccttccatttcttttgctcattcacctaatgctgcagcggatttgggaatgcagattttaatagctaggtcactgttttaggaaagaaattctctggtgaagcacactgaactaaatggttgcattagtttcaggttttgccaggccttgcacactcccgtgacctttgcactctgcagggaattcaccatctgcttaagtgctgtacctctcctgaatctctgttctgacctttacttacttctcatcgtccttcaaccacttctctgagaagccctccttctcaggggcagaggggatgatgagaggccttggctgccccagaagatactggttcaagccctgacaatgtcactcacttgcagaatgacagtgaaaaatttgtggtacttttttgaaacccagtttatttatctgcaaaatgaaggcaggaatgcctttctggccaggtggtgaggatgaaatacagtaatgacctctgatgtgctttgtaacctgaagtactacaaagatgctggttgttagcactgaccac

SEQ ID NO: 120855 - DNA, 1060 bp, Homo sapiens
ggtgttgggaggtgggtggggcatctgggctttagccatagagctgtacatttagatgggccttagcgctccttttagttagtccaccctgactttgtagaggggaagttggctgtcacaaggtcacacagccccatgtgggctgagcctggtcacggaaccaactctttgcaaagggctcttctgaggcacagcctggactccccagaagggtgccggccctgtctaccccacctgtcttgttttcctgggaacaagtgccggtgttacagatgagaattttatgacttcatttcagagaatgtggctgggtacagtttgcctggtgggtgcctaaatttaaacgaagtgggctgtggtgggcggtagtgaagaagattggcttggtgctttcattaaagcacaatgtgttggggggaggttgggtttttatttttacttcactgaatgagggttgagcgcagagctgaggtttccccctcctttccttttctttcctttaaaatgattaaatatctgtttttttttaatattctcaaatcaggactggtggtacatttcactttcagcctgagtataaatgaaaagttgaattgaaatttttttgcattagtattgctatattattattgttttgcatttcctaatggccaagtgcagttgttgggcaagcctcttaagcatctatagaccatttctggttagacttggtttttattcccaatcctggacactcgctggctgagtgagcctggatattatttctgaacttcagtctcctctctggaaagtgttggaagcaatgactaggtattagaatgaatgtgtacatctgcagtcccgtatgtgaagccctggcttactgcacagcacatggagggtgctcatgaattactggctgtgcctggcttctctgctgtgccttccaagccttgtcccccaccaaggtgggcgttgatcaggggagggtgtagacaggatagcctgctgacggaggaggcacggggatggtatggagggatgtgctgttgttagtgtgttgtggggggagagttggagt

SEQ ID NO: 120856 - DNA, 1055 bp, Homo sapiens
tccccatggtcaagttctggttacttcaaatcagcattaggcctggaacagactacagcaatgcatgtgacttttccaaagtcttaaaactggaagaacttgcttgctccagtgttttagatacaaagctacaccgggactgcattggccagggaccccagcgctgcagccgctccaaggtctgggttctttcctggttgtgtgctggcatttgggtgttggcttccattcaggaggacctcttcctttcatgcaagcagatacctgaagacacccaggtccctcgcttggtagtctggaacgatttcactgtcaggggagctctggggtggaatttagtgtggtggggtctatactttctctttgatcattttaggtttagtatgtttttgtctgtaaagggaatgataactccagctcattactataatttgactacagtattggtttaatgagaaacctatgagagggacctacttccttctgatttttgttttatttaaaaaaaattctgtacattctgtttcatttctcttccattggagttttctttttaaaagtcaccaaacaacaaaaccatttagaaaataaaatggaccctggggactatgtagcattttctctccatgctgcctgacttccttccatctggttaaatctctccctgtgttttccaggcggcaggtggtgagatggagaaactgaggcccatagaggggatgggaattgattgaggtacacactggatcagagcttgaatcaggcctacacaatgtaggttccaggccagtatttctgctgctccccagagcattggtgttacctgtgggatggtctccctagcagtgcatgatctccttgtagtttcactggcttacttaagatgagctctcactacagaattgctttgatcatgcattttacatggtgtcaggacaatcttgaatggattccttccccatacattcgtccatccaaccacccatccatccgtctatccatttattcacccgttcatccaaaatctttcttgatctgccatgcacaaggcaatg

SEQ ID NO: 120857 - DNA, 1050 bp, Homo sapiens
agcacacaaccaggaaagaacccagaccttggagcggctgcagcgctggggtccctggccaatgcagtcccggtgtagctttgtatctaaaacactggagcaagcaagttcttccagttttaagactttggaaaagtcacatgcattgctgtagtctgttccaggcctaatgctgatttgaagtaaccagaacttgaccatggggaaggagagggagtagggaggagagaacacctccagtgggtcattgagactagaactgtggcattctgaacatgtctggtagtaactgaatgctctgggaacagaggccagcttctctaccctagtttctcattcccatccatcccccatggtcagatcctctatggtgtggtagtgaatggagaaagtcacttttgttgcccaccattaatccacactctttctgttctccaagagggtcccacaggacctcaaatagatggaattcttgtattagagccatctgatattccaggagtcactgtgagactgtggaaagaacatactctttggaatcagaattgtgttagaatcctgattgtcactcaatggaacccaccccagaggaaaacctgctttcactggatccagtcgtctccaaagaggagtcacaggacctgcatcttttgtgtggagaaaaatactcctggtcccagtcacagaccataaacctaacctcagccagctacaccctaaatgcagcaccactattacacaatggagaaccaagcacaggggtctcgtacggctccatgtgatacaacccaaatgacagctgatgacagctgcgcagcccagcatgcaaacacatgccaagaaggaggagtaaggcagctagataataacaaatataactatcctgtgaggtggggcgggggcagcagtttcaccccatctcattgtgaggggctttcctttggcacaagcattcacgattgcttgacactggcttgcttattgggggtacacctggggatgcagttgcaaacaaaacacaacctttccccaaccccaatcacccaccac

SEQ ID NO: 120858 - DNA, 1032 bp, Homo sapiens
acctcatcttaactaactatgtctgcaaagaccctatttccaaataaaatcacattctaagattccaggtggccgtgaatttttgggagacaacctagcaccagcctcgtttttacctgcttttttgggccttatttccctcccactttcatggccttttttggggaagatgtccagaatctaccccagctgaggtttgctgtctctgtctcgtgagccgctccctctctgtgagcaccccagtactttcttttttgcaccccaatactttctttattgtccctgtcctaactaggctccagcttcctcagaacagggactggacctcgctcctctctctttgtcagcaacttggtggctgagagcctcaccttcagggtgccacagaagcgggtgtgagtccaggctccccacttaattaatgtgcgaccctgggtgacttccctgacctctcctagcgtcagttttctcatctgtaagatggatctattaaatgagaaaaggtatgtaaagcagctagtccggacttagaatctccatgagggcagcattcgatcttgttttgctcacctttgtgtatctggcacttagcatggtgtctgatgtagtaggtgctccgttaatatttgttgaataagtgaccacatggggagacttagcttgataagaaatgactttataagaattcagaagggtagacatttggtaataaccaaatcaacaacaataacaaaagaaatgacttataagaagtgagttctgtgtttatggatgtgacccttccttagaaaccccccttccccctgccttcagtccctaagagctgggtaattacagtttgagttgcagctagatgctgacgagtagcggtgaacaggggtctcagttttagtcaggctcacagccctgcacccggtgtttctctttcatgtggatggaacaaacttcagcttattacattagcggtacctatggtggctgcaatagatgagtcaccatttactgtaaagctttcagatgcccggcagatgc

SEQ ID NO: 120859 - DNA, 1050 bp, Homo sapiens
gggtgggcagggttagcccccatgttgctttggagtatgtttctggtttgttgcaaacctgtctgtcctctttttttgtgagtctgttggtgagaaaagatgaggccttaaaaagggcagggaggaggggtgcagtagctaggaaccaggctggctgggcgttgtcctggtaaggtttggggtggaggctatatttacttcttatagtgatgctggtaggatctttttctatgtttagaaatagtttatataacatgaaagtatgtgttcttaaaaaaaacacacacaaaaaacccagacactagaatagaataaaattttaacagaccaattaccatagaagaaatggagaaagttatcagagctattccttaaaatagtcccaggaccagatggtttcacaggtaaatgttttcaaatattgaaggtacaggtgattctaatgccatttacattgtcctaaagcagagaaagagcgcttaaattctttttatgaagctagtgtaacaaaatgtgacaaaaaaacaggtgtgcacacagagccacaaagtggtctctgttttgaatactgaagatgcgacattctaataacataattagaacccagcagcccatttaaagaactccatggtcacgggagttccagaacaggaaggtaaggataggttaactttaggatttctgttaataaaaattcattgtattaaaggatctaaggagaaaataagatgctgaaaaggtttatgaaaaattacacatccgtttctaataaaaactgctatagaaataattggatacctcctcaacatgggaaaatacatttttgtcaagcaagtagccaaaattttgcttagtattaaaatggtgaatgctagatgcattcccattaaaatcccgattaaacaccataattatataaccttgttctggtggggataagctggtgtaattagataagaggtataaaacctagaaggaaaaggcaaaactaaaagacaaacaagagaattcagtaaggtagtttggtgcatagttaatgcacaaaaatca

SEQ ID NO: 120860 - DNA, 1044 bp, Homo sapiens
cagcactttgggaggctgaggcgggtggatcacctgatgtcaggagttcgagaccagcctggccaacatggtgaaaccccatgtctactgaaaatacaaaaaattagtcaggcatggtggcatgtgcctgtaatcccagctactcaggaggctgaggtaggagaattgcttgaacccgggaggcagaggttgcagtgagccaagatcgcgccattgaactctagctggggctacaagagcgaaactccatctcggaaaaaaaaaaaaaaaaaagaaagaaagaaagagcaaaactccatctcaaaaaaaaaaaaaaaaaaaggaaagaaaaagaaagaaggagagaaagagagaaagaacgaatgaaccaacgaaccaacctctggtcccatccacagttgtgtaatcagaatctgcagttttaacaagaccttcaggtgattgggtgcacgtcaagtttgagaagtgctgggctagcacagatgccccctgaggttagagatttgtggcaatgtggtttttattgtgtagtgcagtaaaagatttaaaccctagtgctgtggtatgattccagtctgctctctgtcattagagcctggaattgtatgtgtgtgtgttcattgtcacttgtggcatcagcgcagggttgtggtttattcaccctctgcagctcaccgagttcttggcgcagctagccatttctttgaatgcaagtctggcatcatagactgttgggggggtgtgaccaaaacaccactttcttcctgttactccctggagcccacaggggctctggttgtctgctgtgtcatgtccaaacctcttgctggggctccagggcccatgtgttccaggtttatctggcccctgctctggccaggcagatgggcagatgccggtcttcagccttgccctctgtctcttgctggatgtgggtttcctggccggccagtcgttcctcctctttatacccttggaccactctctgctgcactgtttagtgcctcatcatactgggctgtttcctggggggctttttgttaa

SEQ ID NO: 120861 - DNA, 1309 bp, Homo sapiens
gtcaataaaaacttaaaactacattgttttgggatgcagattatctaagaaagccataaatgttggggggcaggttttcgaaggttcctcttatgagaaccactcccttaaatgtgtttgtgacaagctccccaagtacaatgatacagatgggatcaaggaggagtcagcttgggttttgaaggcagagtagacatttttgtcattgctttggaaacttttttttttaaataacccgaattataaaatgttagcaattggagtatgatattaggtgcatatgtgtgcattttattttatttttttcttattaccacgaatgtattttttgatcactacaaatgcagataggatatgggaaactgtggctgcatctgatatctatggtttcctgcccatgcaaggtggtgctgggagatctcagctctgaaaggctgcgtttgcagccaggtgtgtgattccttgtctcggggctgctttcaccgtaagggggacgtagatgtggctgggtgatggggccttctcggtttggttccagggttagcaagcagagctagtttagaaatgagtaagaaaggggcactttctggttttaagttttggctcaaatatgcgtactgaaactcttcctcactttcgctcttcttatttgatgagttccatggcatcctaatttgtggaaggacaaagaaggaacatgtttgtatgagagaaccagcttttcgagtagagttacggatgggctggaagaaaccaagatgagttcctctggggatggataaagcatcctgcatgaaggttcaaaaagatgcccatggctgggcacggtggctcatgcctgtaatcccagcactatgggaggcagaggcaagcagatcacctgaggtcaggagttcgagaccagcctgactaacatggagaaaccctgtctctactaaaaatacaaaattagccaggcgtggtggcgcatgcctgtaatcccagctactcgggaggctgaggcaggagaatcacttgaacccgggagatggaggttgtggtgagccaagatcgcgccattgcactccagcctgggcaacaagagcgaaactccatctcaaaaaaaaaaagatgctcacgccaggctgcttgagctgaggctgtggggctgtggagaggccatgggagaagtagggcagctgctagatgatcatggccatcctggacggcagtgatggaaggggcacagagtgcaggggaaggagttgggcagaaaggggtggagcgaagggggattgggcagccctatctcgtgaaattactgcttgag

SEQ ID NO: 120862 - DNA, 1007 bp, Homo sapiens
gaaaccccagaagacattttttttgtgtgtgtttgtttgtttgattttctttctttcttttttttttgagacagagttttgctgtttctgcccaggctggagtgcaatggtacaatctcggctcactgcaacctctgcctcctgggttcaagcgattctcctgcctcagcctcctgaagtagctgggattacaggcacccaccaccacgcccagctaacttttttgtagttttagttgagacggggtttcaccatgttggccaggctggtcttgaactcctgacctcaggtgatccgcccgccttggcctcccaaagtgctgggattacaagcatgagccaccacacccggcccattgttttatgtagacaataataatttagattaatccacatacttactctttttgctgttcttcatttccttccatataagcatgcttctctctcagcttaatttctttctacatgaataactcctattaggggtgtgtgtgtgtgtgtgtgtgtgtgtgtgtgtgtgtgtgtgtggtggagggtgtctgctggtgttccagttctcccagtttttgtttgtcggaaaatgcgttttattcaccttcatatttgggagatttttttcccctggaaaaaaatctttattcaccttcatatttgggagatttgggcttgttttattttctttcagtcctttggaaatgtcattccattgtcttctggcttccttcatttctgttaaaaagtcatctgtcagttttattgtggttcttctgaaagtaacatatctgttttttctctttggctttgtttttttttttagcaattttactatgatgtacataggtgtggttctcttcatatggatcccctgtggagtttggagtgcatctgtaaatcatggctctgtgtttttggtcagttttagaaaattcttgaagcattgtcttccaattttgcttttgctgtttaatcctctcctccctttctcaggctcctgcacatatgtta

SEQ ID NO: 120863 - DNA, 1008 bp, Homo sapiens
ggggctattcgtggatagcgctaactcttggagcctcattttccatgtcctctcagtacctttgttttactgactgaaaaggtttattttgagagtaaaatgagatttaaaaaaatgcaaaagtgctttgagaactgtgaagccatattctttactcttctgcataatcattttctgagggggtgaaactctgtgagggtgggatctcagtgccatccctgggctttgggcgcgatgggtgcgtggttcacacacgttgttagcttccagaagtgtttggggctgaatgtgctctcaggtctgccccaaattattccacatgatttgggggaatcattggtggctgggctgcaagtgggaggacctccaaccagagctggagtgcccttgtgtgtccctaggagggtcacttcaccttcctgaacctccgtttcctgaggtggtcacatctacttggttattaggaagattaactagcagaatgtgtgtaaaaatccacacttgctaagcaagatgatgatgacgtatttatggaatggaagtcatgggctctgcagtctctggatcaggctcatcagcctttcctggtcagaatgttctgcctcacatttacaccacagtctcctgcctctaaggcctggagcagacataattgaaagctttgttagtgttaagactttttcactgaaattgtataaatggtaagtgaaagtagttcatatatatatatatatatatatatatatatatatttttttttttttttgtagagggagattgcaaataattcatagtgattatagagaatttggaaaatactgacacagatgaggaagaaaataaaaaagggctttaattcctccctgttaacattttaatatatttccttccagtattttttctaggcagtaaagtctagtgattaaaaatttaagcactgcagtcagactgcctggatttgaatccaggatccttcattcactttaaataacaataggcctgggtgaa

SEQ ID NO: 120864 - DNA, 1181 bp, Homo sapiens
gacagccagcgaaacatttcccttgtccactcccactgttgttccctacgtgtagctgccttctatttggggttttcaagttctctgtgatcctttagcaaaactgctcttcttgtcggaaggctggcctcagaaatgctggctgggcagtgccagtcaatacaggttcaaattctgattccatattcagaatctgggacctgcccacccaaagggccaaataaacttggtttgctccacaaagaatcctgtgaactgggtgcaggagaaccttgaacctaccccaagaaacccgactgaggttctacagtcttagccgtcttcatttgcattcagtgtttgttttgcaaataaggattgtgctatgaagctgaatctacctaaaagcagtcattagcccttagtcttactgtgtatgctggaaagtcaattctcattttaaaaagatatccagtgcttttcactaatcgggctcctggcctctgcctaagaaggtgaagctttatttatttatttaaaaatgatctttattatgaaaaaactttaaacatacacaaaagcagagaggctagtataatgaactctcttgtactcatcacctagatttagcaattattgagattttgccacacctgtggataatggggcttcttctgtatttgtataataaatatgtgtcgttgattttgaaaaacagtggaactgatagcaatttggtttcatagagagaaggaagaaatcaacgaaaaatcagagagagaggaaatggaggccatcactgaaataactcgcattttgtagttccaaagcctctttgacatatcttatttgtgttctgcaacaaccagagaaggtagatatcctcattttatagctgaggaaactgaggctcgagaagtaaaattggaaaatataaataaatgatcaactaagagtcacctgttcagccagcatccaaagccctgatttaatgccacaatttgaatggtttccaaattttgtgcactctgaaatagataatactatacagcattaaataaaagaatgtggtacagaatatatgtaaaagatcgtggaaaccaggaagatcatctgggtgttttgggcttacaactccaatgagcttagttggaaatactcagatgatttaagcatgtttttggcatgacatttttgaaaac

SEQ ID NO: 120865 - DNA, 1026 bp, Homo sapiens
ggagtgaagggttggctgggaccacgactggagagagttgggaggggatcgtgagggaggagctgcggacagcccgtgtagtcaactctttggcaaaatttgatgatgaaaggcgaggagcagagaaacggagtgggagctggaaggatgtgcacaagggaaagaggttttttggaagtgttggtaatttgtgtgctgatgggaaagatcagtggagagggagtgactgatcaagagaaacgagttgggtcagttgagcaaaaagcccttgagaaggtctgaggggaagatctggcctttgtaagggggtgggggatacttcaggaacttgctccatcatgacagggaagaaaaactgataagggggcagatgctaaggagtgggcaggcaggggactctgtggaggaccgagatgctctgcctccccaggctgaggctgccctgtccctgggaaggagtttgggcttaggacttgataccagccagagactcaagggttaagactgcatcagaaatggtactgcatttttctgaacatttgactgcgttactgagcggcacagaggaaagagtgaattctttagcttggagaaaagagtcttcagttaaagtaatttgggcctcacattaaatttatttgaaaactatgattagaaaaagacttctgtgattttcagccctgttcagagttggtgggtactgtcataggttttgagcaagaagctcaaaagaaaaaaaagcaaaaaaaaaaaaaaagcaaaggctgcctgttgtttaggttgtctttcacaaaaaatatcccatggactaccagcctcggtggttcccagccatggggtctgcatgggaggtgggtggaaaaggagagagtcagagctggattgagatccagctctacaccaaggctctggactagtcgacctccgagcctctctacatctgtaaaaagagggctggtaccatcttcacctctcctcttcaagttgtgagagggaatcagatcatgtatggaaagtgcgatgtca

SEQ ID NO: 120866 - DNA, 1081 bp, Homo sapiens
atattcttttgtgtagatgtgttgtcagagacattatttaactttttcctttaaactttttcctgtaaaactgaaatttaataagctaattttggtgaaagcctctggttatctatggtagttttctttattagcttatttagaatatcaatagagaacagtatatatattgaaaaactattagacctagttttttgtttgctattacagaaactactttgaatattctgttgatgtttggagcagtagacctagttgaacctcataatttatggataggaaattgagaccccattgttcagtaatgttctttgtattaataggatctagttccaaattatttgtatatcttgtcttttaatcttcaatctggaatgtttcctcaatttttctgtgactttcatgatcttgacacttttgaagattacagaccagttattttgtcaatgtcccctcaatttgggtttgtctggttttcgtaattagattcaagttgcatctgtgacaggagtgccacagaaatcatgtgttttaaccctgtcaggtggtatgtatgattttgattagttctacaactggtgatattgatcacttgattaaagggatgtctgcaagacttctccactgtaatgttactcttttcccctatgtgatcaataagtgtgttgttgggaagtactttgagactattaagtatcctcttcattatcaaactttcaatttatttatttatatcagtatttgtggggtctcattattatgctcaaattgtcctagatttggtcaataggagccccttcaagctatctttgttctttttcatatctctatcatcctttgagctctttttcttttcctttccttttcccttctgttttttcttttcttcctggtacaacaagatgtcccaggcaatcttgagctttctcctgccccaaccctgaaatcaaccattttgccaaggatcctggttctttttagtggaaaatggtgtttacaaataagatggtatgtgtgcatgttgctgttggtgttataactctcaggctgtctcaatggagctttattttatacctatctg

SEQ ID NO: 120867 - DNA, 1377 bp, Homo sapiens
gaagttagagtgataaaatatcttgaagagatgcaaagactgggaatacatgcttaacaataaattgctacagcatttagggaaaacagtctagtaacgtgttaaagctttacctcacctaggaatttatctcatagaaatacaagtaccagtaagtgtgtatacagtgtgttcagtacagtactgctttttttgtagtcacagaggactggagacagagacgatgaatgcccttctctgaaggatgttttaataagtccacaccacagaatattatgcagtcattaacagaaaaaaaatcaatgaaagctaagatgcacaaaagcatgtgtagtatttgattttcataagtcaaactaacagatctttagaaatgtgtgtgtaaatatgtgtaaatggagaccatatacaaaaacttactatgttaatatatgttatagagaaaggatggagcagagagtaaaaggaggatccaaaaaaaaataaaaaggagtaaatacattcttaaaaagtgttggccaagcacatcggctcactcctgtaatcccagcattttgggaggccaaggcaggcagattgcttaaacccaagagtttgagaccagcctaagcaacatggcaaaatcccattcctacaaaaaaaaaaaataataacaaaaattagccaggcgtggtggcacacacctgcagtcccaactatttgggaagctaaggtaagaggattgcttgagcccgggaggttgaggctgcagtgagctgttatcaacaccattgcattccagcctgggcaacagagtgaaaccctgttacaaaaaaaaaaaaagaaaaaaaaagatgttgatagatttgaatagacatttctctggagcagatacacaagcagttaagataccacctcacacctattaggatggcttctgtcaaaaaaataaataaatatataaataaaaatggataggcatgcacctatagtctcagctactctggaggctgaggcaggaggattgcttgagcccaggagttcaaggctgtagtatgtgatcatggtacctgtgaatagcctctgggcaacatagcaagactccgtctctaagggaaaaaaagtgttggcaaggatatggagaaattaaaacctttgtgcactactggtaggaaggtaaaatggtatagccactgtgggaaacagtccagcaattcctcaaaacattaaaaatagaattaccatgtgatccagcaattttgcttctaggtatatatgcaaaataattgaaaacaggtttcaaagagatattttacacccccgttcaagcatcataattcacaatagccaaaaggtagcagcaacccaagtgtctgctaatgaaggaatggagaaaca

SEQ ID NO: 120868 - DNA, 1079 bp, Homo sapiens
gatatgatgcagaagtaatgaaagtctgatttcatcagaaacagtgtaatgctgctgtggtttagctccaccagcatacaatgacatcttgggagcttagtagctgttactgcctatttgggctggtaaactgccattgtgctccagaagaaagaatcgatatttatacaggattccacagtttccatagtgaatcaatatctatacaggattctattggtagaaatcattccagttattgttctcatagcagtgttatcttcttgacttcctccagcactgacttttcattataatccttaaacatttggtcattgtggattagaggtgaatctcccccttgttgtttagaattaccagcagttgcagagagattttatggaggatgatcacgagcgagcagtgtcggtgactgctctatctgtccagttcttcaccgcacctactctggtgagtagtgcttgccttttctttgtaactgatagctggcactccttgcctttttttgccttcttaatagaactatgagcgtttgcagagtgattatgtgacagatgaccacgacagagagttttcagtcgcagacctctcggttcagatattcacggttccttcacttgtaagtactgaaagactagaagaactttcttgttttccattaacagaggccttaaaataatagagaactaaagtctgtatattcctgaaaagaatagtattttattaatgggtaatcagacttcaaacaccttcactattcttttactagaatataaccttgaatatcaaagtcatctggtaggggggaagtcatttaaacttaatttatactttctcttcagagtaaaggagagggaaacaatctacaatttttcatagtacttccctgagattttgaactgattagttcacattaagccgattgatttcacaaattatccttcacgttagaattagacagcatattgtacaccgtctcacaatttgagaagtcctcctcccacctccctcccaaaaggggagatgtagctaaggcaattgaatcctgatgattggatggtcttttactgagcttcacg

SEQ ID NO: 120869 - DNA, 1008 bp, Homo sapiens
aataacaagagacctgtccttttcccacacttcagggcttttctaagaaaggtgcctttatgcaagggcatgagggaaggtccatacaaaggaatgagcagttgagaaaacctggaggagtagggtggagcattacctcttggcaaatagaggaaaaccaggacacttgaagatccttgaacctggagtgaaattgtataggtttaagagcattttatagttactttattaataaggcatattaaaaataactgaatttttcaccatattacttttatgttaaaggatatattctaatacagtggaagctgactggagtctgtttacccattaatgagctagtatgataggccaaattaaggatttttgcattttgtcttaaaaacatgagaaggcattaaagaattttaagtggtatttacataattacatttgtgattttaaaagatcatgctgtctgtaatttggagaacaaattggacgaggataaaagtgagtgtgggaaacctaatcagatgctaaagcaatgacccagggaaaaattgatggtaactcgaactgggatgctgaaagtggatatgaatcatgggggatatttttaggtggtgaaatctacagaaccggccaagtgggtttgagggttgttggacttgctgacgaactggatgtcgggtttgaagaagcataaggatgattcgcaagcatctggcttgcagctgagtagatgctgtgccacttgctgaatgattagcatttgtaaagagggaaagtgatgcttttagtttagtcagggttgagttccagaagcctctgagatgatcctgtgtgtattcatatctgtgcttccctccttcattgaaccatttccatgccagtaccacagttgtaataattatttatagcttaatatcccattttgacatcttaaatcccatttcatttgatagcttaaatctcctttcattattattttccaaaatgttttcgcttattcttaggcctttttca

SEQ ID NO: 120870 - DNA, 1027 bp, Homo sapiens
tggcaattggagtaagtaattgttatttagaaatacacagtaatgcatttatgatatatagttgtgttgaaaaaggtttaaactgaaggagctaaacaatgttggtgactttttttttagtcttcctagtacatagtttttgattaccatgcactctgataaactttgtttttaggctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtaagttttcatttaattattaaaccagttgcaatttatagaaagtcaatgtttatgttaattgccactgtcacttttatcttgttcaggtatgtgttaattagcaaaccaactgaatggtcagatgagctgaggcagaagttcctagaagggtttgatgcctttttggaattactaaaatgtatgcaggtatgtaaaaactgttacacttttctttttccttttttttttttctcttttctctttttttttttttttttaatttttctttttctttttaagagatgggggtctcactgtgttgcccagggtggagtgtagtggctagtcatagacacaaccatagtgtactatacctttgaactcctggtctctggcagttctcctgcctcagcctccaaagttgcctgggactagaggcgcaggcacgggcccaggcccagcttctttgttgttgttgttgttgttgttgttgttgttcattgaaatgaacagctttctgtctgcgcatcttttcatttcgtgcacatttccaaaagatcaatttggatggctgcaattctgaccaggaagctcctctttaattggaaattcttagaaaggtatggagcaaaggagatcccagcaaacattccggcatctactgctcttgggttttttctgtgttggttttttttgttttgttttg

SEQ ID NO: 120871 - DNA, 1014 bp, Homo sapiens
ttaaaagcttgtcacatttcttttaacaattttttctatagaccatagagctaaaaaggaaggattattgcagtgaaatattgaagtattttattgcctaaaacagatcttagatgatacctctgaaataatgtgtttattgggatttctaaatttatattttagagaatgttatataaacacataattttaaaagctattatttctcatagtacttgaagtttcctgttaaaacttataccttctatgtttttataatcaatatatatttctcctacattacttcttaggtttccatataaaagaacaactattattttcattcatatataattttttcacttccgttaagggaatggatccaattacacgtcaagtaggacaacatattgaaatggaaccagagtgggaagcagccttcacactacaaatgaaattaacacatgtcatttcaatgatgcaggactggtgtgcttcagatgtgagtttcttctgggtgcggggaataggaggaaagtggaagagggaggaataagcagaatcctaagtaaatttcaaggagatctggagaaaatagtggtgatacttagttcattaaacagcgtattttccttctccacctataaactcagtaaaattttaaaattctacagcctgaggaaaaacttgaaaaatagagaaagaaataatccagattgtctcttccctaatgtaactatctttgttttttttccataatcccttctagactttgaggatataaaaatggtagtttctaaatttattcaaaaataaagttttattattggtacatttgtcctgtgtcttaaaattattttggccttcctttggcgataaagtctagatgagagcctgtatacattatgaggttagggaggtttctgtaaggtctgaacaatctgtaaaagttaatggaacaatgagtaaatgatattcctgactgagaagacagctgcattatagtctgtgatgacagggactagggtagtccta

SEQ ID NO: 120872 - DNA, 1051 bp, Homo sapiens
tttcagtacagctttcatatttcttgattctaggtattcttttcttgctcgcacactgttgttttctttagttccgttttaactcagagaacagaaagaaattttgaaggtatttttactcattgtaaaatatgtagtttatgttaagtttgtggctcagtagcttaatgtgatgtgagggtatgttttttgttttgttttgtttttttctggaggagattgtagagagtttgtttcatttcttccttaaatgtttgacagaattcaccagtgaagtcatctcatctgatgctttaggttttggaaggttattaataattgactcaatttctttaatagatacgggcctgtttaggttatctttttctccttgtgtgagttttggtagtctgtgtctttcagggaattgatccatttcatctaagttatcagatttgtgggcctagagttgttaatattccttcattatccttttaatgtacatggggtcagtagtaatgattcctctttcattctgaaggcattttttttcattgttctgagacctatcacattatcccactgatagacccttgccatgggtatattattgaagtcatggtaatttaagataattacttactctgaggcttataaagttgttattcctagacatatgaatatcaaatggtacaatagaccattacctagaatgaaatcatgatcgtaagaagaaatctctcttatttctataacttgttcaggcccagttttgtttttataagtgttttgagcaactgaactgtcaatcctcaacacaggcaattgatggcatggtgttgtggaaaagtattggacagaaggcaagaaagtgaggcatgcgtgtggaagtagcacgcaggcgcagcgtggcatgccctgcacgtgcccttaaaaaaaaaaaaggcaagaaattgagtaatgagtcctgtctccaactgagccactgatctcttctgcctttaaaaatcagagtgagactctgtctcaaaaaaaaaaagtctaattttatgggaggaagctgatgctgata

SEQ ID NO: 120873 - DNA, 1038 bp, Homo sapiens
aattaataataataataagcctcttatgaatatagatcattttctatcttaattggtaatttgataggttcccaaagagaaaagaagttagatataaagttgagtgaatatttagggtatttttcctaaatgatttttactgatagaaatactgttttttgtttgttctttcatgcaggtttacatgtattattaagcaaaagtgaagtggcatataaatttccagagctcctacctctagtaagtggtgcttacatttaaaagtgaatacttatttattatgttctttgtatttggaatcactttgaaacacatttttagtttgggttctccagaggaacagaaccagtaaggtgtgtgtgtgtgtgtgtgtgtgtgtgtgtgtgtgtgtgtgtgtgtgtgtgtatagatacatatatagagagagagagacagagatttgttgtaaggaactggctcatgaaattgtgggggctgaaatctggcaagtctgaaatatgcaggggagcctagcagactggcagactggagagacccagggaagagttgatgctgcagtcttgagtacagtggctgtcataaaggcagaattccttcttccatgggggacgtcagtcttttctcaaggccttcaactgaactgatgaagcccacccatgtttggagggtaatctgctttactcagagtctatgatttttttttatttttatttttttgagacagagtctcactctgtcacccaggctggaatgcagtggcgcaatcttggctcactgcaacctctacctccatggtttaaggaattctcctgcctcagcctcccaagaagctggaatacaggtgcctgccaccactcccagctaatttttgtatttttagtagagacagggtttcaccatgttgcccaggctggtctggaactcgtgatctcaggtgatccacctgcctcagcctcccaaagtgctgagattacaggtgcgagctaccatgctcagccagtctatgatttaaatgttaatcatgtgtaaaaaatacct

SEQ ID NO: 120874 - DNA, 1450 bp, Homo sapiens
tctttctgaaaatgtcttgcccatcttttttgcttgttaaacattgttttctgttaactatgatgattgtccttggtggaatgaatatttaaatgtaagctttcctagtgaataacctcctattcagaggaataataaatatgttaacacagaaatagtttgtgctaagtcctctgggttgatgttatctcagatcttaagacctttctaggggaaaagatagactttcttctgtactgctgctactttcgtggctctttttatgcatttgaccttgagaatgtaaaataatagctttaaggtgtgtgttaatgaatattctttgagttaaaactatcaaaagtaacaaagagatagtttctaaagcatgttctgtaaaagaaaccaataataacaactgtattttcagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtaggtttgaagacatttattatttatattttagtattttatagtacaagcaaaatattcttgtctgtatctatacacaggaaaactaggccgaaatgtattgtgttttcctaacttgaatatattgttactgcttttgtgtctgacagtaaaaacaagtgccagacagatttttttataccacatggttgttattacctcagtcccactgggcagttgttctctcctagattggtccttgtctttatatatgtagtattctgatattgatataatgtgttatcttttatatatgtttctaatctaattattttccaaaacaaaaattttttttgaatcatccatatccttattttgtagttgaagaaactgacactcatagacttacggtcctatagctagttaagtggcaagtctggaaccttgtttgtgttatttttgtttttgtgtttttgagacaggatctagctttgtcacccaggaagctggagtgcagtggtgcaatcttggctcactgcaacctctgcctcctgggttcaagtgatcccgccacctcagtatcccaagtacctgggattacaggcatgcatcacaacatctgcgtaatttctgtatttttggtagaaacagttttgccatgttccccaggctggtctcaaactcccagactcaagcaatcctcccccctcggcctccccaagtattgggattacatgcgtgagccactatgcccagccccttgtttgtattttactttatagttttaatgtaagccgttcgtacactatctcattgaattcacacaacaccccatgaatagatacaacttttttctcattgttagatgaggaagccaagtttcaatgaggttccattaacttcccat

SEQ ID NO: 120875 - DNA, 1068 bp, Homo sapiens
ttttgttttgttttgttttgttttgtaatgcagaaaaatatgatccattattcatgcaccctgatctgtcttgtggaacacacactagtagctgtgggcacattatgcatgcccattgttggcaaaggtaatgtatattcttaatatttgtcaagagaagtttatctaagggctcaatattttttaaatagaggaaatttcattctagaaaaaaggaaaagaactaaaaatgttgaaaaaatccgtatcattgcctaataaataacaaaagttatttgccttgtcatagatgtaaagtgtatgtcagatatgttttttaatttagctttatatccaagtctcttctatatcttccaaagaaggaagtggatctgtatcagtctgtggatgaagaaaagggtttttacagtaggataaactctagaagggtaatgttgtctttctttgggtccagggtggacaacttttgattccatagatgttagtacttgctttgttacttcccaaaattgtaatggctccctgtgatgagatgtcctgaatttgttctaccttggtgtttcctatgcttctacaaaaccaacaaatcaataatactattattctagaactatgctcacccagttatcatgaactacccctaacaactagccaccacattgtagtcccagctacttgggaggctgagacaggagaattgcttgaatgtgggaggtggaggttgcagtgaaccaagattgtgcaactgcactccagcctgggcgacagagcaagactccatctcaaaaacaacaacaacaacaaaaaaaaaacaaatagccaccagccttggggaagtggcaagagaacaatgacaccaagaaatttttgttgctgctttgtgaatgcttttttacatggcagtctttttttttattttactcttttagaacttttaatccatttggatttttaaaatcactcaaaaatcatgttaaaaataatttagtttaagattttcatttttgaactatttgtggaaacaaattattttaaatgttgaagcttatggctgtcatttatgtaaat

SEQ ID NO: 120876 - DNA, 1029 bp, Homo sapiens
gctttttaattataaaagaatatcgtggtactgacttatctgcatttgaactgatgaagaaattaattattgttagatggaggattaactgtgtataagaagaaatcacccttgttggatttcatctgtcactttattggtccaatttttgggttttgcccatgagattcaattatggtttagtcatattcgaatacaatcataaaaagaacacaggctttggaatctgacagagccaagtttgaatgctagctttgtcccttattcggccttagtcaagttacatagctctaaacctcagtttcctcatctgtaaaatggggacaataataaaacctattacaaaatataggaatacaacctatgcaaataataatacaacctgaaacaaaatgtagggatattttgaggattaagtctaataccataagatatttacagtaaaattccttactaagtgcttgtaacataataagcacttggtagatattaatagtgatggtgattatgatacttaagaaattctagcaaattccaatactgaagagtgagatttttaatacacagtgttattaccatcatattgacaaataatatattcctttccattggccaatatcctgattttttttaatgcaacaaattttcccttatcctttttgtttttaatatttggagtgtgtctaaaatatgcctgtgatcatttaaggagtcttttgtatcttaaggaacaataataaaacactaaatactctctataatcttttctagcaggttaaatttttcagaccaaccaaatctgactcagtggattagaacaatatctcagcaaataaaagcattacagtttcttaggaaagaagaaagtactcctagtaagttctggtaacctgttttcatttttccctaaagtccgaggtcatcagaaaatgtatttccagaagaagttgtttaaaagtgaaacctcccatttaaaattttgactcattctaattttccttgtcttaataaactaaatttgactttact

SEQ ID NO: 120877 - DNA, 1007 bp, Homo sapiens
tatactattacttctattttctattactactttttttttttcttttttgagacagagtgttgttcttgtcacccaggatggagtgcagtggcacgatctcagctcactgcaacctctgccacccaggttcaagggattctcatgcctcagccttccaagtagctgggactacaggcatgcaccaccatgtcccactcattttttgtatttttagtggagacagggttttaccatgttggccaggctggtctcgaactcctgacctcaagtgattcacccaccctggcctcccaaagtgctaggattacatgctgagccaccgcacccaggcttgtaactctgttacttctgaaaactgtaagatactctctttatctcttcagtgttccgaaattttctatgatatttcttggtatatgaatctttttttattcattttgctaggcgttcagtaaacctattgaatctgaacattcatgtccttcatttctgagaattttttatgttgtttcttaaataattttctcttggattttcttctttgaggtagttctgttagctcactgttgcccctcttgaactgataacctaattttcttatgattttttttgctttctacattgtctctgttttccctgagttctgtttctctgctcctttgttttggtttatctctttgatgctttccttaaatgtttattagtccttggataactatttaagcataaggcaatgagcataaggatacctggtggacaggttggagcttgctgacttgtaagcctcacaataaggtgatcaggacacctccagtcttttgcttggtgacccccgaatgtctgtgtaaaaacaactttcccctgaggattgttcactggaaaaactaatctctgtggaagtgggtatacattgctgatgttctcaggatgggaaacagggtcaaggatctcattgtgtagtgtgtaggcttgtgcccagcaccctgttttcagccctgtgcctcacc

SEQ ID NO: 120878 - DNA, 1051 bp, Homo sapiens
actaaaggttcatcccaatgaagaggatcctcgtgttcccataatgtgttggggtagctgcgcgtacaccatccaaagcataggtaagagatttacagctgtttctctataagtcacaagcattcattgatatgaattaggcatagaatcttgtttttaaatgaaatgtttgaagtgggtaacaacgtgaagaaataataaaaagacttagaagcaagaaatgtaatgtactgacaaaatactagattgatagttcataaattaaccacagcaacagagaactcttggtggtggtggttatagcttcttgtcagttgaaggaatgtactgttcgtttttactttgtaaccaaatttaattcttgtgaaatgactttgaagattctgaaacttgacaatattgtactttctgtaggattggggtttttttaacctttttaagaaaattatattaaaatatacataacataacatttaccattttaaccatctttaatctgtagaaagaattttgagtgatgaagataaaccattgtttggtcctttaccttgcagactggtaagttctcagtttattcagttcatgatagtggggcatggaaattaggtggttctgctgcttttaatcttatggacctgcagtagttacttacaccttcacttctttcgtagtaaaaacccattttctgtaaggatattaaaaagtaatgtttgtggtttaatctttcttttaaataaacttcaggaggccgggcgcagtggcccacgcctgtaatcccagcactttgggaggccgaggcaggaggatcacctgaggtcgggagtttaagaccagcctgaccaacatggagaaacctcgtctctactaaaaacacaaaattagccaggcgtggtggcgcatgcctatagtcccagctactcaggaggcagaggcaagacaatcgcttgaacccgggaggcagaggttgcggtgagctgagattgtgccattgcactccagcctgggcaacaagagtgaaactccatctcaaaaaaaaaaaaaaaaaaaaatt

SEQ ID NO: 120879 - DNA, 1018 bp, Homo sapiens
tccgcatcttggcttgtttatttgttttttgagatagagtctcgctctgttttccaggctggagtgcagtggtgtgatctcagctcactgcaacctctgcctccagggttcaagtgattctccttcctcagcctctcgagtagctgggattacaggtgtgagccaccacacccggcctgcactggcatcttgggagtgtcccttgctttctgtcagatgcgtatattctatattcttttcttttccagagaaaaccagcaacatggtggcaaagagatagatttcatttattcagcacacacttagacatttcccattccatttatcctgtgttagaggcatgtcattgagatgtcatagatctagttccataccatctagagcagtttcattgtgcatccagctgtgctctgaactagcattcctgaaagagaactgctttgcatttttgttttttgttaattgcgttggtttattttaggatgactgtcttaggtcattgacgagatttgccgcagcacactggacagtggcatcagtttcagtggtgcaaggacatttttgtaaactttttgcatgtgagtattaatacatttataacatgttgtaatttttcatcctctgaaattttgtttttaatggtacagcttctctcagtaatgaattaaatatttagtagtactggttttcttatatataagctctagcttataaattctcatgtgtcttgcaagaagataaatttaaagcagattatatgcattttaacatgttggcatatgaaatatgctaatgtatttctctttaaatctgtagcactggtgcctaatgacagccatgaggaacttccatgcatattagatattgacatgtttcatttattggtgggtattgtgcagtttgtttggacttctacgtcatactatgtaactttaccttaggtttggtgagcagtgtagtggcagacaggaaggagttatgtgatttccttaccccttctgagtataattcttttatg

SEQ ID NO: 120880 - DNA, 1050 bp, Homo sapiens
ctgcgactacaggcacatgccaccacacccagctaatttttgtatttttagtagagaagggcttttgccatattgcccaggctggtctcaaactcctgggatcaagtaatcttcccgcctcagcctccgaaagtgcagggattacaggcatgagcacctggccaaaaaagttttatttttaatatgaatgttctagctccagataatgttagcttggcattaatacaaattaatatagactagtttttctagagtatccaaattagtaagataatgatgtttatagtcacaaattgtatatatttaagcattcttgcttttagaaaatattctcctgattttaaaagttgtaggcaaaatagtatttctacaggtttcttttgatgaagtaaatatgttaggtcaagaatattattttcctcttattggctatggaggggaaaaaattctagttctaaccctttaaaagtgttttgtgtttttccccctctgtttacattaaagttggtgccgtaacagtgaagttaaaagatatctagaaggtgaaagagatgctataaggtaagttaaagagcctcaaaaactttattgaggtgggagaaagggtggaatcaggatataagtgctatattccttcagaaactgacttctcaagcctttagtgattccaaaaggttaagatatgttgccttcatattttcttcttaatctaatgagagtctatcaaagtcagaattatgaacataaatatactacattcttggcagagaaagcaaataacaaagttatattttaggatatttgctttaaaaaatataacacgtctcctaggtttttcttagctctatttttttctatctttcattatgggaaaactctccagaagtgtgaagagtaaaataatgaggctccacatacttgtcattcaccttcaataactatcagtcaaatcatggccagtcatttcttataattattttttcttcatttctttttacattctattctgattctatagtaaagtgtgctctaccagatcctaacaagatg

SEQ ID NO: 120881 - DNA, 1011 bp, Homo sapiens
ttttactcctataattcttcttttgtgttctcctctgccctcttccctttttacacgttaccaacaaaatgggcaatgaattggtagttttagcctctcaacccagaccctccttatcccccgcaacctctattccctcacctcactctgggtaagtctggtttgtgtacctttccttcctcatttcagcacttattcccttttacctgctcttggcaaagggtcagagctgatgtttttgttaatagccacagtcacctgccagacagaaatgttgcagggagtctaaaaccaataacttgtaaccttgcctaaatcaggaagggttgggttataatagaggaataaacagaacacattctgagtgacatgtgtcttctctttctagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggtt

SEQ ID NO: 120882 - DNA, 1657 bp, Homo sapiens
gctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcattacttttggttagcatatatctttctgtttcattttacacatttacctgccacagcaaggtgcccgtgtcaccttgctacaaatatagtgggatatctgtattagctttaaatttaagagggttatattattatggccactagccaaactatcttgaccttctcagagaaagtgtgatcatcatttcagctgattaagtttcatattcattagccatgacagcgtgtgacctttgtggaccattttggaactcaaatcactgggaaacagggcactccaagacctgtgtctgggtttaaactcttgttcatccttacctggtgatctcaaggtccttgtccttacacactcccctagtgtgctggctggtttttcagggctgttggaggttttttttttcttttttttatgaccacttcctgcttttgagagagagacatagaaaggcagctacactgtcttcctag

SEQ ID NO: 120883 - DNA, 1256 bp, Homo sapiens
gcaaaggaagcagtaattaatctgtcagagaagggagggctccttcctgcttccggaccatgttggatgtgagtctagatgcgagacatctattatagagataatagaagaggttagcggaaccaaggatggttcacttttcttctttagaaataccattaatgctgatcgtcttcgccgccgcctgcgtgctcgccttcgcgcccggcccggcctcgccccggtcttcgcctccgcctcggccgcagagcttgccccctccccacccgcagacaatgtccgagtccaagaacggccccgagtatgcttcgtttttcgccgtcatggcagcctcggccgccatggtcttcagcgccccgcgcgctgcctatggcacggtcaagaccggtgccggcatcgcggccatgtctgtcatgcggccggagctgatcatgaagtccatcatcccggtggtcacggctggcatcatcgccatctatggcctggtggtgacagtcctcatcgccagctccccgaatgacgacatcagcctctacaggagctgcctccagctagcgccggcctgagcgtgggcctgagcggcctggcagccggctttgccatagacatcttgggggacgccggtgtgcgagccacggcccagcagccccgactattcatgggcatgatcctgatcctcatcttccccgaggtgctcggcctgtacggtctcgtcgttgccctcatcctctccacagagtagcccctctccgagcccaccagccaccgaatatgatgtaaaaaccacccctcctcattccagaacgaagagcctgacacacacgcacgggaccgcggcccccagtagttgatcttgtacatgcgcagcgcagcgtcctagtgccggttgtctgttgccctggccttgcccccaccccaccccccacgccgccccgtgccatggacatctgggtccactcatcgcccctccaggcccccggtgccccaccccctagagtgctctgtgtattcggatgacttagagttgtcatttctcttcactggatgtttatttataaagatctggcctgttcccgcgtctgcggagaggccctggtctcccagctgtctataaccttagctagagtgtggccttgtgggctcctgttgctgagacctcctggatggagctgccctcgccaccgggcccttggccctgcacggagctctgtccaataaagttctcggatttggggggaaaaaaaagaaatgaccat

SEQ ID NO: 120884 - DNA, 1058 bp, Homo sapiens
gcctctatatctgcatccccacccctgtgggggtggcggggggtggtgggggggtcctgtctgaagtggtagggaaggagggttttgaggtttttgactatttgcttgcaagtatctaagtaagagatttgtttgcccacatttgcactctcttggctagcaacccgacaaaatattttctgatggtttttcgtgtatgtggtttttgtttttgagggagagaataattaacaccttggttaaattgtactgagatacaatggctgtttttaaaaattgctgttaactgaagggttgaagctagtataattcccaggctcagcctcttgggaggctgagtctccaatagcatagtcttcaatagactatgctgtgaattgtaatcagaaaagaaaaaaaaattagacacgagcaaaagcaattaaagtatttattctccaatattcgcatttctgcatttgtcagcagctgtggaactgtcacaagatatgctgatttggttgtggtatgtgcctgtctggggaggggaggaggaggatgaaggcagactgtaaacaaatcattattgtaaagtgatcagtgggtaatagaggcgtgtatagagtgcatagagaagggactcactcattttaagcaatgtttttcaaatggggtcacctccattagtgaatcatgaagtcctttaccaagtgcctaacagcatttgaaaaaataaagacaatatagaatgaaatacatcaagatgcatcctccatagtaggtttagatatttttttttcaaaaacctttgtttcaattatatatctactgaattacaatgtgaaatgtgtttcttgggattgagtctcaagcaaagatgtttgaaagccactgagttaggcgacgggagaaggcttcccagaggaggtggcattggagctgggccttgaagaatggtggacttgtgccacaggaaaagggaattccaggcagatgggaaaggatatgtccaaatctggatctgtttgttcaggggcagggtattctctgtaaagggaccacagggtactaggagagga

SEQ ID NO: 120885 - DNA, 1979 bp, Homo sapiens
attctggagatgggactggggtcgcgcggccttctccttccccacgcccccagacccaaaagacgaggccgccggctcggagcgggaagggctggggccagcttcttcctcctaaccacttgtttgtgatggaagaagggggctgggggtcgagcctcgcggctgatgggttccctccctgaccccgcacccccactcctcccagtcgaaattggaggtgaggcgctcctgccattttctctcctgcggtctgagagtggacgtctttgtcttctctggcccggcgtgggggcagggcattgagccttttccttaattcttcagttattgaaagtagagtccaaccaggttacaaaactaaaaaaaagagtccaggacattgtctgtctgccttccggtagcatggttctctgtgggtaccctacgcttcgtttcttagttttactctaaaacaaccctgaggagacatttactagttgtcagattacgggaaggtgatgggttccagttttttgaaactttttttgttggctttcatattacttcaaatggcagtgaattaaaacagtttcttagaactctaatctgaaaagttaaatacgctttaaaacagtctgaaactcttctaaaaagcaaaactgcattattaaaagcatccatgtaagtatctgttggtagtatctattagagatgggggaggggtttaacttttacattattattgaaaagaggaggggaaaggtctataaagctctgatctctctagaagtccacatacatggaaagtaaatagttaatttctagtgtagaaaaataacaccgtggtgccagtaggtgtgtccttgtgtttataaatatacatagtggatgttttagaccatttaatgagacctattatatattgaatacctgctgtatgccaggaactgtgcctgatgctttgtataatttctattatatcagcccagaaatagtgattttatgatctgtctaccggggaatgaactaacgttcatagaagtatagtaattgttcgaggtcttgcagttttaagtagtaaagttgccattggatcacaaaagctgtattcttccccctacacctatggtttccaaatgtgagcatcagaattaatttgggagatgtttttaaatagagatttgtaacatcacctcttccaccatcatttgctagggccaactgggtcttttaataatgtgtcaggcactccaacttcttgatgttcaatattgacattctggcccaccctgcacccgctatatccaaagatctagtattccaaagctctccaggtgattccagtgacacagacacacgtttggactgtcttgtactatgctatgcactgttctgctcttttttgaattggaacatgagaattgaggtccatgtaattttgagtttcagtagttttttgctcacattagtctcatttttgtttttcctcttgtagctgccatttatcaaatcgaaattatttcctcagagaaaaaggtttaggtatcctaagactttaaaatctcagtacgtttttttttaaagtatgttgtctcattctattgagaagttatacaacatacaggcttctaggtctagccaggccatctagtttagtcaagacagctgtgtaacaaacgtagccttgaggcctggcacggtggctcatgcctgtaatcccagcacttttgaggctgaggcgggcggattacctgaagtcaggagttagagaccagcctgtccaacgtggtgaaaccccgtctgtactaaaaatacaaaaaagctagccgagtgtggtggcaggtgcctgtaatcccagctacttgggaggctgaggcgagagaatcacttgaactggggaggcagaggttgcagtggcccgagaccccaccattgcactccagtccgggaaacaagaacgaaactcccatctcaaaaaaaaaaaaaagaattgaatccag

SEQ ID NO: 120886 - DNA, 2071 bp, Homo sapiens
cttggaggactggaagttggtctgggtgagtcagtgagtggtgaaagaatgtgaaggcctaggacactgtgcactactgtgaacttaataaacaccatacacttaggctacattaagcttataaaatatttttccttcctcaataataagcttagcttactgtaactttttttcttatgaacatttttggtttttttctgagacagtatcttggtcacccagggttgaagtccagtggcgtgatcatagctgcagcctccatctcgtgggttcaagcagccctctcacctcagcctctactgagtagctgggattacatgcatgtaccaccatgcccagctaatttttttttttttttaaatgtagagatgagttcttgctatgttgcccaagctggtctcaaactcctggcctcaagcagtcctcctgcctcagcctcccacagtgttgggattacaggtgtaagccactccgcttggcctagatttcatttaaccctgagactttttagaagtgcaaataagtatatttagaaattgatgctgagtgtggtggcttatgcttgtaatcccgcactttgggaggccgaagtaggtgaatcacttgaggtcaggaatttgagaccagcctggccaacatgaagaaaccccatctctactaaaaatacaaaaattagccaggtgtggtggcaggtacctgtaatcccagctattctggaggctgaggcacaagaattgtttgaatctgggaggcggaggttgcagtgagccaaaatcgtgccactgcactccagactgggcgacgagagtgaaactctgtcacaaagaaaaagaaaaaaaggagaaagaaattggctggctggtttattttatttattttttgagatggaatctcactctgttgcccaggctggagtgcagtggcacaatctcagctcactgcaaactccacctcccgggtttaagtgattcttgtgcctcagcctccccagtagctaggatttacaagcgcatgccaccatgcccagctaatttttttttttttttttttttttttttttttttttttttgagacagagtctcgctctgttacccagactggagtgcattggcgtgatctcagctcactgcaagctctgcctcccaggtccatgccattctcctgcctcagcctcccgagtagctgggattacagacccagctaatttttttttttttttttttttttttttttgtatttttagtagagacggggtttcactgtgttagccaggatggtctcaatctcctgacctcatgatccacccgcctcggcctcccaaagtgctgggattacaggtgtgagccaccatgcctggctgctaatttttgtatttttagtagagatggggtttcaccagttggctagtctggtctccaactcctaacttcaagtgatccaccagccttggcctcccaaagtgctgggattacaggcgtgagccaccgcgcctgaccaggttggtttattcttattttccatttgtattgtgattctccaaatctgtgagagttttaggatggagaaatctgtgaaagtcaaccccttttctctaggtgtaatcacacaacatgaaggtttacaactgggatgtttttggcgctacttctatgcgtaggcctcaagatgacttttttttttttttttttttttttgagacagggtcttgctctgttgcccgggctggagtacagtggccccatctcagctcactgaagcttcactagtagctgggactacaggtgcacaccatcatgcctggataatttttgtatttttgtagagacagggtttccccatgttgtccaggcttgtctcgaactcctggacaagatgacatttttatttttatttttatttttatttttatttttatttttaaaatgtaaaactatgttacttgtttataaatcagattaaaagaaaaaatttgagacaggggctcgctgtgttgcccaagctggtcttgaactcctgagctacagtcatcttcctgcctcagcctcccagatagcacggattacaggcatg

SEQ ID NO: 120887 - DNA, 1053 bp, Homo sapiens
aggtattttaaataaaaattaaataataatcataggtttagtagagaaacagagacatgattaacataggggttgtaattcagtaattctttttttttttttccttttgagacagggtctcactctgtcacccaggctaaagtgcagcagcacaatctcagctcactgtagcctccacctcccaggcccacacgatcctcccacctcagcctcccaagtagcggggactacagtcacacaccaccatgcctggctaattttttgtgtttttttttttttgtagagacagggttttgccatgttgtacaagctggtctccaactcctagactgaagtgatcctcctgcctcagcctcccaaagtgctgggattacaggcatgagccactgtgctcagcaagtaattatttattaaatttatttcctaataaatcccaggaggcagaagtgaataataataggaaatggcacaacatcaaaacaaaaacaagattaaaaaaaaaaaaacctactaatagttttaaaatagggagaggattttactcaggtaataaatcattttctttctactctagtaaaaattagttctaaatatagatagtatatttgtttgttgttttatctctttttttcctctcttttctagagacccacaagcattgaactattttctacatggacctagtaataaatctgtaagtaatgcatagaataccacagacatctattttgtttctgctttacagttaaagtagtaaccacctattgaatttgtatctttgcagagcaatgatgacttgactaatgcaggatattctgcagccaattcaaattcaattttcgccaactctagtgtgagtattggaaactaaatgcaatgattgaatggtttctgtctgattgatgccttgtgaactgagcctttaactgcctttgtatcatgagaatccttaccttgtctgttgtaattaatttaattttatttatttattttgagatggggcctcactctgtcgcccagactggagtgcagtggtgcgatcacagctcactg

SEQ ID NO: 120888 - DNA, 1057 bp, Homo sapiens
aaatatcagaataaggtgagcagtttagagagttatgcctgagaagcagactgtcatgctttattcatattcaaaagtaagattggccaggcgcggtggctcactcctgtaatcccagcactttgggaggccgaggcgggcagatcatgaggtcaggagattgagaccatggtgaaaccccatctctactaaaaatacaaaaaattagctgggcgcggtggcaggcgcctgtagtcccagctactggggaggctgaggcaggagaatggcgtgaacccgggaggcggagcttgcagtgagccgagatcacgccactgcactccagcctgggtgacagagcgagactccatctcaaaaaaaaaaaaaaaagtaaaagtaagattaatttttatgcatccttttcaaaggttacatatgccatgtaacatactgtttatttttttagaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcataga

SEQ ID NO: 120889 - DNA, 1013 bp, Homo sapiens
caaaaaaaaaaagaaaagaaatattacatagaaactacacagaggaccaggcacagtgtctcacacctgtaatcccagcactctgggaggccgaggcaggtggagcactaggtcaggagtttgagaccagcctgaccaacatggtgaaatcccatctctactaaaaatacaaaaattagctgggtgtggtggcaggcgcctgtaatctcagctactcaggagcctgaggcaagataattgcttgaacccaggaggcggaggttgcagtgagctgagattgtgccactgcactccagcctgggcaacagagcaagactccatctcaaaaaaaaaaaaaaaaaaaagaaactacacagaaagcaaataatttctgtgtttctgggtgtcccgggaatttaaatggtagctgacctaaatactactatttcaactaattgtgtacccaagggtatgttccttaattttaataaacctggggtttcacttgttcctgaaaacttatagcggaaacacacttgaacacctgaaataatgcaactgacctagttcccaatgctttttggcataaaaagtcagctgctttgaagctgctagtgtaggcttctttttacctttgaataactgaaacttttgggagtcagagagaaaaaggtatttttctcccccctccctttgaagcattatttattatatagcaaagaagaaaaggaaatgaccatgctatggatgattgcttaattaattataataaacataaagctgatcaatacatacatatataaaatgatcctcaagttctatcattaagtgaaaacgtctatggcgtgttgcaggtaagtatgtgtatgcactgtgcgtgcttgtctatgcagaggatagctctgggggaatacaaagaacttacagtgaggcttctggaaggaaactggaggttggggaaagacttgtttttcactctagactactttggaactgttttacattcttactaattaactgcacattttttgttt

SEQ ID NO: 120890 - DNA, 1007 bp, Homo sapiens
ggtgcatacctgtagtcccagctacctgggaggctgaggtgggaggatcacttgagcctgggaagcagaggttgcagtgagccgagattgtaccaccacactccagcctggacgacagagcacgaccctgtcaaaaaacatgatgatgatgatgatgatgatgatggtgcatttagagaggaggtaggcattcaggctttaaagtgcaaactgagtccctctcaggaaccgattatacacctttctgtaatcttaacacagtacaactttgtttcatggactctgtgtactggtttttttttttttatttttcagcagggcacattctgtagtcttagaatatgttcttgataggtagttgaaaatatgtgaactatagtgacctttatgtataactgtattcttttttctataaaagggaataataagaggtttgttttgtctttaggtggagagtcattcgggaggacaaaaaaggcctgctgcgaaacagctaacgaaaggagctttgtgagttactctcggaaatgacaaatcaattctgaacacttctttgggtccctagccttcaataaatataccacagaaaacaggttataataatgagtatattagcctttttaaaaatgtactttgaggcaaggcatggtgactcactcctgtaatctcagcactttgggagtcttaaggcaggaggatcacttgagcccaggagtttgagaccagcctgggcaacatggctctgcaaaaaatacaaaaattagccaggcgtggtggtacgggcctgtagtcccagctacttgggaggctgaggtgggaggatagcttgagttctgaggtggagcttgcagtgaattggagattgcgccactgcactccagcctgggtgacagagcaagaccctgtctcaaaatatatacatatatactttgaaaatctttttctatactttcttttccttttttttttttttttttttttttttgagacagagtcttgctctgtcg

SEQ ID NO: 120891 - DNA, 1018 bp, Homo sapiens
ggaggccaaggcggatggatcacctgaggtcaagagttcaaaaagatttctaagatacattattaagtagaggagaaaaaaatacagaacagtatatatagttgctactatttgggtacaaaataaagaagtatatttctttatatataaatatatttatagtacatatatattcttatgtgtgtcagaaatatctccagaagagtactgaaaactactaggcaggcagatgcctccagggagaggcactgggtgatagtgggtgcacaccagggagaggcaaagaaaggaggctcacttttcacatgccctgtagtatcttttgaattttgtaccaatgtgtaaattattttttccaaaagcaaccattttttaaaaattgtctatgaaatgactggcctctctctttttcagcgaatcaatccctctgctgagatggtgatgatcgataggatgttcaaccaggaggaaagagcttccctgtcccgagacaagcgtttggcacttgtagaccctggtaagaaacatcgcagtgaaagtagtggatagctcctgccatggttcagggaccatggggcctttggcagtctgtctgaactttgggtaagaaacttgaaggtagaacgtgaattctggggagagctgggcacggtggctcacacctgtaatcccatctacttccttctcctctttggcctgcacagccaatgtttgttggatggaatcatctttttagatttcaaggctatattccctagaactcacattttagaatttggtgaacaaattcatgttcacactatacatacatactcttcgttgttttgtagatgtcatcaaagctctatttcacttcgattatttccagcattaacactttttccactcttgtgtaacagcagtctgcctgcctccatctgtaccctcaatgttctaaatcctcatggacatttcttttttttttttttttttgagacggagtatcgctctgtcgcccaggctggagttcagtggcgga

SEQ ID NO: 120892 - DNA, 1025 bp, Homo sapiens
ctccgtctcaaaaaaaaaaaaaaataccacaattaaatgggcatggtggcgggcgcctgtaatcccagctactcgagaggctgaggcaggagaattgcttgaacccgggaggcaaagtttgcggtgagccaagatcgtaccactgcactccagtctgggcaacagagcaagactccatctcaaaaaaaataaaatgatacttagagatcaggactgagtgatgctttttgcccatcacattttcccatttgtcatcaagcatctaccttttcaaaaggtttaagctccccatcttgaagctggggctccacagccttggctgcctttacaggatgccctctcaggatcagggtcctgcttctgcatgttcctgtatgtgaagcagatggattctgtgagtggggctggctttgccctcagcacctgacccactgaagttctgctgtatagtctgtcctctcccaatcactcactaatgttctttttgttcccatttccagagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaag

SEQ ID NO: 120893 - DNA, 1030 bp, Homo sapiens
ttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtc

SEQ ID NO: 120894 - DNA, 1911 bp, Homo sapiens
cccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatgtgcaactgtgattgtcttgattttgcaaataggaatggctacttttcccagaagaaaagggtaagtgttcaatgggaattctattttaatagatttaccaataccaaaatcaatttaccccagtcagggaagggataggattttaattgattggcctttccaaacagtta

SEQ ID NO: 120895 - DNA, 1698 bp, Homo sapiens
gctagaacagacgtctctatggtcaagtaaacagagcgtgtgctgtcttccccatgtggtggggttgcgcatgatcagtagctgcaccactagaaagatggcggagcaagagtgagtgtttggggctttgaatatctggagtggggtcttgagtatccggtgccatccacggtgtttatgccttggtggcggattcctgtgggctctaggaatagaaaaggccacagtttacaaagggtgggggtgaggaggagtagcgctgtggcggaggagggaggggaccgcggtcaagttcgggttatctggagaggcgaggattgacttcaggcagcgggctggagtgccacagttgaattcacccagcccgacaagtgttaactctgcagataggcctgcccccgccccaaccccatagattcgtcgctgctagtgcctatgaagaactgtggccgtgaaaaccctgttaacttatacgaacccagaggctaaaggattcattattttccgaggctttggggatgagtgactattagggatggatttatgaggcctggagtcagaaaccgcaggtttcaggggaatctttcttcagatacttgaaaacagtaatgttccctaaagcccaggatattgaattggtttggaaatccattgaatgttcgttttcttttttgttgttgtttttgttttgagacggagtcttgctctgtcccccaggctggagcgcagtgtcgggatctcggctcggtgcaacctccgcctcccgggttcaagcgattctcctgcctcagtctcccgagtagctgggattacaggcgtgcgccaccacgcccagctgattttttatttttagtagaaacgggggtttcaccatgttggtcaggctggtctcgaactcctgacctcaggtaatccacccacctcggcctcccagagtgctgggattacaggcttgagccaccgagcccggccaagtgttcttttctaaatgttatctctgatctcaattttctgcatcaggcaaagaaaaatccctttggttccagaaaatctcctgaaaaagaggaaggcttatcaagccctcaaagccacccaggcaaagcaggcacttttggcaaagaaggaggtaatggtggggaaccaagagaaagtaattagaatttttatttggtgagttttatcccgcatgtgttggactacatttggtattgacgagctccccccaacggtttgacagaccaggtatagttgtctctcagtgtccttaaggggttggttccaggactcccacagatgcctaaatctcagactgctgaagtcccttatataaaatggttgtagtaggccgggcgcggtggctcacgcctgtaatccctgcactttgggaggccgaggcgggcgtatcacgaggtcaggagatcgagaccatcctggctaacacggtgaaaccccgtctctactaaaaatataaaaaattagccgggcatggtggcaggctcctgtagtcccagctactcgggaggccgaggcaggagaatggcgtgaactcgggaggtggaggttgcagtgagccaagttcgtgccactgtactccagcctgggcgacagagcgagacactctctcaaaaaataaataaataaataaataactggttgtagtatttgcatataatctatactccttccgcctatgtagtt

SEQ ID NO: 120896 - DNA, 1971 bp, Homo sapiens
tttttgttcgttatttttcccaataattcccaagtttcctcaactccacctttactttggtttctcatttttcctttatatgaaaatagagaatgttgctttgcttcgcattgtggaacacggggaaataagctatatcagttgtcacttatgaattactgttctaaaagtaaaaatgtatggaggcacaagatgatgatgatggtctgtcttctctgtagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggtaaggaactggtgtctttctaattgcatgaggctggggcaaagtgttgcttaagctttagacccctttctagggagataatatgccccaagccactcaggcaaattgtgctaggatgtcagggttgagcacaatttagtctgcaatatttggaagaccttagacagataggcttgaaaataagtgctatgagggtaaagtgctcactagggagaggggttgaggacaccctctctaaagcaggaacttcaacctgagacctgaaagatgtgaaaggcgttcaccagtgttgggagatttttcaggcatacgtgctgaagtcctgaggtagggaaagcaaggcatcattctaggaactgaaacaaggctgagtggatgaagcatattcagtgaaggggagacatttttcctcatttagtggaactttcccaaccccctgcccaccccatgtacaactctacttcttgctgtttcccctacccaatcacccaaaccagaaacctgtggattttgcatgtttatgagctctgtcctttgtagccctctaccactgctcatatttttcctgaactattgtattaaccttcctcctggatttccttgcctctagtgtcatactgtgatctgtcccatacactgcccttggtgattgtcagaaagaaatctggtctggtctcttctgcttaaaatcttcagtagcttttactgcccatagaagcacatccagcttccttagctggacatgtgtagacctacataccaccactccgcctacccctgaaacacacacaagttcaatttccatagcattccaggcactgctccacattatgaaaaggatctgttttcataaccgcctcccactaaactgagctctttaaggcatagtctctgtgtcttattccagattacccagtgtagtgacctcgcatgttgtgcttgctggactgacataaactggagggagtctgtctgacttctgttgctgttcatttcaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctgggggtaagtaaggttttccatgtgaattcacattagatttctatttgagtgtgtcagggtgcaccgggtattgctttccagggctcatgttgctgtagaagggacattttgctgtgaccacagtcaacctgaaatcagtgggtagctgtaataaccatgggacacagggtagggaggggtctgaacaataccatagtagggctggttcagtcataggctaaggctgggtcaaggaaagcttggttcttgaaagtcttaaagcagagctaaaggcagtgcatgtgtaagagtagtattcctggccggacacactggctcatgcctgtaatcccaacactttgggaggccgaggcgggtggatcacacggtcaggagtggatcacagggtcaggagattgagaccatcctggccaacatggtgaaacccctgtctctactaaaatacaaaaaaaa

SEQ ID NO: 120897 - DNA, 2829 bp, Homo sapiens
cggagcttgcagtgagtcgagatcgtgccactgcactccagcctgggagactgagcaagactccgtctcaaaaaaaaaaaaagagtagtattcctcaaacattgaaacccaacaaaaacttggattttatttccaactcttgcaccatcttgagtagagggtcacctaaggccagagtcgtagcccctaaggtaagctaggacatggtttctgttttgtttttgttggcaatattttccctggtgaacatttacatccataaatttaaatttctaattatgtaagtggggtcacttcagttctttatcaggagtatttccaagcatttcagctggaatgtgattgcagaacacttgctcgttgggagaagtgagtgtgtgggagaacctctccaacctctcagccaggctgcaggactggtatgtagtgtgccaggtgctggtgaaaaccgtgctttattttcctacatagatttccaaatctgaagtctgtccgagaactcattttgaaacgtggacaagccaaggtcaagaataagaccatccctctgacagacaatacagtgattgaggagcacctgggtgagtgctacagcttagggatcagctggggcagaaagccagggtctttgaagctttgatgtgagattcaggttgtattcttcttggggccccaagagtctgccagagtggccagcttagtatatgctggatacatgttaaataaaggaatctgtgcttttgtgtttcttagggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagtgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtattttt

SEQ ID NO: 120898 - DNA, 1219 bp, Homo sapiens
gatatccattatgaacacagatatctctttgagactttccttctttctttcttttttttttttttttttttttgagacggagtttcgctcttgttgcccaggctagagtgcaatggcacgatcttggctcaccacaacctccgcctcccgggttcaagagattctcctgcctcagcctcccaagtagctgggattacagtcaccgccaccatgcccagctaatttcgtatttttagtagagatggggtttctccatgttggtcaggctggtcttgaacccccgacctcaggtgatccgcccgcctcggcctcccaaagtgctgggattacaggcgtgaggcaccgcgcctggccttgaaacttctttagtctggtgccagcctcactcgatttccgtctggatggctattttaataatcctgtggatggcgctctcctgacggtcctgagggaacactctgcctccagggctgcgctcccggcccttgctttcccagggctgcctggaggccgcggtccccgcgcgttcccaggcacagcccgcgcccaggtgcgcgccgtcgcggtgggttcccccccgggagggggagggagcggggcaggtgtccctaacgactctcccaccctccagcccagggaggagctggctcgggctcggttaccacattacagatggggaaagagctctcctgcctctttcagattgcaggatcttcccaagaaccggaaggaggaagaccccctccacccccgcccccgagccagccgcctctatctgcagtagctgacccttccgcctgtccgctccggctcccgcggggctcaggcgtccctggccaccgcagcctggaagcgttccttgcctgctcctcacattggtctcctcttgctgagatccccgagtctccctcggaccccatagtcttgctggccctgaagacgccttgccctgggcggacggccttttaactggacttgggcgaacctatcattcgctggccaggactcgttcccagatatctaatttaatcctcacaaccatcccaccaggtgttaccggctaaggaaacgggcccagaaaaactaagttgaaacggcgaagataccctagcaggccagtggtggagccagctggaggcggcagttcagcagagggatgtgtttacagggctgtctcttccaaagctcattcacaaggctgccggggcagagaaatgaa

SEQ ID NO: 120899 - DNA, 1117 bp, Homo sapiens
acaagatgaaacctgtctctactaaaaatacagaattagccgtgcatggtggtgcatgcctgtaatcccagctacttgggaggctgaggcaggagaatcgcttgaacccaggagctgagatctcatcattgtactctagcctgggcaacaagagcgaaactccatctcaaaaaaaaaaaaggaatacgaagaacaattgcttaagggcaggatttacagtaagtacatgctcttacacaagaaacagtagataaaatagaaatcctagaggcattcctgaaactggggttaatcagaagtcaacatggcacattagcatccaagatggagttgctttagcctccacaggttctaactccttccctgccttgagtgctgattttggtcctccagtctaggaaaggatgcccacctggatctgttttgctgggagctggcctcccattagactcatgtgcactcagtgggctgtgctacctccctcccccagtgtgtaaatatgttgctgtggagctgaagtcagcctttgaggaaaccggcaagaccaaggaggtgattggcacgggctatggcatcctggaccagaaggcctctggagtcaaatacaccaagtcgtaagtgaatggggactcactggcctggcctgcgttgctgctggaggcttcaggggtttggagttcccttctcctagctaggcaaaccccctacaagggcatcatttgtaaccaagacctgagtttgcccactgattctgtccccagctaattgggtgacgtgcataaatctcttaacttctttatgcttcagcagatttctcatctctaaaagcaagactgttggactatatcattgattctcagacgcttggatttcacagagcaatgcaagtttttttttgcgacggagtttcactcttgttgcccaggctggagtgcaatggcatgatctttgctcactgcaacctctgcctcccgggttcaagagattttcctgcctcagcctcccaagtagctgggattacaggcatgtgccatcacgcccagctaattttctgtatttttttagtagagatggagtttcaccatgttggttaggctggtctcgaactcctgacctg

SEQ ID NO: 120900 - DNA, 1142 bp, Homo sapiens
cctgaggcacttctgttgagggtctctctcctccacaccctaggttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctgagtcctctgcagccctcagaggtgccctggagcctcttgttctttcctgcccctcgccttccagcccgtggggctgaggaggggaaggctaaaacccacccactctcgggagcagcaagtgctgggaaggcccagggttgtcttggggtgaggggaggcatgggcataggatgaggcccagggcagtgcactgaccttacgctgctccctcgtgtcctggacacctggctgccgttccctccctccctctctcctgctgctcctcttcccaaggcctcccatttgttgtgtaaaatgcagtgtttacctggccagctcccgcccctgttcctacttccacctggccttgactgttggtcctgaaccttgttttctgatgaccacacttgatcactct

SEQ ID NO: 120901 - DNA, 1102 bp, Homo sapiens
cagggttccttctcccttgatccctcttttctcctccccctaactgaacggggagcttgtgtgtcttaagaagaaacccaggcaggactgcacttggtggaggtggctgctactggtaccatcgtgcctccctgattcctctttctcttcctgacccctagtcatcgaagaagccaactggatgactctggacaaagatgtgccccagtcagcagagggtggctttgatgctgtcatctgccttggaaacagtttcgctcacttgccagactgcaaaggtaagagagggtgtggccttgggcatggcccccgccttgaggcccccttccacagacatctggcacctgctctcctgccaaagcagactctctgccttggctctggcacccctggggaggggagagatgggagggagactggtgctgggggccctgagcagatggagtctttctgcccgtgcctggagctcaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataaggtggggccctctggggtgggggtgggggtgggggtgggggtggggtggagggagggtccagtggccccaaggtgggttacagaggctaatgccggctgccccaccacctacagagtgacttgaccaaggacgtcacaacatcagtgctgatagtgaacaacaaggcccacatggtgaccctggactatacggtgcaggtgccgggggctggccaggatggctctcctggcttgaggtaccacttggcttagtgggggtgaggcggtagttgggggagctgaggtcaccagtcctcatggttgctggggcctctgttacagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacaga

SEQ ID NO: 120902 - DNA, 1005 bp, Homo sapiens
ataatcgcttgaacccgggtggaagttgcggtgagccgagatcgcgccattgcactccagcctgagcaacaagagcaaaactccgtctcaaaaaaaaaaaaaaaaaaaaaacaacaaacctaaggcatcaacagagggcctctgctctagctgggggacggtccctgaaggttcctgcctactgtgccctgctcatgtgtcctttcctgtggttccctagggctttgtggtaggggatctctatgcccttctgacccacagcagccgggcagcctgcaccaggatcaagaactcagggtaagaggacgtgggcaccggaaaggcggaaagaggaaatggatgtagatgggtgggtggtgaggaagggagaagggaatgggacgctgatggtgaggaggcttccctgtgttcctctttgcagtttggcaggtggcttgactgaggaggatgagggggagctgtgtgctgccggctttcctctcctggctgaggactttgggcaggcactggagcaactgcagacagctcactcccaggccgttggagcccccaaggtggagaccaagtccttggaggtgggacaggagcccctccaagagcatatcccaaccacgcactttccatctcctagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcaggtggccagggggcctggaagggatggtgggtggatcaggggctgcagcaggctggggagcaggaggggctgcccaagaggtcaattgtgtgtatgtgcatctgacggctctcaccttctcacatcctctcactcagcgtgaaggggccagagctcattaacatgtatg

SEQ ID NO: 120903 - DNA, 1046 bp, Homo sapiens
tgtaatcccagctactagggaggctgaggcaggagaatcgcttgaacccaagagccggaggatgcagtgagccgatattgcaccattgcaacccagactaggcaacaagagcgaaactccgtctcaaaaaaaaaaaaaaatacaaaaattagccgggcgtagtggtggcgcacctgtaatcccagctactggggaggctgaggctggagaattgcttgaacccaggaggcggaggttgcagtgagaggagatcgtgccattgcactccagcctcggtgacaagagggaaactctgtctcaaaaaacaaaaaacaaacaaaaaaagaaatacattctctctcagctctggaggccaaaagttgtaaaattagtgtcggcagggccatgtccttctgaggttctaaggaagaatctgttccacatctctctcctagattctggtggcttttgacaatctttggcattccttgtagatgcatcactttaatctctgcctctgtcttcacacagcattctcctccatgtgtctctgtctctgtccaaattttcctcttctaaggacaccagtcatattggacttaggtttcaccccaatccagtatgatctcattttaacttgattacatctgcaaagaccctgtttccaagtaaggtcacattcacagattctaggtggacatgaatttggtgaggggagggggtaggggactggatactgtgcaacactatgtaccaggcactgtgctaagtactttgcatacattgtctcatttaaccttcacaatactcccctgagattcctttattattattattcccatttcacagatgaaactgaggcttagaaatgttaactgggcacagtggctcacgcctgtaatcccagcactttgggaggccgaggagggcagaccacctgaggtcaggagttcgagactagcctggccaacatggtgaaacgctgtctctactaaaaatacaaaaattagcctggcatggtccagctacttgggagactgaggcaggagaattgcttgaacctggga

SEQ ID NO: 120904 - DNA, 1968 bp, Homo sapiens
atgtttgtatttttagtagagatggggtttcaccatgttggcctggctggtcttgaactcttgacctcaggtgatctgccctcctcggcctcccaaagtgctgggattacaagtgtgagccactgcgcccggcctcttctaccttttgattggagactgtcatacattcagtaaaggatcttaagtgtactgctcaataaattttaggtatgtatctgccatgcaccaccttgcaggtccagtcaagatacaggatgtttacattactcagaaggctcctcatgtctcttcttattcctcatgtgtcttcttattcatcatgtgtcttcttagcaatacccaccccatttcccctggcaacgtaatcacttttttgacttctgtcaccatcaatctatcaattagctttacctgttcatgaactggaatgaacgttttaaaggctcttgatgcacaagcagtgggcatctctttgggtgatgtgacttcttgactgctccctgccagggctacagcacagttatctctgtaaccctggccttagctccttcggggcaggagacagctgctcactgcccaggcctgtgcaggcataaacagacttggggatggccaggcccagggtgggaggcatatcttgggaagtggatttcaacaggtgacttgtttgaccaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaaggtacttggcaattggtcacaggggctgttttaccagttctagtgggcatcgggagttggtggaatggaagttttggggtattttgcggggaagggagttccagagaatgcgggaagggggtgccagggagcaggatggtggcagggtggggtaagggaaagcccttgaaggcaagcagggcatcgcagtgaaggactacagaggagaacctgactgctggggcccccacagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatggtgggcacagggaaaggacacaggggggactggtgaggggctctggagaagcccaggtggagctctaactggccctacccctcagttttcagtgaacctcttccggacgctgccaccttcatcgaatcccacaggggctgagtttgacccagaggaagatgagcccaccctggaagctgcttggccacatctccaggtaccagggcaagggggcagattggccgtggctgcagggagtggggcacttggaggcctgcaagtccttgggaacatcccctcagtggcgtgccttttcccctatagctcgtgtatgagttcttcttacgtttccttgagtctcctgatttccagccaaacatagccaagaagtacatcgaccagaagtttgtacttgctgtgagtccccgagttcctgtccttgccctctctttccattccatgcccccttcatctgtgtcccagtggctctttccccttaagctgaatatattgggtttcatccatgtctggtacgaggaggctataaagggtaaaaaacaaaacaaaacaaaaccctactctggccttaagaaactaacaacataatggtaggaaacaaaaaagcaacagagtacctctctcaggtcaatagtgaggcatcacttt

SEQ ID NO: 120905 - DNA, 1870 bp, Homo sapiens
gactgatctataatgccctgaagttgtttatggaaatgaatcagaagctgtttgatgactgcacacaacaatacaaggcagagaagcagaagtgagtatctctctccccgggagactttcatcttctaccaccagctcactgtgtttctctcaagcccaaccccaatcctacttttgctcctcaggggccggttccgaatgaaggaaagggaagagatgtggcaaaaaatcgaggagctggcccggcttaatccccaggtgaggttttcctgccactgttgtgaactgaggggccagcccatcttgagctgggggagagtttgttgggggaggaatatggggcacacaggcccccaagcctctgaagtggctcttaacgcttgtccatgtctcctcactcagtatcccatgttccgagcccctccaccactgccccctgtgtactcgatggagacagagacccccacagctgaggacatccagcttctgaagaggactgtggagactgaggctgttcaggtgggagggcaatgtagggggatggagcagaaataatagctctggaagggagaggagacagaaacagcagagccaaagaataaggggacggaacaatagaattcactgggaattggtcaccattcctcaccttgtccctattcacacacagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctga

SEQ ID NO: 120906 - DNA, 1119 bp, Homo sapiens
ggatgggggcgggtgggggacgctgcagctggggccatttgaggggagcccatggggcctgaaaggcatctgtcaggcggtacagagggggtcctctaggagaggggagaagggggcgggtacgccgacctgtttaggggagtctgatgacccagagttcccaagtcgcgggggaggcgtggcgcggggagccggggttctggaaggggtgtcttttaggaggtggcagggcctccggttgggcgtttaactaggaagtggcggagcaagttggtggggcctggttcaagataagaaccccgacttaggagggggaggaacgagaggctggaattggggcggaggggtggaggatgcaggagcctcggggaggagctggttttttgcacgcaggagactacaaggagatgatgagaggatgaagatgggcctggtttcatccgatccctgtcctaccgcctccctgttcttgcagcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggtagggtggaggagggatggttcctgaacaggtgaagctgggctccctgaaagcctagacccaaacggtcttctgtggctctgcaggccctggggcttcatttgccagacccaccattagagagtgaagatgaagatgaggagggagctacagcgttgaacaaccacagctctattcccatggacccaggtaaaagatcattctttcattctggaataattactaaggaaatgaactggcatgagtcagtagaaggaagtttcagaggaagaccctatcctaaaaagatagtttgtaaactaagattttgtagacttcagagtccaagtgaaatgctcttttgctagctttggggatgggcaggcttgc

SEQ ID NO: 120907 - DNA, 2826 bp, Homo sapiens
gactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcaggtagcctgggatgggtagaagggcaagggagaattagggggcttaggacgtgctgtctggagctggagtggcgggggaggggcctgagagtgatgaggtgggggtggggagggagctagggggatgatgggaaaggagagtgttaatggggaaagcagggctaggggaggatggcgaggagatgggtaggagagacctggtgtctggaggaagcaatgaaggaaatgggaaggaagactgggccatgaaaacagggaagctgagcataatggaaggggaggggtgtctggcgtggtgggctaggggaggccggaatgtctggaagaagacagggatagagtcatatgcagagaggggtatcgtggtcagtgcatgctaatttttctttccttagtggaggtgggaaaatggagggctgttgggtggagcttggaatggtaggagaaggaaaaatgagaaaactgcaaagctctcacgagatcaagaagggcgagaaatggggaataaaaaatgcaagagaccaggcgggtagatacattaagggaatagaagaagtttgaaaatgcttggtggtgatggaggactggggagacccagggataagaggagcccctgagcgcctgggggcttgttctccttgaatttgagttgtttatatggcagagaaactaaaattttttttctccacctttggctggaattgcttatctcctctcctgtgcatattttactttaccttgacatatctgaagggaagaatagagaatataagggaggatggaagacttccattcttaagcccatcgacctcctaacagtctccacaagcccagacccaagatattttggagagcgggagtaatgaagtgagagtagcttcctgctggggctatttcaggatgggtcccatggctatttaaagcttagggtgtggagttgggggaggttgggtgggtgggactagcaagccagctgaaagccatgtctctttcctgcaaggggcctcccttatttgagctgttttagtgcctgaggttttgcctggccctttcctctgccagggcttcttaaacagggagcagatgatgatacacccaaactcaggagatgcttgccagcaaaagcattgtcagttgcaaggatttgcctgaaaaaacctcagatgtacccaggtgtacgtgccactaggttgacaggttgtgtttaagagaccatgaccagctgggcatggtggctcacgcctgtaatcccagcacttcaggagaccgaggacggtggatcacctgaggtcaggagtttgagaccagcctggccaacatagtgagaccccatctctactaaaaatacaaaaattagctgggcatggtggcaggcgcctgtaatcccagctacttgggaggctgaggcaggagaatcgcttgaacccgggagggaggcagagtttgcagtgagctgagattgcaccattgcgctccagcctgggggcaagagcgagacttcatctaaaaaaaaaaaaaaaaaaaaagaccatgacttctcatgctggatctttctcttgtcctgcccaagggcattttttgcctcccttcccctttttttttgttttgagacagagtctcgctctgtcgccagactggagtgcagtggtgtgatctcggctcactccaacctccgccacccgagtgcaagcaattctcctgcctcagcctcctgagtagctgggactacaggtgcgcgccaccgtgcccagctaatttttgtatttttagtagagacgggtttcaccatgttggccaggatggtctccgtctcttgatctcgtgatccacctgcctcggcctctcagggtgctgggattacaggtgtgagccactgtgcccagccccttcccctttgcattgcacactcccacctctatccgcctttcaggaacccaagttgtggaagagcttgttctctcttttctactggaaatggcttgttctctaccacagtagcagggatggggaagtggcaggaggagaaaacccctccctctatcaccatcccccaagcctaagcatacacatacctttctggcttaagtcctggcagcataccaggcacagctgtcaaaggaactccttgtgcctgtggggggccctgggtgaccccaatgacaacaactcagcttgacaggagctccctgtgaggggctaaccaaccgcggtaacatggaggtccctgtcctggatcagtcccgccctatcttgggtagggggattgttccactctaaaagcctgaaagcttttctgctttgaggcactcatgccagctttcaatggactgtttgaggctggctgggctattaatagctgtgagtattttgagatccctttccccacctcaaagaacacagattcttagagaggtggcagtaagcagagcagagacaagagaatataccgtttgggaagggggcttcaagtttgtgccaagccagggacagagtggagcctccacgagtaggttgtgaccatgatatgcagattctgagctggcaatcaggtgggggtggccccacccttcactgttggagaacactgggcccaggctgctccctgacctcggcagctcccttggggcagggccagccacctgagctgagactagtgcccctgtggaggggtagtgtg

SEQ ID NO: 120908 - DNA, 2328 bp, Homo sapiens
gtgcacattttcaatgcaggtaagccaatgctggggctgtccctgggtccccacatcagggtgggaacgggctgctgatgaggtttggctgtggtctctgggaccaaggggattggggacaaacatctggtttgggaaaagtggacagcctggagggaggttcccagggctgagcagagctgtgcccacagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcagtgagtatggatctcagagaggctatgtccttccagatgttgcctcagttgcccaagaaaggtttgggttgggggtcttggggagtagagtaccccagagctgaggagggactgtcatagagggtgcttagttgagccattttctcatctccttcagatacgcacaagtggttcacaccccgagtgtcagggacagttcctggggcccgggatggacattcagcctgtgtcctaggcaagatcatgtacatttttgggggctacgagcagcaggtaggtctgggaataaaataagaggtttagggtgggactgagaaagaggggaagggcaatttaggatggtgaaatgggaggctttggcttgtttgcaggttttgaggggagggatggagggtcagagagtgaccattggctccctcttttcttcctccttttctcttcctactcaggcggactgtttttccaatgacattcacaagctagataccagcaccatgacatggactcttatctgtacaaaggtctgctctttcttttttttcccaaatccccaccctctgttgaagcaatgataggaagctcagtcagaggagatcctcttccagtctttgtgctgacccctccaccatctctctgcctctgcccagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctgtgagtgtttgttacttccctgtggagttcccttcctgccctcttcacactcctgacacttcctctctccttccagttggctacaatggggagctgtacatctttggtggttataatgcaaggctgaaccggcacttccatgacctctggaagtttaatcctggtaaagagcactgcatttagggcaggaacaaggagcaattgaggtgggaggaaaagaaaataatcctgaggcggtgagggatgggggtggggaagatacctggactaggcaggtattgaacttccatataaatttctcttcagtgtcctttacctggaaaaagattgaaccgaaggggaaggggccatgtccccgccggcgccagtgctgctgtattgttggtgacaagattgtcctctttgggggtaccaggttagaaggagagagggaaggggctcagggaagtcactaatgggagagtgggaggtatttgaaaagggggtttcgtgggtagtttttgtcctactttcatctctcttttgatcccgacagtccatctcctgaggaaggcctgggagatgaatttgaccttatagatcattctgacttacacattttggactttagtaagtatagttattcctgaattgctcctgccatcaaggtccctgtctttgggtggtgatatccaggactggatcctttcctcacctttgaccatctcctttccacaacttctcccttaaaggccctagtctgaagactctgtgcaaactggccgtgattcagtataacctagaccagtcctgtttgcctcatgatatcaggtacagcgagtggttggaagggagggattgagtgagggtgagtgagcagcacaggtgtgacctgattagcttggtttcagtatggaggagacagacatttttgttctgctggagatgtagtgtacttgtgggaaatgagatggaaggaggtgaattgacagccatcatataaaactgtcagcagaataaattatatgaaaaaaaaatacagctcggcagcatcactttctgagacctaagcttatacagttatttttgtgaccatgctgagaacaactgattaaatctt

SEQ ID NO: 120909 - DNA, 1001 bp, Homo sapiens
ctctaagcaaagcaggaaaggcaggttgggatgttgactgacatgtatacacagatctcaggtgcctggacactgcaatatacatacatacataaacataaaccggaaatccatatgagcttggaggtagaggagtgggtggtgttggatttggtggtgggtgggttctgattgttcaacctagtaggtctcttaagtaagaggtggctgtgggtggttgacctttaggaagttggagagactggtgtgtttttagcttggttcaaacatcccttagcttgggctgagggccccctcttctttctgtctcttattgttggccttccaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtgttgtgtgtttttgtggaatatggtggagaaggctggagttt

SEQ ID NO: 120910 - DNA, 1001 bp, Homo sapiens
gtaggagtaacatgatctgaagtttatgtgtgggagtgataagatctgattttattttcgatgcctctctcaggctgaattgaggcgcatagctttgagaggagtgaggctggtggttgggagactaggaggctagagcactgattgaggtgagagatgctgagcatgtggaccaggacactggcaatggtaactgagcaagggaggcagatgcccttctggggaaacctgtgaatgagtaaaagagagagtaaaagaatgagtaaaagagaaaaagaagggactatggtttggtgcacctttgaccttacatatacaccttccttagcaagatgaggccccaggttgctgaaatagttggagagtttaacactatcacagcctctgctgcctaggacttctaataatgattggtctgatggggtattaggattagctagctaaggaatggggatgggaagatgtcttttctgcagtgggacatgctgagctgagttgtatgtccctccccacttccacaggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggtaagcaaggcttgccctagaagttggaagataactgggaccttgaataggtatgttgtcttgggtgacaggtgggaagcctttgaccaacactggagtcctcttgacttggcttttaatttctccataggcctctggaaatgtcagccaagatccgagtaccatttttacgtcaggttgttcccattagtaaaaaggtaaggaagaaggccaggcactgtggctcacgcctgtaatcccagcactttgggagcccgaggtgggcgatcacctgagatcaggagttccaagaccagcatggccaacatggtgaaaccctgtctctactaaaa

SEQ ID NO: 120911 - DNA, 1049 bp, Homo sapiens
aaaaaatagaggccgggcgcagtggctcatgtctgtaatcccagcactttggaaggccaaggtgggcgaatcacgaggtcaggagattgagaccatcctagctaacacagtgaaaccccgtctctactaaaaatacaaaaaaaaatagccgggcgtggtggcgggtgcctgtagtcctagctactcaggaggctgaggcaggagaatggtgtgaacttgggaggcacagcttgcagtgagccgagattgcaccactgcactccagcctgggcgacagagcgagactgtgtctcaaaaagcaaaaaaaaagaaagatgaggaagagacaggaagcactttttctcagtgaaaggagattgaacagttgtgttttatattctctctcttctctccaaaggtagcccgggaccctcgctttgatgatctgtcaggggaatataatcctgaggtgtttgacaaaacataccaattcttgaatgacatccgagcgaaagagaaagaggtatacagcttgagactggtttatggggaattttgtggggtggaaaatgagggcacaggttagagagttgggcagggggagtgggaagtatagtggtgggcagatttaactctctccaattcagttcatattcaaatcctggctcatcagtttactagctgtgtgattattggcatgttacttaatctctctatgctttagttttctaatcataaaaaaataaaataataattactgtcttggaggccgggtgtggtggctcacgcctgtaagtaatcccagcacttggggagactgaggtgagcacatcatttgaggccagcagttccaagaccagcctggccaacatggtgaaaccccatctctactaaaaatagaaaaattagccaagtgtggtgttgcatgcctatagtcccagctactcaagaggctgaggcatgggaattgctggtgccctggagacaaaggttgcagtgagacaagatcgtgtcactgcactccaacctgggcagcagggcaagactgtctccaaacaaacagttactgt

SEQ ID NO: 120912 - DNA, 1187 bp, Homo sapiens
ggaggctgaggcaggagaatcacttgaatctagaagacggaggttgcagtgagccgagatcgcgtcactgcactccagcctgggtaacagagcaggactccgtctcagaaaaaagatagaggggcaccagtgagctttaaagaactcatgtatccagcataatggcttggagttactgacctggtttgggaaagaataggggcttccttctttgttcaccaactttcattctccctgtcatttagctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctttttattctgttttttgtggccttctttttgtgtttcccccccgaaacagagtctcgctctgtcacccaggctagagtacagtggtgcaatctcgcctcactgcaacctccacctcccaggttcaagtgattcttgtgcctcagcctcccgagtagctgacatccgccaccaagcccagctaatttctttcgtatttttagtagagatagagttttgccatgttggctagtttgatcttaaactcttggcctcaagtgatctgcctgcctcagactcccaaagtgctgggattacaggcgttgagccaccgttccggccttaaggcctctgcttttatgtgggatttgtgggtagcctagaactactttttagtgggccacatattgggataggcaataaagcctaaggcatctacaactgggaagtcagatc

SEQ ID NO: 120913 - DNA, 1033 bp, Homo sapiens
agagtgagcacaagaatattgggcctgggccaataaaagcctataatctctggtaccaaggtgaagaggcactaagtgaccagctgcagcaaccccagtgtacctgggcccactgtgctgggcccccagcctgctgctgctgcctgtctggactctgccccaaagggcagctgtcactcagcaggctggcccctgctgtgagagctaccgacaccatgggaccaacactgcaaagcaagcactacggagcccctctgccctctgtattatagcctcatcctgagcagcctgactctcccacaagccatggccttttttcccctagactccaaatctcagtcctggtggcactcagttctctctgtctggcttctgtgccctcctttaccacctgactcttcctcatcccccttccccctccttccatagctttttctgtcacctctgggctacgagcctcgggatgcctgggtcatccctcctttcctcctccccagtagccctgccaagacacagagctgcacctttggcacaggatcccctggcctgacctgagctgccctgcttcagcaggggtggtgccaatggagccaattatagtagcacaagcaaacctccccaacagcagcagggcagaggctcacctatgggggtagttaggggtaggagtttttgcctttctgaaatagagagagggtctatgtcacctaggcaggagtgcagtggatattcacaggcacgatcccactactgatcaatcagcatgggagttttgagctgctctctttctgacctgggccagttcactcatttatttatttatttatttatttatttatttatttttgagacggagtcttgctctgttgccaggctggagtgcagcggagagatctcggctcactgcaacctccgcctgccgggttcaaacaattctcctgcctcagcctcccaagtagctgggactacaggcgtgcaccaccacacccggctaatttttgtatttttagtagagatggggtttcaccatgtt

SEQ ID NO: 120914 - DNA, 1087 bp, Homo sapiens
tcagaagattccgtctcttctccaagttctggccgtcttcaccctcagcttgcaggtacgtctgaggtgggatgagccgcacaatgtcccatctcgacctgggttccttgctgccatctcgaatcttgaggacccctgaaataaatgctgatcactcactcagtggagagcccacgaggagcctggccctgcctcagagcagaggcccctctggccctaagtgcatacctcctggtatatccttttgctcgtgaaggtccagggggcctcttgaagaggtgaggggcccaatcgcctgattgagcatgtctgcggagagccctgagaacgccagcagactctccacagagaccgccttcagagaacagatgggagacattcagggcctccccaaggagtggagagaagaggatggagggaagaagcagagggagtcaaggttttgggaagagaggcaagggacaaagtgggagacaggagagaggtgcagcggggctgggccaccttcaggtcgttgagatacagcagtagccacatctgcacggtggacacatgcagggtctggttcccaaactgcagctcagcccagcccagccacgtccactgcagtcgcctctgtgagcctcgctcaagggcagggtggctctgacctggaccaggaagggggagggagacaaagagcaggtgaaaggagggagttggtgttggagggagggtgcacgctggtcacgctctgtttatctctgcaaggcgtgtgaccccagcatttatggacactggggcttctggtctgagcttccagatctcagccttctctgggcctgcctctatggcaagcctcaggatctgggagctatcctatgcctagcctggtgccaagcaggttctcatcagtgccttcgaggattgccccatgtgtttttagggagacaaaaccatgaagggaggaaggactggggctcttatcaagctggaatattatgacaggaaacaatgtctcccctattaggaggcgccctgaccacaggtctgagcctcttccccctcctgtgttgctgccagctcagggatcagcccccgatgggga

SEQ ID NO: 120915 - DNA, 1101 bp, Homo sapiens
cctgaggccaccagatatgagtaggtgtctggctcttttctggtcagtcacctgtcatcctaaactccccatcgggggctgatccctgagctggcagcaacacaggagggggaagaggctcagacctgtggtcagggcgcctcctaataggggagacattgtttcctgtcataatattccagcttgataagagccccagtccttcctcccttcatggttttgtctccctaaaaacacatggggcaatcctcgaaggcactgatgagaacctgcttggcaccaggctaggcataggatagctcccagatcctgaggcttgccatagaggcaggcccagagaaggctgagatctggaagctcagaccagaagccccagtgtccataaatgctggggtcacacgccttgcagagataaacagagcgtgaccagcgtgcaccctccctccaacaccaactccctcctttcacctgctctttgtctccctcccccttcctggtccaggtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggtggcccagccccgctgcacctctctcctgtctcccactttgtcccttgcctctcttcccaaaaccttgactccctctgcttcttccctccatcctcttctctccactccttggggaggccctgaatgtctcccatctgttctctgaaggcggtctctgtggagagtctgctggcgttctcagggctctccgcagacatgctcaatcaggcgattgggcccctcacctcttcaagaggccccctggaccttcacgagcaaaaggatataccaggaggtatgcacttagggccagaggggcctctgctctgaggcagggccaggctcctcgtgggctctccactgagtgagtgatcagcatttatttcaggggtcctcaagattcgagatggcagcaaggaacccaggtcgagatgggacattgtgcggctcatcccacctcagacgtacctgc

SEQ ID NO: 120916 - DNA, 1084 bp, Homo sapiens
agctgtcttacaatgacattcagagattagatccccaaacctaacttttagggggattaaaaaatttaaaacattttttaggagaaattagagaaaaagattgagagttatgaatctatttctgagccttcacattactaacaatggccaactcctgtgactgtccccttcctgtagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgaggtgagagcatggtgacaggtgggatctctgagggcaaagggggtccatgaggctggctacacatttctctgcccccagaatcctgaagcagctggtggacttccccgaggcactgctgctcccctggcacgaggccgtggatgcctgcatggcctgcctgcggtccccaaacactgatcgagaggtacccctgccctgctctggggagaggctgggggagaggataaaggcagccactggcaaggcacacctgctgggcaaggctctggagggcgtgatagagcctttgagctcttggtttgagttttgcttttaaaattgaattttattttttttaaataggtaatacattcacatggttcacaaatcaaaacgctctaacaaggtatacactgagaattcttgctctcacccaaatctctgttcccccagggtcccccacacaccccttactggtaactacttgtattaatttatgtatctttcccgtgttcccttatgcaaatataagcaaacccaaatgtgtgatcttgccactctcttttttacacaaaaggatatggagatattattacataaaacattaagagcttcaatagctccatttttggctgggcctgtgggagaaagggggatgaaggaggcagagcgcccatcacataccagagt

SEQ ID NO: 120917 - DNA, 1241 bp, Homo sapiens
agctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcagtacgtaaatgattctgttgcccttctcttagagttggaagaaaaggaggtgggcatgggagtgagggtgggggttatctgccaaaagaggaaagactatcttcaagaacctcatattaattagttgctttttatgcaaaggaagaatttagagtttagactattgtagatcgtgtttatgtgcgtgtgtgtgtgtatgtgtataagttagcaaattttagcttttgaagcaaatcagttctttctcattgtgtggtggcaaaaggattggattgaaagagtagagggtctaagatttctaggaagggtgagattagggagaagttaccaactggggtgtgggttacagggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtaacctttgggggtgtaaggtggggggaacttgtgaacaagatctagggtccaggcctttgcacctatctgcagaggatggtatggagagaggggcttaaactgggacaaggtggatataggccaaaggttgtatcccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccaggg

SEQ ID NO: 120918 - DNA, 1022 bp, Homo sapiens
ttatttttgtagagatgggatctcattatgttgcccaggctggtcttgaacttctgagctcaagtgatcctccagccttggcctcccaaagtgctgggattactggcgtgagctctttgttttcaactacttagttcctactgtaggaccttcacttagtgtcagccatcttatgcttttccttttccctcgcccttctctccttgagtctaagaagccccccaagggtgtgctctcaacattgtcaagctctttcccccccattgtacagaatctccatctgttttctctgtcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcttttccagttctgactttgggaaacggggagggcacttccgcaggagggaggactaaaggaagaggaaagggcggcgcaaagaaggaggtgctgcgtcgccaaggtggcatcctcggctccgccccggcgctctcccagggcccctagctttccgctgggtcgggcggaaatgagccgtggcttttggctggcggagccgctggcagggaccgggccccaccctgccccagtggctgccgactcacgcgggtgcagctctgttccgcg

SEQ ID NO: 120919 - DNA, 1415 bp, Homo sapiens
aaatttataacagttgaaattatttaagtatgatttacatggctctcagtaaacttactgatttcagtaatttgaaaatattttggctgggcgcagtggctcacgcctgtaatcccagcactttgggaggccaaggtgggcggatcacaaggtcaagagattgaaaccatcctggctaacacagtgaaacccgtctctactaaaaatacaaaaacttagctgggcgtggtggtgggcacctgtagtcccagctactcgggagactgaggcaggagaatggcgtgaacccgggaggcggagcttgcagtgagccgagatcgcaccactgcgctccagcctgggcaacagagtgagactctgtctcagaagaaaaaaagaaaatattttatctggaagttttatacaatttcaataatcatataatgtttttttcaccaagcttcatgttggtgttgcccctccttactccagtgtgctgtgcaaatttttatcatttctgcttgtgccacaatgctaagcactgctctctggcagagaatgggccagttcccagtgctggaaactaaactactctgacctgaatcatatcccccaactgtcctaaaccacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggcaagtttgggatgtgggatgatgatggaatggtctgaataactccatagcttctcagaagatgtggggctgcctagacggtctgcttacctgtccctcaccctgattaggtcagcagacatagctctggttgctgggggcagccggaaacgctggatcatcgccacagaaaacatgcaggctggagatacaatcttgaactctaaccacataggccgaatggcaggtgagagatggctaccagatgtgtgggctggaggcagcaaaagttctagagctaatgaaatcctgtcttttagttgctgctcgggaaggggatgcgcatcctcttggggctctgcctgtggggaccctcatcaacaacgtggaaagtgagccaggccggggtgcccaatatatccgagctgcaggtatggggaaaggagttgcctgggtcctatagtttggaaaggcaaggagagtctgaacccatggttccacatctggtactggcagagaaaattaaggaaaaaacaaacatgaggatgaagatatgcatgtgtttttacctaaaacatagcatgcgtccttctttgtgtatctgctcctaaagagcaaagcaagggcagcatgtggggtatgtcccctgtgtaagtccctctgcacccccctgttttgtggagggt

SEQ ID NO: 120920 - DNA, 1025 bp, Homo sapiens
agttttgtaaggttggttggagggggtttgttcatctttctggtagtgcgagaataagagatggcagagaccttaaccttcagccccaggataccctcaaagactcacctgcaatctgccggtgtggctgccgctcttgccggtactgcccctttaaatccatgatggctgccgctcgaggcaattgttttgacgggtctgggggggcggggcctgtttcctagtcacgcgacattagagctgcccgcggattggctctcacggcgttcaggtaggaaaggaggtgtgtatccagcttgggctccagttttctgcccgcctccttttacgttattgcggagcgacggcgccggacagtcaacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccaggtaatccatcttacccgggaagaaggctgcttccattcgggctgccggagatggggtctgcgggcatgcgaggcgggagttgcgagtctggtcaggagtcatgcaggtccgtgaccttggataaggcacacttagcctcagctttttcctctacaagtgttgctttctcatagggcgaaattcttcagacgagatacttaaggtgaaagtgctttgcagatcaccggttgtgcaggtttcagtaataacgtttcgagtgcctatgataagccaggtataggtaatagacgtttcaaataaatgaactcctttcaaatactctataaggcagttactattcccattttatagatgaggaaaataaggagtccaaggtcacacaccaactatcagagctaaacagtctgtctttcagagcctgtgctcttaaccattatgatatgatgcctgcaaggatgagttactgctgatattagagaatgcagggcaagataccaagaacagtggcctcagggga

SEQ ID NO: 120921 - DNA, 1009 bp, Homo sapiens
cttcttcccttccaggaggagaaagaaggcgatgccaccaaggattccctggatgacctctttcctaatgaggaggaagaggaccccagcaatggctgtgagtctgcctctggaatgggagggtgaaaaggggcagcaggaggctggccctagctgtggcccaccctgtacacaggacagtcaccatctagaaataggttctccactttctctggagacagggcaggggctgggctagtacttcgatttcctcagcctccccattgaacgaacatgtattaagcactgaatatgtgccaggtactgtgctaggcactaggagtactgagatggaaatggcataggtcttaccagtaaggagttcacagtctagtgggagaataaacctgagacagggagaccatgagccccccaagggaaagaaccaggtctttcttacctttgtactcctggaacatcccttggttcatacttattaaataaatgtttgttgaatgcatgaattactgggtgaacaactgaggttgtgatgggcataggtcaagggagtggataaaagaatagcacttgaggcaggtctaatattgagagtccaggttggggtgggcacaagtatggaacaagacatgcaatggggagtggaagggcagacagcaaaggggagaggaagagtcctttgtttatgttctgtgatggtttagtgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcggtgaggacttccctcctccagtgcccagatcttcccccacattcccaccttggtcctcctttggctttcatttttcctctttacaggg

SEQ ID NO: 120922 - DNA, 1054 bp, Homo sapiens
ctgaagctgtcctatctctcctgccagaaggtagacactgtagaacttctggactgtcattcttgcgacaccatccatatttttgcccctattgggttttgttttaatttactgaggggctctcccatagagtttagtacagtacttatttataatgggttcttatgtaggtggtttttttgtttgttgtttgtttgtttttgttttttttgaaatggagtctgcctgtgtctcccaggctggaggcattggcacgatcttggttcactgcaacctctacctcccaggttcaagtgattctcctacctcagcctcctgagtacctgggtttacaggtgtgtgccactgcacccagctaatttttgtatttttaatagagacggggtttccccatgttggccaggctggtctcgaactcctgacctcaggtgatctgcccacttcagcctcccaaagtgctgggattacaggcgtgagccactgcacccagccgatataacaggtcctcatataggtttatttaaaaagtgaatgaaccatttgggtgcagggcagaatgatcaagggtggagttaaatatccccttgcatcctaggcatggggagtcttttgcaccctccccagcttctttgagttggggttgcctgttcctccttgcgcctgctctacggtgaccaaattaaggatcagaccttccttccctgatcctgggctggctggttttggtggtggtttttctcagttttgatgtggtgggtcttctagctttctccaagttctgtgcgtgggtaagcaccgctacgtatgaagctgactgcaacttaaaaactggtgctaaagttgcttcctcagagaactgggtaggggcctagagtatctataactgtgctacttgaagaaagacccagggccacgtggcatcagcattcctgggagcatgaatcagaatcgcaatctgcaatttatttatttattctttttgagatggagtctcactctgtcgcccaggctgaagtgcagtggcacgatcttggctcactgcaacctccacctc

SEQ ID NO: 120923 - DNA, 1051 bp, Homo sapiens
tattgatgaaaagtttagtttcctgggccttactgcagacctgcccatcagaattattgagggagaggccagaaaatgcattttatttatttgttagattatgttgctgtttttgaatagctgatccagttacataggccagatttcaaaaggaaactgcattttaatttttatttatttatttttgagacagggtctcactctgtcacccaggttggagtacagtggtgcaatcacagctcactgcagccttgtcctgttgggctcaagtgattctcccgcctccgcctcccaagtagctgggaccacaggtgcatgccaccatacctggctagttttttaaatttattttttatttttaatagaggcgaggtcttgctgtgttgcccaggctggtgttgaactcctgggctcaagctatccttctgcctctgcttgccaaagtgttgggattacaggcgtaagccatcacgcccagcctggaaactgcatttataaagagcttcctggagattcttacctacgcttaagtgtgagaaccactgggtagccataaggagaatttatcagtctgaagcggaggtgtggtgttgagaaaaagggtgatattaatagtggggggcttaggagggagttcattcaaagtgcttcagtgtcttctatgggtgaagctgtctgaggaggcatggaatgcaggaagaagacaagatggagaaacgtgaatcagatgaagtatgaaagacaccatttggtaaagtgctaagtagaatagaagaacattctagaatgtgtgggatggtaagtctgagatgtaggagcaaatagggggtgggagggcttcagagaggagagaagaccctacattgctgaatagatgtagtcagtgacggcctcagaatgatgaatagatgtagtcagtgacggcctcagaatgatgtaaagtcatcggaccaggattctgaaaacctgggtggtactgttctaatatcacatggcagccacaagtgatgaagtaatagaagagacatctatagacctgtgacaccagttt

SEQ ID NO: 120924 - DNA, 2411 bp, Homo sapiens
ttgtgccaggtgtatctctctttggctgaaccgttgaccactcttggtgattccactgagtttgttcttctgctttggaggttctcagactccagtgtgggaacctatgttctgtcaatgaaggatgcaaagggacaactctagtgatctgattccattgtagctcatctgtttacaaagctgggctgtttcccacctagaagaagagggagaaggctctgtcaggccaacagatccttagagagtgctaggatggcatttgagatccaaacctaatttccagccacctgaaaaacaaaacaaatcacaaagaaaacattgtcttacagcctcaggggggagaaaaaaaggaaatgctgtcgatctcttaatagttccagcacaaagaacaaagcattctatcagtttagttcctttagcagattaaaccagttgttaaactgaccaattaaaaaaatgcccagctacgcagcagcttttctgcccacgatctgagctcctcctctaccccagggatccaggcctcttaccggaggagtactgaggggagggggctaggctgggtcctggaacagccctggagacctgtaggaaggtctctctctctcctatcccccctcccctttagcaaaacttcttagaacaaaaggctgttatttaataaacacctgcaccctgttttgatggagtgtcctgagctgtgccatggactgggaaaaacagggtggggaccttgtcctttgttactgcctatgtaagaggctggggtgctctcaggggttgtacagcctcctgtgtctttccttaccctctttacctttgcctgaagggcctttgaacatggcttgagagatcctgcggaagccaccaagccagcttgctctgtctccagacagcaattttaggcgagtctctacttgggcctttccaagagactcccttttccaggcactgcacagctgccgctggtgacccagaaaggggtaggagagcgtgggctcagcctagccttggtgcaggtggcaccgctctctgccccttcccactctgcctggatcaaaggagcctcctcagggagcaggaaaatacttctcccaatagccccaccagtgagtaaacagccggggcctcttgcagcttttgaagctggtgcttcaggcctggaggaatgcagaacatttcattttaggggtggacttaggtttccactgctgtcggtatttgcaaatttgaaacaaatgccctcatttagcagcaggcaggctgagcagtaaactggggctgtttaagggcgtttatgatggtcacaggtatttgtggagagagggaccccagcaggtttgggaaaagatagagggtttatggttaggtgggttgtacaaagaccctagccaggtctccagtggaggttgttgttaggtgggctttgtcatacaaagcattgctgcctcctgctcccccaggaagtatctccttctggcagacaaaggtttgggatggtgtttatcctcaggctctgatgctcagggccttgtccctcccgcttggttgccaaagtatcagatttccaatgaatccttccttcttctactcccaggacctgaaaggctcgttaaatgtgctttatatataacaagttggctgagaggttcccccctcacttccagccagttttgtaaggaaggagctagggaaacctgttttctttttttttgttgttgtttctggaagtaggacctgtgaaggtgcacttgaagaaagaccctgattttagggatcagccaagtcagggttatttgcctctgatgggtcagcctaaccaagaaggatctgtctgaagcctggctgccccctccttgctccccgcttcccagggaaattcagaaatctgttcaggaactgacttctggctccacagcttactggctgagagaccttagtttacttcacttctctgagcttcggtttcctcttttttttttttttttttgttttggagatggggtctcactctgtcgcccaagctggagtacagtgacgtgatcttggctcactgcaatctctgtctcctgggttcaagtgaccctcctggctcagcctcccaactagctgggactacaggcccacaccaccatggctggctaattttgtatatttttgttttagtagaaatggggtttcaccatgttggccagtctggtctccaactcctgacctcaggtgatccacccacctcggcctctcgaagtgttgggattacaggcgtgagccactgcgcctggccggtttcctcttttgtaagataggaataataataccagtctcgttagagttcttgcaagagttgagtgagatggtactgcatttcattaactcttagatgttttttcttttcacatttgcacatcttt

SEQ ID NO: 120925 - DNA, 1034 bp, Homo sapiens
gaaaccggctgcacaaagacggatttcacttcaggctaagtgttttgttgctgaatcatttgcattcattaaaagtagtgaagggtgagtgatatttaaggcaacatgaccagtttgctgggggcctggaggccgctgccttagaacctcattaagaattcttggggccgtggagagcaagggagcagctcattcaaagcttgcttaacttttgactgccttgggcataggccagctactaaaatatgaaaaatgtttgcccagcagcccccagagcttggccagactgccctggccaaagaaaacacacacttacaattcattatttagcctcctcctgcgcggttgcttgcatttcttcctctccagggaccttgctgagttgggggcaccaggttgggtggggggcaggaaggcccctgcatcttttaaagggaagctaaacctgaagccggtgctgtctgtactccctcaccccatcctgcccccacttccctggtttatttcaccagtgccctactggtggacttcaggtttgtttcagagggtttcctattttaaacaatgccaccacaaatatccttgtacctgtctttgtccttgtgcttgtatatctgtaggacaaattcctggaagtggagttgctctgtcaaaggatatgaacgtgtcaaaattacatagacgattttgtatttgttatttttgtggagagggagattatagctttcatcagattcttaacaggtctatgaccaaaaaagtttctgaatcactgctctgcagtgggcctgtgaaatttgcacaggataatctataaatattggtaaacatagttcaaatgcggggcattgctgggttgaccagataatttgtcatccaaacatccccacctccatgattactaaatatgccgagatggccagataacccagggttgttcaggtaactggcagtgtgggagcccagtgcccactggaaatcttatccctgatctctgagactgtgttctctgttcaccaccagttagcgctgaa

SEQ ID NO: 120926 - DNA, 1021 bp, Homo sapiens
aaaaaaaagcaacttgcagaatagcagatattagagggtgaattgtgtcctcccaaaatacatgttgaagtcctaagcctcagtacctgtgaatatgactttatttggaattagggtctctgtagatataatcaaggtaagatcaattcattaaggtgaatgacgaatcctgtatgactggtggcgccccatgtgaagagaaaaggcccagagacagaagtacaccacaggaagacggcttgtgatagcgaaggctgaggttggagtgatgtggctacaagccaaggagcaccagggattgctgacagccaccaggagcaaggacagaggcgtggaacagactctccctctgtgccctccagaaggatccaacctcaccaacactttgattttgcactctggcctccagagctgcgagaggataaatttctgttattttaagccacccagttgtggtaatttgttatggcagccctgggaaactgatagagcaggtatggcattatcccgtagccgtgccttctgtgactgcgcctgccattctctccatgacaaagagcttcttcagtccatttcctaccctagcaaccacctccttggaaacagggactcattgtggttgtgatttttttttgttgttgggggacagcctgagcagggtgggtttgcatttcacctcctttgcctccttgccccaaagtggagttctaatggcctcttggtgggcttccttctcctcatccttttaaccctgagcattctgaattactcagagttctctgatcatgcctggtctttgtgcttctgacttgttctatttgccaagtcccgttcctttttttgtttttgtttgtttgttttttgagacagggtcttgctcgattacctaggctggagtgccctggcacaatcacagctcaccgcagccttgacctcctggactcaagggatcctcctgttgcagcctcccaggtggctgggactacaggcttgcaccaccatgcctagataatggggtctt

SEQ ID NO: 120927 - DNA, 1005 bp, Homo sapiens
gagggcagatttgttaacttgcacagcaggtggaatagctcacccagagaaccatcagtgccacgctgagaagtaatgggctgcttggagctgcttccagctccatgactgggttttgtgtcaggagatgtgggctggcacctatgagcatgttgggagacggaccaacaccaggggcagcccctcatctggacccagcctgggggatcctggaattgtcttgacactgactttatgaggagactgattctcatgccataaagaacagaaccccacctccagggacttggaaggggctctgtaggccaagattagtttccagtggtttgggaagggatggaaaagactccgttagtacctttctgcccttgcccagccagtttggctcaaggcagagcctgctgcttcgtgtagcagttccaggtggcccatttcttcttccgggggcggggggatcagggagtcctcttctgtgttcaaggcccagtggctccaggcctctgcaagtcgcccacgcgggctaggaacaaagtccagtgtgttgctcctgccgccgccgtaaccatgccacccacctgcccggctctgccctccgcctccctaaacccatctgccatacagtgtaggcttcttcctctttcctttgttcccactgactgcagttccacctttggttgcggggaccctgtggccagagctgaactataatggtgcaggaaggggaatgacttcaagtggaactctggaaccacatggctctcctcttaacacagagaagctgaccttggccacagatggattttcagggataaagaacaggacatggggccgggtgcggtggctcacgcctgtaatcccagcactttgggaggccgaggcgggcggatcacgaggtcaggagatcgagaccatcctggctaacaccgtcaaaccccatctctactaaaaatacaaaaaattagccaggcgtggtggcgggcacctgtagtcccagctactcgggag

SEQ ID NO: 120928 - DNA, 1027 bp, Homo sapiens
ggatgaagagggttattccggacagggatgtctccccaaatcttggactctatgcggatgttacctcgctccattctgtgaccactcgttccaccaccacagtgctcttcaccctgccctcccccagatattgccctatgccggcccctggtggcctgaagagtgagccacattgtgtgtagagctgggagatctaatatcaacttgattctgcccctgaatcagaattactgtgtgcccttttgcaagtcccttcccttcctcaggccgtttctccatgtataaactgaaaggtctagccctgaccctctgatactgtatcctctccactggccactgagtacccctccccaccactgctgactgtgtctgccctgcaggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctggtgagcctggggtgggggcggaagggatgaggtgagcacaggagggcctcaccacccaggctgcatgctcccccatctttccctctccagatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcggtaaggcatctggctgggagcattccagtaccatgtaccacacacatgcattctgtagaagggggtgcgatttgtatcacagacatcacagatttgtacatgtattatttcaaatttccaagagacacagttgaatgttttgcttttacaagatgagtctgacacagggaagagtctctgggaagagcccttttccagtttgcacaaaggcactc

SEQ ID NO: 120929 - DNA, 1179 bp, Homo sapiens
atttgcctcattgcttcccgagctgatctcctgtagttggaacacacacctgcacgtgcacctgagcaagtgtatgcaggcacacacaccagtctggagtgtcagcttccttctctctgccctgttcctggtcgattccttactacatttccgactttgcaggaaaggggttcccttgcattcctttccagaactaggcctattggccactttctccaaattgcactctcccctctgcagccccccacacctccgcagagccacagtgtttgccaacgggtctctgctgctgacccaggtccggccacgcaatgcagggatctaccgctgcattggccaggggcagaggggcccacccatcatcctggaagccacacttcacctagcaggtgagtctctgggtctggggtgctgatgtgggaggctgcctttaacatttttggcacatagagatttaggcttctgtttttactcagccgcttggagggcaggggaagaaaaggatgctgggagtaggaagaggatatgcagagggctgcaggggagggtttgtgctgggaaagggcctaggcttgctgtgggagaacatcatgtaccctgagacccacaataattgggccattcctcctacttatgtccttgcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatcta

SEQ ID NO: 120930 - DNA, 1081 bp, Homo sapiens
atccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtctctcctatcagctcaggtgttcaggagcagaggttgggtctccattattgtgattttccctttgtgcctgtttagggctttgcccaataggaggccccatgaaagcaaaaatccttatgtgtagctatggtattaaggaccagtgattcagattagatgtctgcagttggcttcatctcagaggtcataatcagctgcatcacta

SEQ ID NO: 120931 - DNA, 1015 bp, Homo sapiens
agaccagcctgggcaacatagcaagactctgtctctacaaaaaaattaaaaacaaacaaacaagtacttatgaatgctttatgtatgtttctgctgctggcgttctcctttgtttgtttagattagattgtaaagctctggaggacaggggtttcctctcaggaatctttgagggcagagggtaggggactgttttcctcttggctcactgaagatgggggctctgttgccccacctgtctggaggttccccttggggtagaaatgccaattctcctcctttctaactgagacagcctctaggaggcgtctcctatatatttttaaagttctgcactcccagtgaacttccccctgggaaaggggcccaggctagcttaggccttctcactgcctccccaggcaggaattctgcgagcacctgcttggtctgaggctttacagccaatggctgtgcactgacctgagcgagatgcctggcttttcccttagggagacctcaagcagttcctgaggatttccaagagcaaggatgaaaaattgaagtcacagcccctcagcaccaagcagaaggtgaggacagggagtgaaggagggagggagagggtgcccaggggtgggccaggagcaacagaggcaccatttattgagggctctctatgggccaggccctatggtaagaacttcacatgtgttactgtaattatcacggtagtcgtctgaaatatatactactatccccattttgtggatgaagacattgaggcttaggaggttgtctgacctgtcccaggtcatgtagcctggaagtggctttgcattgccatgctggcttcacggagaagagctaccctcggaccttgcctctgggcaggagcttgcattggagcaggacgcctgcccacctgcaatgagctctgagctggagaagcagcaagcagtcctagtgcaggggcctgctgggctagctgtgggcctgagcgtgtttcttcagctctgagtggagaagactcttc

SEQ ID NO: 120932 - DNA, 1030 bp, Homo sapiens
aggattgcttgagcccaggagtttagaggctgcagtgagctgtgatcatgtcactgcactctagcctgggtgacagagcaagaccctgtcacttgaaaataaaaaatatcagctatgatttctgcccacttatttttcactggacaagtggttactatgtatgtgcccttaggcccatgtgccactcacttaatctggcacttgctgtgtgtcagcatggtgtcaggcactttagtttgcttagttcagtcttctaacaacccaggaaggcaggtactgttattatccccattttacagagaaggaagctgaggctgttgtgcttctgggcttcctacgcagcacaccaatagtgttgaaacgctaccaagggttgtgttgagggtggtcatcttgatgcctattcctgggctgctctaacaggcccctttatctctccaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacaggtagaagggcatgcgtggggtgggggctccccattttttcccagagggtgaggggcagaggacagatagtttggggggtgtgggaaagggtttagtgcctgcttagtccaaagctggagggcctgggatagggaagagctttctcatcctttttccaagggtgcagcaggcttcccacccagtgcacacccttggtggttgtaaaatgtctctagcgattaaataaataaataaaccttttttaaaaaataggcaaatttgataaggatttatatataatctatttatatggctctctctgtaacttcctgaattcagtcattattattttgaagtctgagacttatgcctcagcacccatgccagagcttgctctagacagcctacgagggctctgcagcgctgccgggaacatcaccctgagtccctctggttcc

SEQ ID NO: 120933 - DNA, 1401 bp, Homo sapiens
cccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgtttctgagattcattccctgctcttgctcgtggaagatgttcctttttcccccgctgatgagaaggggccgtgtgcaggccgggtgcagtggctcatgcctgtaatcccagcactttgggaggctgaggccagtggatcacctgaggtcaggagttcgagaccagcctggccaaaaaggtgaaacccctgtctctactgaaaatataaaaattagctggacatggtggcaggcgcctgtaatcccagctacttgggaggctgaggcagg

SEQ ID NO: 120934 - DNA, 2859 bp, Homo sapiens
ggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgctggttggaaggacaggcagggttagggaccaggtaagggagcggggcaggagaactggtgctgccctgagcagcaggaacctagtcctgcgccggccgtgagtcttccatggcatccactgggaaccacatgctcctggcaggacccgctgcagaatctcctgccgttaggacaagtggggtttccagccctagggagaatctatgcttggatggggtttgggggaagtcagggaggcttgcagaggtacctaggaattcctcttctgccagccagtgaaaagtgttgaggaaaggagtcattttggggtgtagacgataagggaagagatgaaagcagaggaactgggagacaaggagctggatccttgggaacactggctggtgtttatttctgtcccatgtagaaaccagagctgcttccaaggtggtttgcagaactttgttgggagagtatggcatctatggggccatccttgaaggtccccttcctgggctcatggcaggatgtttagtgctaatctaggtctcgtctcccatcactccagacactgttgtatcagtgtcccttgtcacttgatcatcagtggagaagattgtggggggaggtaattaaggaaaactctcttctctccttccataaccttcttcccaagacaaaggagtaagggcagtaaagtattacagggcaaaaggagaaactaggctgtggcaacaagttggagcctgtgcagtttctggaaagaaacatgggacagttggagcttaaatggtccattatcactaatgtcttgtacaaattccagtgtgataggtagggatccatcctggtccctgtgacagtgagaaggggtgaggctctgggacattccaggcactaagctgtgttggggagcagctagctgggtccttcgtatcccctgaagttatatgttccatcactgggggctgttactgtttgcttggggtatcttcaggtcaatggggctgctcctcaaaggaggagcatgggtagttttgctgcttccagagatcctgataggacaccctgccctcagagtcattagagacgaaggtcattatgggaatgggggaatgacatcactgtataattctttttccaacttctcaaggaaggtagagataaaaagtttgctgacctgcccatctccctcctcacccctcaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggtgtgtttgggttgcctatgtgagaggagggaagggagtggggtccctctccctttctggcccaggacaggtggataggtgcccaccgatgtggagtggagccggattaacgaccctcgtcctaggggacaggtgtccatcctcactttcctgatagaagaccgcccccctagataagcgggcggcctccgtgcccatataaggccggcttgggctccacgccggcctcccgcccgcagcccgcctgcctggcagggcctttgcattcctcccgccagctgtctccccgctaggggcgggggtgtagtttagcccggccctccgggctgggtcgccagggagtagaaagggagcactccggtcccggggtcctgggaatccagcactcttggcaggcgggctggttgactgggccggggactaccttacaagccagccgctgccctttcagggtgttgggggcctgggcagttagggagcgcatttgcctgctgctagggatgcctgcgctgttactcctcccccttccttttcccggtaaggagagggggtggggcttcctcccttgctgtctggggagctccaccttccgggtggcacttaactgactggccaatgggaggaagcggcactgtttgccttagcaacgcctctgccaatcaagggtcttgggcccagctgctttgcaaacgtctcgtgctgacccaccccgcagcctttgagcctctggttgactcatttcgggtctgggcttggtggcttggttctcagtttccttcttccccttctaagaacgaagtcttccttaggggagagtcagtgctgtaggctacctcctctcttagtggcatatcatctgtaataatttttaaacttttataacagtagggctcatttattcccaggaaattttgttggatgagtacattcttttggtagtttacatcttgggtgtttgacatatagtgtgtcattgccagattctcaagatctctctcaaactcttaagttccctgagaaactcagttcctatctcagaagcctgacaaattagagctggaagaactctttgaaagaaaacgtagtagcccagccccctcatgcttatagaagaggaaaaccgaggttcagaaaaggggactggttatttcagggtcacttagatggtcattaccagagctaggaacagaccttgg

SEQ ID NO: 120935 - DNA, 1027 bp, Homo sapiens
cagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttg

SEQ ID NO: 120936 - DNA, 1380 bp, Homo sapiens
aatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagactgtggggtctttggttctgtttttctacttagggagggatgggggtatgaacgcgaggcaaactcctaaaattgctgctctgagtagcgatccgggctgcttgatgagaacggtaatgctaaggtgtgctttgggctgtttaattctatacgatttaatttaaggaaagttttgcggggccgaggaccttctccctgtgcgtggcttcgctaggtgttaaggccaacgcagaggagcaaattttaattaacaggaaaagtgacacaactaatccaaagcattgctgaagggtttgggaaactcatgggcacctgacctactgaaaagtcaaaaagggcagccttaaggtgggaatgtgggttaccatgtttcgtcagcatgatcgctgtgatgggagagggaggattaggagggccga

SEQ ID NO: 120937 - DNA, 1048 bp, Homo sapiens
acgcccctcttccagtgcagccgcccgcggtagcacgcatgctccactcgcgcgctgttccgccacgctcggcgtgggccgcggtgggacccgtaggtgcccggccgtgcgtgcactcgccgtgtgacccggaagggagctctgaggaggcggggccaggacggcgggaccggccgctgggtcccagcgagggctgagccgggcggtgggaggtgagaggagagttctgcgccgacccaatccctccccttctcctgtcccctccccggtcctttagccactgtccatggggctgacgaagggaaccaggtcttgctctctgagattcactggatcttttcagcttttttggaccgcgcccccaaccatccttccccctccccccaaacccgttccctctgcggtgctggcctcctccacctccccacggctctgcaagcttgggcttgaccttgctatctgctggtctcatccatgcgtccagagctcacccccacacctcagtttattgttgctcttctaggccgacgttacacctcctacctcctcctatccgattcttttacttccccctgctgctaatcagttgcccgctggcacatcgctggctaccatccaggcttgccccccatcctaagtggacccctacctccattgaggtccacatccatctttctccctcctcttcacctctactctcatcttctgtccctgtaccccaacatgacccctgccctgaccactatatcttcatctgggtttaccttcttccattcttattctcactattccctgttgcccctgcactgcttcatatcacgcatatctttcctgattattccactcccatttataatcggtcttaataactttgcatttatttgatgactcccctaccttctccatctaagaataataacagattatgtttactgaacactctttatgtgctagatgctgttccaagtgctttacatacatgatcctactaaattcatgaagtaactatgaatattactaccatcttgcagaagaggaaacaagctca

SEQ ID NO: 120938 - DNA, 1051 bp, Homo sapiens
gggctgggtatgactaaggagactatcagggcaggagcagaggccacagcatcaacagcggtacatctgggcccttggcattcctggcacacccctgcccagaggcaggagtccctgaccagccagcttcctccatagcatgacctgtgccaaatgtaaccatggattctgctggcgctgcctcaagtcctggaagccaaatcacaaagactattacaactgctctgccatggtaaggcgctgggcactaggggagggcagaggcccagagccgtcggggaggggtgctgctaccaggtcctgggcagacagggctccttgtgcagtgcagcattctagctgttgggatagaggctcactgtggggaagacagagccacctgggcctgcagatgctggaaagtctgttcacagggaccttcagctccagaacaggacttctcataccgaggtggctacagaaaggctggggagggctgggcactctcagaaggcagcagggcagagcaggaaagagcagggaccctgcatttagagcctggctctgctgcttagcatgtggctttgagcaagttcatttacttctccaagcctcaacagcctctgcaaaaggggtgaataatatgacctactccacacagtcatgaggactgaatgaagataatcgggggaggtgtagaaaggcctccgtgaatgttggcttttccacttattaactccctcctgtccaaacaaaacacccaatagccctcccaacgtatccttgctaggtaagcaaggcagctcgccaggagaagcggtttcaggactataatgagaggtgcactttccatcaccaggcgcgggtgagtcgggaggaaacagcgggtagatgcctgcagaagcaggttggggtggtggggtggaggggggtgggctgaaggtctgaccgggcaggtggtgctgcgccacctgtgctggtactgatacaccttcctccacacaggagtttgctgtgaacttgcggaaccgggtgtctgccatccatgaagtgcccccgcccagatccttca

SEQ ID NO: 120939 - DNA, 1040 bp, Homo sapiens
ccagccaggggaggtggtcagggtgaagagttagacttggtggcagggttgagaggtggctgaggtgagggcatggtgggtgacgttcttggtggtctcccttctgcagcctcggaatgtggccgggtttcgaggaacggttcgctatgcctcagtcaatgcccacaagaaccgggtgagtggcaaagcccgggatgcaggatgtggaggtgggaggggcaaggtcggggtgcagtgtgctgctggggaggggtggggagaggagagtggggcaggggctgcaatctgccaccccagagaccctgggctggaggaaggcccctctgtggcagactcagtgtccccttcctcatttgtttcggaaaccccatcctctctgttctcactacagacccctgtccggtgaggaagcacacacggtagttttggctgtgggactctgtgggtgttggagggttggggatggagctgtggcctcagggagaccccagttctgtccttaggggcctgggtgtcaggcctccctgacagatgcccctcagagaagggtcagccgcccattcccagggaaggacctgagagctgcaggtgactccctccccccacctccaggagatgggccgccacgacgacctgtggtccctcttctacatgctggtggagtttgcagtgggccagctgccctggaggaagatcaaggacaaggtgagccccaggcagctgggtctgaggtggcagaaggagtgtcagggcagctgggactccatctccctgtggcctcttgcctccaggaacaggtagggatgatcaaggagaagtatgagcaccggatgctgctgaagcacatgccgtcagagttccacctcttcctggaccacattgccagcctcgactacttcaccaagcccgactaccaggtgggagcctgctaccctgcccccgctccctcgacaccactctgtgagtgactgtcccccagcagacctcgctcctgctgaggctccacagccctgccttgtccccaagcctctccccttggt

SEQ ID NO: 120940 - DNA, 1035 bp, Homo sapiens
gggcccgtgagtcctcacccagagaggccctagctggcctgagttggaggagcagccctggcagacctggcagtcaagtgggctggcaccattgcgttgtaactagccattgctcccaccacacccagcaccaggcagcaggagagggagcaaaatgtgtttggggtccttgctccgctcccgtttattcatccacactcactgagtatttactgtgtgccatgtaccacaggcatcagaggtgacttgcacaataggttgtacccgtaggaagtgcagagtctagggagggtgacagacagtgtcaagagagagccgagaattaaagtcaggagactgaggtctggacctggctctgccgttcccttcccagtgactgagggccagtcagtgtccctttctgggtctccaggtgagggagctgaggttcttccgaggttcatctctaaagtttttcttacctgcagattcctacctgtgtcctgggactcatcctcactttggggaattctggccaagcgggtggggagagagagatttggtggggtggggaagcacaggccgattctgtaatcagtctcgggctcgggtcctgcttgtgacagggactggcactacctatgtcagcaagagatgagttgtgtgtgtctttgggggtgaggtgtttgtgggcctcgggttccccacagtgtatagaatcgaggttggttagcactctgcccctgtgcatgtgcgtttgtgtcagcggagctcgagctgtgcactggtggatggatgtgtccacatgtatgtgcctgcatgtgggtgcacacattattgcatttgtgtagaatatgcagcaggtctgcaagtgtgtacagaaccacagatgcctagaatgtcaaagcatttctattgatggtaacaattggagtaataattctaataatgacaacaatagttagcactgtcctaagcactttcatgtttacatgtatattcttcacaacaacactgtgaacagggaatcctgattttaaaagtaagaaaactaag

SEQ ID NO: 120941 - DNA, 1032 bp, Homo sapiens
accacttgagcctgggaggttgaggcttcagtgagctgtgattgtgccactgtactccagcgacagagcaagaccttatctcaaaaataataaaaataaaaataaaacacctcttcccacacttccttgcccaggcccaggtcctccatagcctgggagtcccttattcaactgaattgtccttaccctcaagaccagctcccagcaccagccactcacttctcccatgggtggcaggagggaatgagatgaaggagggacagacatgtagacatatccagaagggtcatccaaggccaagtcatctttaggaggcaatgtagtgcccaccctgcctgtcctcccactctccggcctgagctccccacccccatgctggccctgcccctatccccaactctccaaggggccagcctcaatttatgtttggctctgtctttatctctgactctctgtatcttgttctctgtttctcacttttccttgccatcttctttctgttgatctctgtctctctgtctctttttctctgtgtctctttctgtctcttggtcacttcgtttctctttcccttcatctctcaatctctctatcctcaaatctcaggctctgattaatctcatctttcacttcctgtatctcccgctccccagctgcctgcagtcctcaccagaggctgaggatgcctggggcacaaggcagggtgacagctagcagaagccatcgccagtcccgtatcaggtacccaaccagtgccagcagcatcacgccccctgtccagaaggtgctgctcaggactccagccacggtgcggtgctccacatccagccactccagctctgggccaggacaggagacaggaagatggttagtgaggaccagatgggctcagcctcactctgacaactgccttcttccagccctctaggtcctgcctgtttcttgcctgcctcacccagtggcatcacgatgatggtaaaaccagccagggctgagccagtaagggtgcgggtgatggcaaacattacatag

SEQ ID NO: 120942 - DNA, 1025 bp, Homo sapiens
tgagactcctttcaggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagctgggacactgctgggcacggccctggcgttcggcactagactgctagtgtcctccggtgagcccagtcccataggttctgcccaccccagaagccgggccaggaaccctgcccactccccggagaccccacctcctggccaagaacccactcctcccccagatccctgctcttacccagtgagctcagactctccaccacttaagtttggcccactctggagactccgcaccctatccagaacacccctggctctcctccaaggccctctcactacctgaacccgcttccctccagatatgaagtcctggagcactgtcctggcagtgatggggaaagctttttctgaagctgccttcaccactgcctacctgttcacttcagagttgtaccctacggtgctcaggtgaggaagcctgcaactgatctgggggtatggggcttgttagtcacgtgtcttaaccaacacttctacatacacgcaccacaacctggtctctcactcattttttttttaattttaatttttggtagagacggggtcttgctatattacccagactggtctcaaactcctggtctcaagcgatcctcccgcctcagcctccaaaagtgctcgtattacaggcactattacaggcatgagccaccgcacccagcctctcactcgttctccacactacacccagaatacagagctaatcagggccctctgtgtttgccctagtcttggagaaggcagagcatcttatcttctgtactatgtgaccctgagccacgtcagacatcctctctgggcctccttaagaaaacaaccccaaggccgggcactgtggctcacgcctgtaatcc

SEQ ID NO: 120943 - DNA, 1149 bp, Homo sapiens
gtgaacaccatctgcctccctcatcctctttctctgaacagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtatgaacacaaatacataaggttgttcaggaagatgtgtatgtgtgcacactcaagtatgcctacacatcaggggtgtgtacaagcatgtgtgtgagtcacttgtacaggcgtttgtataccaggaactggggtgagccctgggacagccctgatggggcaggctggggtggtaggctcggggattaaaccccaccattgctcacaactccttcctccctagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagc

SEQ ID NO: 120944 - DNA, 1048 bp, Homo sapiens
atgtacatgccatacttcaggcatgtacatgccatcccagtgtctgggatggggctgcccacctttggggccaaacaggtagccgtagcaggggacgtggcagtaggggactccatcatgctgagacacagagagaaagagagctgtctcagcctggttctcttcccatctccagcctcctcccaacataaccactcattcctgccctgctcacctcagcatgactcccagcagtcagggtcttgtggcaacgctggcacctcagacacggtcggtgccaatttctgcctaatgacatcaccttctcagctggtggtggaaagaagtggtaatgcttccattctaggggtagagtagggagacctacctgccttggatcacctccctcccccttgctgcccaccctgtatccccctccccaagttttccactgttacttaccaaaatagacgggctccccacagccagggcacagcgaggtctccccagtgaatgtcttcatatggggagggcctttaaaggggaagaggccctggctatgtctgaggtggagatgcccaccagcacctgcctgcatatggtgctgtcctctttcaaaagccatgctcattccagagtgccccacccaggcgcccaagagtctgccttctacaggcccagagctgagccccctctgactccacctcctgccccatccctatgtgtattagggactatctgcttccttctcctgcttccttttcatcctcccaggggctcacgtacccaccatcccaaccctgttagcaactcaatcctcaggaaacttgagctgatataggagctggccacagcacgggtgtcaggtgttggggagcacagtgtcattgcctacttcagggaatggagggaaagaacagggaccagaggagaaaagttgaagaatatgagaggctggccttatcccaatgactcctctcctttagatcattccttccatggccctggcctgggacagacctaagttcctggccagctttgcctctgactagctttgtggatggacagt

SEQ ID NO: 120945 - DNA, 1159 bp, Homo sapiens
gtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctcatgtttccttctggatttttgttttgaaatcacacacatttgaactccaaaggaaaactagaacagtgaatccctgctgccctattgtctatccgcacccgcaaccatgctttcctcacttgtcagaactacttcatgccagaatgttaggatatatagtctgccccagcgcagcctgggtgggtagtgagtaggcaacagttgtctggtattggtatcttcctgttgtgaagctttttatatacctttgtgttgactctccgtaggattttctgggaactgagctcccctaggacaatcaggttcttgctcttgggaattagggagctcagtcctcagattttctctgtcccagtttcctcttgtatccctgttgtcagcagtttataacctgactcaaca

SEQ ID NO: 120946 - DNA, 1992 bp, Homo sapiens
ctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagtaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagt

SEQ ID NO: 120947 - DNA, 2296 bp, Homo sapiens
ttaaacttctcaatttcttttttttttttttttttcctctgagatggggtctctctctgttgcccaggctggagtgcagtggtgctatctctgctcactgcaagccccgcctcccgggttcaccccattctcctgcctcagcctcccaagtagctgggactacaggcgcctgccaccatgccttgtattttttgtatttttagtagagacggggtttcactgtgttagccaggatggtctcgatctcctgacctcgtgatctgcccacctctgcctcccaaagtgctgggattacaggcatgagccactgtgctcagcccataaacttttcaatttcttaccttcacaagtagctagtgctgctactatacccttgagatttacagaagatagtttcctcagtaattaataccaacatgagagatcatcataaaatggtaatgggctatttgggagtatagtttttatatttcctgagatgcttggtgctagttagggtttgaggagactcagcaacaggaattaatctggcacaggaaactcctaaattaaccagtataatgttcccaagaggtagaagaaatagaggactgtagttcaagccttaggttggaaagactgtgccattgggattcatctaaatactgcttctgacttcaaagtgggtaaggccctctatactgtaaccattttactgcaaaggggtggtgggatttccattggttgctgtcattctgggtggaatcgacttatttccttgacttttttctacttcttccaggctctgagtttctggttcccatcagtggattttattgccagctctgtgaggaatttttgggggatccaatttctggggagcaacatgtgaagggtcaccaacacaatgagaaatacaaggttggtctttgtagtaggctgtggagtttccaacttttctgaagtaattattttgactttgtcaaatggcgtccgagccagaaaaagccattgacacttcaaattccatataacctctaagttctcctcaatcctagtgggagatgctcagcagatagcatcccgtatgtccttgaggaagataattctggggatttctactaaatgaattctaacagtagcggggccaagatttttttctcttgtattttcaccagtttttgagtctttatcttttttcttcccagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatccgacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcagactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgtt

SEQ ID NO: 120948 - DNA, 1090 bp, Homo sapiens
aagaggagctggcttgctcattgtggctgaacatgacttgcggagtactgtggatggaataggcaggttgggtcggatcttagtctgtgtggaagttgtcacaacaggcatccaagggctggtatgtgcaacaacagttttcccagagagcttgattttgataggctttgccttcccagcttcagttttgccatcctctttgtccttactactttctagaatctcttctttagagatacttggggtcaccaatgaacttttctcctcttctttttctggcttcttccagctgaatttcccaaaagaagatgatgttggtgattccttctttacctcttcttttaactggagtttgatgccagtgttccttttattttcagctttttcaggggagttcctaccctcagagagttggtcttctaatttctcagagaccttgtcatcctcctttacttctttcacagcctttgcctttttttctttcttctcctcctttggtttctcactaagtttgcgctttagctcactctgccgtcgccgttctgtctctaggaccacagccaagccagcttggcggtccagattccgccgctcctcatataatgggttttcatccacatatttctgggaagaaaaaagataaagactcaaaaactggtgaaaatacaagagaaaaaaatcttggccccgctactgttagaattcatttagtagaaatccccagaattatcttcctcaaggacatacgggatgctatctgctgagcatctcccactaggattgaggagaacttagaggttatatggaatttgaagtgtcaatggctttttctggctcggacgccatttgacaaagtcaaaataattacttcagaaaagttggaaactccacagcctactacaaagaccaaccttgtatttctcattgtgttggtgacccttcacatgttgctccccagaaattggatcccccaaaaattcctcacagagctggcaataaaatccactgatgggaaccagaaactcagagcctggaagaagtagaaaaaagtcaaggaaataagtcgattccacccagaatgacagcaacc

SEQ ID NO: 120949 - DNA, 1104 bp, Homo sapiens
atcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggtgaatattagctttgggtatcctgtgcctgagttttctgttttgccataaatttgtatatgttttttagaaggggctgaaaatttgtaaggctctttcacttgaagtcgtctggaggctgctgtcatcatcctaagaagtgtatattgttcctctgtttttcacacatgttttatcattaggactaaacaaaagtctggccttgggtcctattgtgattgtcagccttttttaagtttaattctatccaagttaatggtcttcaaacactgtagataggaactgggagccttgaagtcttcaatatgatttcgtagtggagtagggaaccaaaattgggtgtggtgaaggagaatcagtaaacctgtttgatcccagtgaattctgtattcttaccctgtaatgattatgagttaaagttaataactagttg

SEQ ID NO: 120950 - DNA, 1002 bp, Homo sapiens
aagaggttcccaagcaaaggaatgctgatgagttagcgttccagagtttcctctccccacttcagccaaagcagctttttttttccttttcttttggggatccatagaaaagaaaacaagctaggggatctctaaaattcttttgaattcaaattccttttaacaaatagataaaggtgaggattccatccagtttgcctcacttcctgtttctcctcaacagtagaaacatctggagataaggggattcacattttgaatctggctaaggatacttttcctcccttttatccatacttgtatctcacctgttaattcaggaagaccaaagtatttaagtatttatctcaattactaatgttctgagattctgcataagactaaatcagttgtgtttgtctttgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgact

SEQ ID NO: 120951 - DNA, 1405 bp, Homo sapiens
tctgcatgccctaagtctagtcggagaaattacccaagagatctatctagatatgttggtaatattacctcttggttagaggctaaagctgcttgttcccctggggaaagggagaggaaatgttcttggacttcatgattatagtcttttgccctaagcattttatagcccccttgacaaacaccagtctcttagccttgtctgctcttattctttccaagtccatttgttcaatgatgcttctctttttcctcagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcaggtctctgctgcatttcttgtagggcctcttgctagtctccctaatatcttaaagcctgcttactttcctgtgggctatgttcctaatggtatctttgtaatatgtgctggaccgacattgtgagctacaccttctaggactctccaaacgaaactgtaggccttttaatgcatcagtagagggttctattgctgtatattaggctttatattaataaatagatattttggagagtactgtaagtttttttacttaaattggattatcctttggcaatctttgagtatgggtttgttggaaatgaaccttgaagggcaaggggaggaggtgatctcaattttctcatctctctttagagagaagacaagatgtatgagttgtaggacactggactagaaatcagatgattctgattttggacccacttctgccaccaacttactgtgatttttagacaagtcacctcaccattctgagccttgatatttttccctgacctgtgaaaggat

SEQ ID NO: 120952 - DNA, 1044 bp, Homo sapiens
cttggaccggatccagcttttcctcgaccttccaaaccacaacccccaggcctactacagcccaggtaatgggaagctagtgggcagaacctggcacagggtgaggagggaagtggagccacttgggtgctgcgcatagatgtcaccaagagggcttagagagagcggaatccaaaacagactcatttagctttgggcaggtagatatggggctggcaagtgaattacatgatttaccctccccaaacagattgtggtagattaggagcccaaatcaagtggcttctctgttcagatccccctgcagagccatctacagtattggagctgcatggagccttgttctcctgggacccagttggaaccagcctggagaccttcatcagtcatctcgaagtgaaaaaggtttgttggacagacaccctgggagagtcctcagactaacgagagagatgggaactcatgtcagagaagcagtgaccgagccaatcatagctgatggctctgcagctctaattgctgcaggagggataggcatttggtgagcaggttctaatcatgaggagatgacacctcacatctgaatctcagaatagttgcacctctctctggtctttaggcagcttgtatccatccagtccagaccaatgggtgtgcttgtctctccatgtccctcagaagctgcagcattcagaacaggccctggggtttatgtagcatctcccccagattggggatctgggggagaggcccagcaagtgcttccaagaaatattttgcaaatggggatcctctgtttaggctggtgaaaagcaatcacaccctgtgactcatgctacagcatacaaagaacttaaaatggggcattcctggcaataagccaactcctgttcacctcctgttctgagttttcactctctcctgacctttgtccaaccctgtgccccacagctcaacccggcattctctggtggtggctgaattgcctccaccacatttggctcacgtttctggcttgggctgtatgttttgtttttcctctta

SEQ ID NO: 120953 - DNA, 1084 bp, Homo sapiens
ggtaaggtggcttccagtgacaggtttctggctggcatgctccctgggaggaggatgcatgggcttagagtgatgccaagaaacatttggtctgaaaagggctcacttttatagagtttgtcctttgtctgaggtccttaagttagtgtttggcgtagattgcaggctgacttttgagagttggtgtagaattaagccttgtgtgccttcacctatgcaagtaaacctggacagaggcctagagaccaggccgaaggatgttaacacatccctgtcacaagcagtttcctacatgctcattgtttctgcttcaatatccccatcacttcttcactttggcgtcctgcctggaagtggagatttgtgggtgacagatggtggggagtcacgagaaaacaaattctgatcgtgttcactgaccatttaggtacctgctgtcactgactcctgaattcattctcgctgtgtgtctacttttgcttttttggtaagaagggctcattagtgttcctctggggatgtggattttggtgggggtatcagaggtgagggaaaggcaggttgggattagagagaaaaaatgtagatcagtttctggtaagagatcaagtggactgatgtaaagctctgggaatgtttagcaccgcactgcctatccttgagacccctaatatttgagagctactttacagttggacaagtgtggtgatgcaaagaaaggatcatggaacttgctcttttcttttctggtagtttttttctctcctttgtaatcttcccatcaaaccacttttgaaaaatatcagtctcagtagccaaactaagcatggcctgagaggtagtggatttggtgttggagagaaaggaaagggactggagccagagaacacagtgaatgtggccttcacttcctttggtgagtgttttgccctagccagagttgggagtagccttcttattgaagcctgcttcaggatcagcatcgcttcatggtggactaggatggtttgatctagaactcttcatttactgtctgctctgtacctgtccccccaatcaaaggcttactccaaacagaacaacc

SEQ ID NO: 120954 - DNA, 1038 bp, Homo sapiens
ctccatccatctcaagaaaaaaagcgtctccaaaaaaaaaaagtctgtttgactttgccatttgtagctctgtgacctttattaatggcatagctttgtatgcctcagttttcttatcaatcaaatgtgggtagtaagagtatctatcgcatagggttgttgtgaaggtaaattagttaatacattaatatgcttactcagtgcctgacagtaagttttagttatactagtcagatctcagcactaatttctgtttcatggttgaacctgctgtctctttatatagatagcatctgcattggtttgggctgctagcctgatgttaaagagatgaagcagagcttttggataatacagatttttttgtcgtgagaatatcctcattaggctatttaaggcaatgttaaaatgccagtgatttcctgtttgaagctgtgaggctacacaattatctttgcagttgagtaatgatgataataataacaataatggtgcttattgagcacattctgtgcgtaggactgttgtaagggcttttcatgtattaactaatttaatttttgactttttttttttgagacgaagtctcgttcttgtcgcccaggccggagtgcaatggtgctctcctcactgcaaccgccgcctcccaggttgaagtgattctcctgcctcagcctcccaggtagctgggattacaggtgcccacaaccatgcctggctaatttttgtatttttagtagaaacgggggtttcaccgcattggtcatgctggtgtcaaactcctgacctcaggcgatctgcctacttctgcctcccaaagtgctaggattacaggtgtgagccaccgtgcctggccaattaatttaattttcataatcatatgaagtagataacttattatccctgtcttacagatgagaaaatggaggcagagtggttaagtaatttgcttaagatcacccagctagtaagtgacagagctggtatttgaacctaggcattctagcttcagcagttgagctttttttttctttaggt

SEQ ID NO: 120955 - DNA, 1634 bp, Homo sapiens
aaaaaaaaacttaacagtcaatgtctttcctgaataaaattaataaaatttgaaacaataaataataaaaataggaagtagcaaactacacagaaaaaaaaaaaaagaagtggcattttaaatagcttcgtcccctcagctgaatgggaaaatagaaaacaaatgtgctgctgaagcctatgttgtttgaagaaggccctggcagcggtgctcagtctctccctttagccaggcaggaggcccagtgtagccttgaggtagaggtgtgcccaaggtttcattgactggctttcctttgccctgtatttaagactcactctcctcctccttctgagtcatgtcctgtctatttaacacaccttcagggcccttctttttcttcaacaaatgactctctaccctgccattgaagtaggcatgtgtctgccatctaattagatttcaggggaattgcgggctcaggactttgggctttccctgggaactctgcactggccctctgatgacctttcctatttgtttggcacatgtgattttgagaagcagacggtatctgtcagacgtatcgctccccacttcatgaacttgggagccatatatcttaggatagtgtattttatcttgcattgcgtggcagtcagcgtgctgaaacgtgttatctctaaagagtatacctttgtactttggtagacgtcctcaaattttctggattcgggtcacattttagtaaactatggagttgcaaggtgaaggatgatggattttgagctgattcttcccctttattgttttctttgttgtgtaaatcaattctcagggtgccccttattcagatatttatgaagccaatcccttcacttccttctcaccaccatattttgaatgccaacgacctctgggtgaaggaaccttcatttctcacctggattcaggctcttaaatagctctccaaactgacctcattctagcctctagatctttgcatacactggtgctactcctttgcctacctttttgtccttcaggtctcagtttaaacgtcacttcctttagtatctcacccctgcccccttgagtgcccttcttctgtgcttctgtccgatacttatgctgtgtcataattgcctgtttacttgtctgattctcataagactaagtgccctgagaacagagactatgtcttattcactactgtgtttgtagcatttaggacagtgctgggccttaataggtgctttatgatgccgtggtgcatgtagaatgaataaaatgtggtcagcagtctcttctcacaccagtctatcttccatggtgctgtcaaaattatttgcctataaaatagtcttcctggctgggcgtggtggctcacgcctgtaatcccagcactttgggaggctgaggtaggtgaatcacgagatcaggagttcgagaccagcctgatgaacatgatgaaaccctgtctctactaaaaatacaaaaattagttgggcgtggtggtgcgtacctgcaatcccagctactcaggaggttgaggcaggagaatcacttgaacccaggaggtggaggtttcagtgaaccaagatcgtgccattgcactccaaactgggcaacagagcaagactccatctcaataa

SEQ ID NO: 120956 - DNA, 1274 bp, Homo sapiens
caggtgcctgccactgtgcctggctaatttttttgtatttttagtggaggcggggttttaccaagttggccaggctggtcttgaactcctggcctcaggtgatccacccacctgggcctcccaaagtgccaggattacaggcgtgagccaccacgcccagcctccccatctcttgttttgtgatgactcctttgatgatcgtgatatgctggccttctccagttctggtgaggttggtggtggtggattcgtaatgtaattaaggctggggatagacagaaagctgctcacagtggatgactggatggagagtttcaatatccatgtttccccatattttatggattgaaaaatgggtgaatctgatggaacacatccaggcattgaggaagccagacttcttggccccacttttcttagggctttaatggtcttcctgtgccacagaacaggcttaacttggatgcttcccacaagtggggctgatagctgcatcatgatccattctttgcttttttgtttctagtgtagttgatgggggtagtccttagagccccaattgctaacaaacaccaaatgaatttctttccagaattaagtgtataatgccagggatactccagtgcgagtttacaatcagatgaggaagatatgtctgagttctctggatggcagccttgtctggtccttaaacccttgtcccagctaggtacctctcctctgtgctctcaaagcactcaaccacactgtactggaagtgactgttaacctgtctctctcccactaggagtaagatcttctgtctctgaagcttcttaggggcaagcttttttactgaaggccaagcatttaggcactatagagtaagtgctgagcaatgttggttactgtgtgacccaactcagtccttcctcagtgggattaaagaagatggaatctatctggcaaaaccttttgcaccctcaggaaggaaggtcctgcataaacaaaaggtgatagtgttaacaatagcattactaattattttccaggattgcattcatgtggttaaatcatcttccaggtgcttggcttcagctgtctcccttttagcctttttatgttttttttttttttctttttttgagacagagtcttgctctgttgctcagggtggagtgcagtggcgcgatcttggctcactgcaacctccgcctcctgggttcaagcaatgctcagcctcccgagtagctgggactacaggcatgtgccaccacgcgcagctaacttttgta

SEQ ID NO: 120957 - DNA, 1016 bp, Homo sapiens
tcctccatccttccccgcagcctggctgcctccctccttagcttatatcacgccatctcctctgctctcttgttcttactactgcgtccctctattttcccagtctccctttgctgtgggtggggatgtgcccccttcacggccacctgcccatcaccagcctgctgctgggctccactgaccaccccccaccgtcacccttccccgagtcagcagcgtgctcttcacttctcccttcatacagaattggttcgagtttctgttgaatctgtgcttttagcacagagtttgagaagatccctcaattaccatgctgctgctgcttctcatgcctcagagacagatgaactagagtgggaagggacttttctcctagatcagatcatttcctccctttatcaagaagggaaggttggatagtgtccctgttactctcaccctaggataagaagttaggatcagctgcaaggttctctttaggattggggaggtagaggaaaaccttgacctggttctggggaattccctgggcagaaaagtgaagctacttaaactgaatgctggggccccaaaccagggacccatgtgagatgtcactcccattggtgaccgttgctctgggaggtgaagtttgtcccccccacctcttttcacatccggagtttctggtggactttagccatgaaaagctgggaagggtgcctcagtagagtgggggcaggacctggcttcggattccacactgggctcagaaaaagtcctggcctcagactgggagatgggtgcgtgcagcctggcttggagaagctcccacgcagtcccttctccctccaggcttgggaaggagaggcgggtctggagatcatgagaaagttgattgcctgttgtttcctggtgttccacacaggtcactctagatagactgtggcttcggcttccggaggcagtgtggtgctagggaggctggacagggggagcttgagaacagaaggctgcctaagtggattctgttcccc

SEQ ID NO: 120958 - DNA, 1491 bp, Homo sapiens
ttgattcattgacagctgagagcagaaaggcttcgtagtaggttcagaaattatctgaacccagataaactgatggggccacaattacctgaagtaggtattggtgatgtggagagtagggaggtagttgctctctagggcaagctagctgctccaggatcaggagagttgtggagtgaggtagtagtgcagaacgtggggagctggagatgtttggtggggaaggctgaagttggaaaagccaaagaaccatatccagtctggattcctgtctccctctcctgggctggtgttgaagggatggcctcagcctcagctgggagaaggatggatgcttgaacctcctttcctcttctgcatctctgactttgcctgagctttaggcagaaccccggaaaggatggcagaagggaagtgggacggcatctttggctcttgggctggaaactttttgctgttgctcctatgggtgcttgctgggaacggtaagatagtatattggggagcagcaggattctgaagagatttctctctcataccactctgtctctagcaacagcaatcttccaccacggtggaagcccctgatcaaatatgcgtacccacaaaagggagcaggtataagtcccacctcctggttaaagagtgatgcttggcaaatttttttccttttattaaaggacactgctcagccagcttctggtacagatcatgccttacacctattctgtctacactctgctcagctgttcagagggttcacagtgcagctctgctgtgcgtgccgagtcccatttctaatgaaagtagactttgttctctgaaggcagctaatcatgccccatgggctgtaatcagggagaaggtatttaatacagggcaggcggcaacaggcggcctgcaccgactggcaaattgcaacatggcaattaggaagctatcacccctctctccaccccagcagatatgaagtagagtctttcctttgaactgatttttgagtaagcaaagaatgaatgctatgcagagcatggcagaagctggggttggatggggtaggatgcagcaggggcagggagggttgaggagagtcccttttccttctcacttcaccttcatgggatggggaagggttgctgctactctgggtgtctccctcaacactgcctgcaggtccagcccaagaagccccaggccacgctaggtcagcgagaggttttaacctaggcctcaacctttctcccagggcatagctgttcttacagaacagacccagcacgttatctggtagtccaacatcctgagtcatctgccctcagttcctcaaggcttaggtttagtttggggtgggggtgggagtgggattcttccttgttgatttcctttttttttttttttttttttgagacggagtctctgtctcccaggctggagtgtagtggcgcgatctggactcactgcaatctccacctcctgggttcaatttttgta

SEQ ID NO: 120959 - DNA, 1022 bp, Homo sapiens
cccgacagtgggaacacatgctttagcccgcaaggcttccctcaacctccagctctgtttaggttgatgggggcgggaagagattgttttttctgcccagaaggccacctgaggttactgcctgatcactggtggctgctgcccccgtgctgcaacccagctaattacaggtgggggccagggaggggtgtgcacccatctctgaacctcaggaggccggaggggctctcacaggtcactcagtccagccacctctgtgtagataaggaactgagctatccagtgaggaagggcattacacagggccccacagtgtcagtgctgagcctggagcccaggtgtctccaactcccccgactggggttttcttcacgagtgttcctcagccttggcactctggatattttctattgggaatcatttgtggtgggagttgccctatggttgtgggatgaccaaagcatccccggcttctacccactaggtgccagtggcactccttccctccaggtttcgacaaccaaaaatgtctccagacacttgccagacgtccctggggaaggagagtgggcgccagacgtccctggggaaggagggtggacagagttgcctggttgagagctactgctctgtgttgctcccttttcagatttcttctcctagccctatgcctcctcattgcaaaggccggtgaccatcattatacaccaaatagccttgggcctccttctggaaatgctaggtgctctctttccatcattttctctatcttcttggatctctgtgaggctttttcctggtgttctcatttgtaacccatgttccccaaatctcttagttgtttccaaactctgagaggcttgggagatgaggaccgatgtggagtagggacaggacggaaccggacctattccagaattgggcaatgtgctgagaccatgaacacacagacacatgtatctcatctgggcctgtgacagtactgtcatggagaaaggcaggaacccagtgcttccagtcat

SEQ ID NO: 120960 - DNA, 1824 bp, Homo sapiens
gtcaatggacaaaggaagccacctacctccattttctgccagaggctgctcttctgaagcagtcagttccacatagaataggccccttgatgtttccctctcgcgatagcaggggcctactctgctttgtggttggctgaacttgactcttgagccatgactgccataggggtttggggaagatggggcaggaggttaaaagacagacaaggcacttcctccccttagtcaggattagtcctcttctcccatgcacttgttcttcctgagcctctgcaagagcctgattctgcctttgtcttcatctcaaggctgagggctttgtcagagctcagaactcgtgtgtatagttcagcctgacttttctggaaggtctctgccatacctctgtggatacaggacccaccaggagccgagtgaacagctgagaggctgtctgcccctggggagaggtagcttgggtgccaggacttatttgaaaatggctttaggattggattaagggtgaaggttggaagaggttcttgaatcttctggttggcatgggagagggtagtcgaggcttgtcccagcattactgaattgcttccatccgtagagagccctgcagccctcttctgctataagagtctttgggcttcacacctgagccttcttgtggctatttggagggtgagccagccgggggtccagtggtccagagctgagcctcaagcctctcttttttgcctaggaacccctgactgatgcagaaaggatgaagtgagtatctgctacctgagatactgccctgcctcaactctgtccctcttagctccaggctagactgttggtacagttggactttcccttggattaggtagaaataaaggttgggatgggttgttttagggactctgggaggagtgttgatgttgtggatattttttctggaaaatgggattttattgttccatgggcttcaagagagcgtagaatcaggaggcgaatggctctgagggccctgctcttcttgctaaggagcccttccccagctcctggctcctgtaccagctgccacccttacagccctttagccacatgaggcctctggagaggagggcagtgctgggctggatttccaagagatgaataatggagaagcctgattgtgcagtggggaaactggagctgggggcttggtggccagctgacatgggctgtaaccagagacaggctgggagccatatccctacccccaattctttatttctattctccgatagtgaagggaggctggactgtcccctaccatcccctcttcctcccctgaccctccaacccaggctgtgttcccagggccagcaggcctatgaaatatgctgccttagactcagactaagactccaggagtttccctgtcctgtttgcctgtcctcatgtcatcccttccttcctgagcccactctggagctccagggcatgcccttctatctctcatacccctctgcccttgatcccacaacaccctgccaggctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggtgtgggaatgaggggccagacacacacacacacacacacacacacacacacacacacacacacacacacactctctctgtctctctctctctctgtgtctctgtctctctcctttcataggaggttagctggaagatgccttagag

SEQ ID NO: 120961 - DNA, 1815 bp, Homo sapiens
gttagctggaagatgccttagagatcatctaattcctattagaaaactgaagttcttgagggagaatgacatgttcaagatcccctatcggggaggctgaacagagcctgaagaacaggatcttgacccagggatgtgccttgtattatcccttttcaggctgcagaacagctacacggcttcccagcggaccaaccaggagttggaggacaagctgcacacactggtaatctgtctgggagggcagcttggtgggcactgtgctcatagcatagcagggggccaggatttgccaggggaatgccactctgccctggggcttgagggagatggtgggatggggcagtggtgggggtactgcagtgtgctctgcaagtcaagactgtcttaatgctcacactgtttctcttctttcctcgtctccccctcatgctgccaccgttgctgctgcactctcctctcaggcctctcttagccacagctggatttttgcagttgcgtctgagtttgtgtgtcttctcccttgccctggccttctcctcagctgagatctgggattgtgggccctggctgttaccctgtgccccttgagtacacccgctcctttctcttccctgtatgaggcccgtttaactgtcaatgcctccctcccaggagagaggtggggagcctagcctgctctgcccttggctctggtagaggtactgattgatgtctccactgaacacccaaagcttcttggctccagtggcagcaagcccaggctgtgggagtggggaggggaggctgcagatccagtccctgaactggagatcagaaggctacttttgagcctgcagcttgctccctgctcaacaaggtgccctggctgccaccgcgccctgcttcctcttccctctcctagcctgatgctggaaacagctgcacacataggaggcttcagccccctggtttgcagttactgccgttgaggtaccagctgccttgcctggtgcccagagcccctggaacctcaggggatggacagctcttatactgcctgtgtcctgggcccaggtggcaggaagtcatgctaagaaagcccccaccccacagccagtccagagagcgggagagatgcccagtctccttctgtctgtccgtcatttgtctctgctctgtccgccttggctgccctagcacctgtggcctcttgtgtctccaggatgggaggaggtggagggagaggaagggctggctagagtgtgggctgggttaacctcaagtctgtgcttcagatcaagaaggctgagatggataggaagacgctggactgggagattgtggagctgaccaacaagctgctggatgccaagaacaccatcaacaagctggaagagctcaatgtatgtgcgcttcactactcgggccttcctcacctggggctagctttgtcctggctcggccctgcttccttggagagggctgggctgggctctgaaacaggtctgtgtctgtaggagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagaga

SEQ ID NO: 120962 - DNA, 1008 bp, Homo sapiens
tgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatggcctaacttgtcttaatgacctcccctctcccacttttctccccattcataagtattcccagtcctagtctcatcctagtcggctagtgactccccctcgccccactctgcctagggtttccctaggcacagagcatcagggagcgggaaagggggcaccttaagtaaccttagcagggttcctgagtcttccctcggaggcagggaccatatctttatggggctagtgtaaggtgttgcctcagaggcctgggttctaggcctggccaggcctattttgagatcctggaccaggtcacgcagcttagagcttgggctgtgcgatgctactgccccctagtggtgcttactggtagttccaattcctcccctactgccggccccaagtgactacagccacacgacaggttgtggagttcataaaatcttttccgagccagcgggttgcagccagagctgc

SEQ ID NO: 120963 - DNA, 2290 bp, Homo sapiens
ggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatcgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctggtaaggagccaggtgtggtgggcaagagtgatgttaaaaagagtagccaggccttggtcggcatctgtcctggggccccaaagcctggaatgggaggagtaggccaatggaccatgtgtttcccagggtccccatgaggggccagaaagcagcccaacctgaatgattttcctctccaccatcctccttcccagggctatggcctctttgggcattgcattgtcctgttcatcacctataatatccacctccacgccctcttctacctcttctggctgttggtgggtggactgtccacactgcgcatggtaagctgggcaagaggcttccaggggtgggctgtcctcccagggagttggggaagacagcctggagctgtccatctcacaaagagccctaaatgggagggaagagcccaaagatggttctgccctgggtgggggtgtcttgtccccactcctcactttggagccaggccctttgagctgtattctcatggtcctaggtagcagtgttggtgtctcggaccgtgggccccacacagcggctgctcctctgtggcaccctggctgccctacacatgctcttcctgctctatctgcattttgcctaccacaaagtggtagagggtaagtggcaggaaggtctgggtgggggagaatgggaaagcagctgcctagagcaagaagctagatatgatggctggtgggctgggcccatctgatcctcgctcaccttccatcttccttccagggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaactgcagcggctgatccagtggtcctccctgtcatcccgcttcctatatactttcctactcagtcaacagtggtaatgtcatatgttcccttcttcatatcctcacccaggcaagataaaggtgggacaggccagactacatagaaggcagtgattgaatatcacacctgacccatgaagcggcagggaggcctcaagcacaaaagccataagcctgatggaacactgcagccagcttgagtctgggctcagctgctctcttgggaagccaaggaagcagtgacaattgaacaaaacatcccgacttaaaccccgtgtcaaaacaaggatcttctgcacctgggcattgtgttgataattttcctgtggagctcttaattgaagccaaatttggctttgccttggtggtactggggccagctccttttagtttttctgtctttcctcttaaaaccaaccaccactcctaacatagcaccatccacccccaccacctctttaatatgctccacttaataagttaattcaggtggctaagagtgggaatagggcctttgacctcccttcactatattgaat

SEQ ID NO: 120964 - DNA, 1457 bp, Homo sapiens
ctgaaaacatactatgtgtatagttttgtttggggcttaggaaagaaggaaatgggcactttttcagccttttagtctttgataggtaacataggagaaagacatgaatggaagactagtaggtttcccaggctagaaaagatagccaaagctagaaaccaggcgttctgagagcatatgagggggaatggagtggcatgatctgtagtgattccaagccgtatcctcagcagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcaggtaagcaagattgaatcctctgcaggtagaaaagtagacctaggtatgtcccgtgttctggaattggtgttggtgatgttcgccccaggttgtccagttagaaccatgtagaaatcaaacggaaaataggcaacaggatctagaaccaacagtaccacaatacctatgcccatcttccttacttcagatgtggcaggctgggaaaagacaagcctccagggccttcagcttgtacgccaacatcgacatcctcagaccctactttgatgtggagcctgctcaggtgcgaagcaggtgaggagccttctcttgaagaagcttccctcctaacacctagaccttcatgcacactacagtcagatttcaagccctgggctctgatgggctccccgtcttcatgaccccatcacctctcatcactgcacctgtcactgaaacaagtaataatagcacaccatcttcctcttcttttccatctaactgactactcatcttccctcaaaacctacctcagatgtcacttcctctgttccacattcctcaatcccatccccagtttgttctctcctggtgttcctatagaactctgtgcttgccagccgggcatggtggctcacgcctggaatcccagcactttgggaggccgaggcgggcggatcacaaggtcaggagatcgagaccatcctggctaacacggtgaaaccctgtctctactaaaaatgcaaaaaaaattagacaggcgggtgcccgtagtcccagctactcgggaggctgaggcaggagaatggcatgaacctgggaggcggaggcggagcttgcagtgagccgagatcgtgccactgcacttcagcctgagcaacaaagtgagactccatctcaaaaaaaaaaaaaaaagaactctgcgcttgcctctaatagacagcac

SEQ ID NO: 120965 - DNA, 1035 bp, Homo sapiens
tgtcccttgagggctcccgtcgctgaaacccgcgctagccccgcgcgcggagtgggcaagatgtgggcctccggaaggtagacgtccagggtcgaggagaggtgggatcggccggaacacaaaaaggagaagcccggatgtttggacaaaagcaacttccggaagctggggacgtggacgggggcggggaaaaatctcgcgatatttaagattccaggaggcggtgcgttgccacggagacggagcagggctactaggacgcacgcgcgagatagaacctctagtctcgtggagagattgaagatggcggcttctcaggcggtggaggaaatgcggagccgcgtggttctgggggagtttggggttcgcaatgtaagccttgtggccttgagctcgggcgggaggaatgagagcggaacagggatgggtcttgggattggcgtggggatagctgtgggctcactgtcccttcgtggacaaattcgtccctttgctctaggtccatactactgactttcccggtaactattccggttatgatgatgcctgggaccaggaccgcttcgagaaggtaagtggggccggagttgtctggggagggttatgaaggccagaccttgtggtctgagcagcctgtgtctgtctcagaagctgctcttgggggtcgctccgtttgtaagtttgttgagcaatgtgctagacgctccgtttacaggccaaattagacacggtttctacccagttctgcaaagatgttcagtcttgttgaggaatggtgtgtataaacagtgaatctagtgtaatatggtgaaggtggttgatagcgatgaagacggcagggttggggtggggagcattacgctgagaccaggaagaggggcggagaggtacttaacatttcaagaggagggtacatctcaattgagccttgaatggtaagtaaaaaagaacaggagttaaattatgaagggtttgtttcaagtcagtgaagttcaggatatacaggttttgtgtgtatttagtcttttgtattgt

SEQ ID NO: 120966 - DNA, 1611 bp, Homo sapiens
cctctggaggttggggttacggggataggtagggggtctgttgggtttttgcagataagtggttatttttccttgggcaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaaattttgggagaagtggactatctgggttcaaatcctggttgactgtgatgttgggtaagttacttatctttgtacatcagtgtctttcatctgtgagaacacttgccttgtctcccaagtttgccataattaaatgggaaacacgtaaagcattcagcatagtgctggcactcagacgtttactagttcttaggagctccctccatttgtgcaggagatgaagaaggcacagagatagatactctacagtttcgtctccaggtcagatgcactcggaacccccatgctgctaaagattcctctgaccccaacgaactgtacgtgaaccacaaaggtgagtagtggtagggtgaggaagaggccccacctgtgggtagctgctagttttagggactgagatcttctgacatgtttttcctccagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggtgagaaccctgtgtgccttcctgggaagggggatagttcggttgcagtggggcaagctgactagggaactcagctgagacattcccggcaggtagaaagccaagagggttgtgcttttgctgttagtagcttaggaggagtattcttcctaaccctagaagggtttcctataggcacgttccctcttcctctccaggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtatggtatttgggatgctgttcaagttaggacctaaattatattttctttcaaggtgacagaaataaaaaccctgggctcctaaaagtataacctggtttgctaccaagtggcaaattagaaaaaggaataaaaaaacatggtttgttctcattaggtaaaaaggtggccagagttgccaacccccggctggataccttcagcagagaaatcttccggaatgagaagctaaagaaggttgtgaggcttgcccgggttcgagatcattatatctgtgagtatgaagtggtgagatgagtgggcagtgctctttggtgctgcagcttccttccagtctagatgtgaagtttatgagtaagttttacaggcaagccctgcctagactaaagtgtctctttggtccccagtctctgttgagtcaacgggggtgttgccaccagatgtgctggtgagtgaagccat

SEQ ID NO: 120967 - DNA, 1142 bp, Homo sapiens
cttttaggagcccagggtttttatttctgtcaccttgaaagaaaatataatttaggtcctaacttgaacagcatcccaaataccataccttggacttcctgcacctcaataacaccaggtgagaagcacctgctcaactcctcagctgcctccccttccacgggctcaagcagggtgatgtctggcaggagcctgtaactggctgttgccactggtgaaaacttggcatgatctttgcctggagaggaagagggaacgtgcctataggaaacccttctagggttaggaagaatactcctcctaagctactaacagcaaaagcacaaccctcttggctttctacctgccgggaatgtctcagctgagttccctagtcagcttgccccactgcaaccgaactatcccccttcccaggaaggcacacagggttctcaccaatgcccttgacacagtgcatgagcaggtcaatttcttggccaggccgcagctgagcgatgaggatatcatcatgcactggtcggatagtgccctctggaaagagatcagcctggttccccagggggatccatgtcatatgcctggtatacactggaggaaaaacatgtcagaagatctcagtccctaaaactagcagctacccacaggtggggcctcttcctcaccctaccactactcacctttgtggttcacgtacagttcgttggggtcagaggaatctttagcagcatgggggttccgagtgcatctgacctggagacgaaactgtagagtatctatctctgtgccttcttcatctcctgcacaaatggagggagctcctaagaactagtaaacgtctgagtgccagcactatgctgaatgctttacgtgtttcccatttaattatggcaaacttgggagacaaggcaagtgttctcacagatgaaagacactgatgtacaaagataagtaacttacccaacatcacagtcaaccaggatttgaacccagatagtccacttctcccaaaatttcattttctcaccttggttccgatactcaaaaagacggggatcagcatgaatgggaatgagccccagacggtgagcaagaatctcatcctgaacaatggatgtattattgtacaccaggaccttctccac

SEQ ID NO: 120968 - DNA, 1025 bp, Homo sapiens
ctggagtgcagtggcgtgatctcggctcactgcaagcttcgcctcccaggttcacaccattctcttgccttagcttctcgagtagctgggactacaggcgctcgcccccatgcccgactaattttttttttttttttttttttttttagtagagacggggtttcaccatgttagccaggatggtctcgctctcttgaccccgtgatccactcgccttggcctcccaaagtgctgggattacaggtgtgagccaccgcagccagcaaatctttcttacctgaaattataaggagaatggtgaaggagagtttgttacaaggatgtcctccttcctatttttttattcctactttttgggccagtgaccataatgtgcagcctgacggaaatgcagctaaactaagagtataatggaattcaatatcagtgccatttaggattttaggaaaagaactttaagattttttcactgttaacacaggatatttttgacatctggcaaatcctttagggattgattctgcccaggggtgcaacccaccacctggcaggtgagagatgtgtgcctatgcactaaaatttcttaacttgttgcagcacgtgtctttgtaaagcctctggtgctcttctgtcccccagagcactatgaagccctggtatcccccatcctcggacctcttttcacctacctccatatggtaagagataagtcaggaacaggaagcaaagagtactattaaggcctctggccatttctgagctttgcaagtcaggagctcctagaagtgttgtctactagccctgccagactggctgggcagagcttctaccccagctgactatccttgctgtaggatcgagcagcccccaaagaactaaactgatttaattgccacaagacagcttcagttgcagattctgctcctaacctcctgttaactgaggagaggtaaaaagaggaatgcttgctcacagacccttgccaggaatgctgggtctgttatccttactctagaattaagcag

SEQ ID NO: 120969 - DNA, 1491 bp, Homo sapiens
aggatccgcctgcctcggcctcccaaactgctgagatcacaagcgtgaggcaccacgctaagcctaatttagtgactaagagatatcttaaatatatataaaccttgtgtggataaacagaaaaaaggaaaacattcggtgatatttgaatactgattgtatactggatattgaattactggtagtattttgagatataacaatggaaatgtggttatattaaaagacttattactagctccatattgcttttgatttgggattttcgtctctatgtttacaagtgatttaggcctataattttcctctttggtactgttaatgtctggttttggtatcaaaataaataagcctcataaaatgagttatggagcactacatttttctttttttttttcccacgcttaattcactttatttttcttgtataaaaaccctatgttgtagccacagctggagcctgggtctgctgcacagagactctggtgtgggtcttgacgaggtggtcagtgaattcctgatagggagacttggtaaatacagtctccttccagaggtcgggggtcaggtagctgtaggtcttagaaatggcatcaaaggtggccttggcgaagttgcccagggtggcagtgcagccctgggctgaggtgtagcagtcatcgataccagccatcatgagcagcttcttgggcacaggtgcggagacaatgccagtgcccctgggtgcagggatgaggcgcaccagcacagagccacggcggcctgtcaccttgcaggggacggtgtggggcttgccgatcttgttcccctagtagcctctgtgcacggggacaatggagagcttggccaggatgatggccccacgggtggcggtggccacctccttggagcacttaacacccagaccgacgtggccactgtagtccccgatagcaacaaacgccttgaacctggtgcgctggccagcacgggtctgcttctgcactggcataatcttcaaaacctcatccttgagagaggcccccaggaaaaagtcaatgatctctgattccttaatgggcagggagaagagatagatctcctccagggacttgatcttcatgtccttgaccaagcggcccagcttggtgacgggcatccactccttatctttggccttgcctccgcgagctccgcggcctcagccccggcccggtccacggctgcgaccccggccccggatgccactggcgaaacctctgcggaagccaccgcggttccccatcccagggccaccagggcctccaggcccccccactgcaccggcgtcatccgccatttggtgttttctcggagaagaagctacatttttctattcttgggaatagtttgtctaagagataaattatctgttccttgaaggtctgggagaactcccatgtaaaatcatttaggcctggagttttttggtctaatttaactactaccaatataattaatatgaagttatat

SEQ ID NO: 120970 - DNA, 1156 bp, Homo sapiens
cggggctgaggccgcggagctcgcggaggcaaggccaaagataaggagtggatgcccgtcaccaagctgggccgcttggtcaaggacatgaagatcaagtccctggaggagatctatctcttctccctgcccattaaggaatcagagatcattgactttttcctgggggcctctctcaaggatgaggttttgaagattatgccagtgcagaagcagacccgtgctggccagcgcaccaggttcaaggcgtttgttgctatcggggactacagtggccacgtcggtctgggtgttaagtgctccaaggaggtggccaccgccacccgtggggccatcatcctggccaagctctccattgtccccgtgcacagaggctactaggggaacaagatcggcaagccccacaccgtcccctgcaaggtgacaggccgccgtggctctgtgctggtgcgcctcatccctgcacccaggggcactggcattgtctccgcacctgtgcccaagaagctgctcatgatggctggtatcgatgactgctacacctcagcccagggctgcactgccaccctgggcaacttcgccaaggccacctttgatgccatttctaagacctacagctacctgacccccgacctctggaaggagactgtatttaccaagtctccctatcaggaattcactgaccacctcgtcaagacccacaccagagtctctgtgcagcagacccaggctccagctgtggctacaacatagggtttttatacaagaaaaataaagtgaattaagcgtgggaaaaaaaaaaagaaaaatgtagtgctccataactcattttatgaggcttatttattttgataccaaaaccagacattaacagtaccaaagaggaaaattataggcctaaatcacttgtaaacatagagacgaaaatcccaaatcaaaagcaatatggagctagtaataagtcttttaatataaccacatttccattgttatatctcaaaatactaccagtaattcaatatccagtatacaatcagtattcaaatatcaccgaatgttttccttttttctgtttatccacacaaggtttatatatatttaagatatctcttagtcactaaattaggcttagcgtggtgcctcacgcttgtgatct

SEQ ID NO: 120971 - DNA, 1032 bp, Homo sapiens
gatatctgaagttctctaaaagcagtcttttgtaatttaatctctggttcaattagattgtgggtggggagggcacagagtgagactcctgtggtgtctgcattgcagcaccagcacatttagaaaaatgagaacagctaggaagggccatacaaccacacagacacttatctgtgctcacacagtagagaaattattttctttatattttgaagattatattcttgtttaattcttaaattgttactaataatatttgggagtgggaagggaaatttaaaccttcaaatgacaactgacaattagtatgattatactcctctcactataaaaactgctcttaagggccaaataatgatagcctgttaactcctgtggaagaaactgtccttgtttaaagtcatgatgtaacttgtttttccccctccaaccttcagagtgctgtcagatgttgatgctttcattgcgtatgtgggtacagatcagaagagctgtgacccaggcctggaggatccgtgtggcttaaaccgtgcacgagtaagactttcctgggaatgggaagtggcattggccatgggtaggagtagggtgttgtcttttgtcaagtttctcatagatttgttttttctatactggtgagaaacgtgggagtctccacttccctaagcttctcctttcttttcttctttagtcttgaattcttgagttagttcccacagcagagcagatggtcttttctatgaagtcattattttggctttaaggatctctaaatagctctgaagactgaaggtgtaatgaggaagtaggtcagaacttggtcagcagggtgagtcctccctgccattgctctctggcatgtaaagtcttaagtgatggcttaacttgcaaacctgagatttttcagtgctttgctatttaaataagcattgttcctggctccattatggcacaagtcccattaattaacctggcaagtagtaggttgattcagagtaccgtgaggggggattaggacactagctgtcaagg

SEQ ID NO: 120972 - DNA, 1115 bp, Homo sapiens
aagggcacgcacagctgagtacggtggttcacacttgtaatcccaacactttgggaggccaagatgggaggaatgcttgaacccaggagtttgagaccagcctggacaatatagtgagacctcatctctactaaaaatttaaaaaattagccaggcatggtggtgcgtgccagtagtcccacctacttgggaggctgaggccgtaggatcacttgaaaccaggagtttgagaccagcctggtcgacataacaacacttctacaacatctctacaaaaattttagaaagtatccaggcatggtggtgcccgcctgtagtcctagctactcaggaggctaaggcaggaggatcccttgagctcaagagtttgaggttacagtgagtgatgattgtgccactgtgcactccagcctaggtgacagaatgagaccctgtctctttaaaagatgaaaataaaatgtagccaaaatggttatttctaagtggaggcagccattgtcaacctgttttatgtctttgttacaggaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaaggtataaagcccatctcctttgtaaattttattttgacatttctaagttaatttttatttattttatttttttggagacaggatcttgctacattgcccaggctggactcaaattactagtctcaagggatcctcacacctcacccttctgagtagctgagactacaagcatgcacaaccatgcctggcctaggctaattatttttgtaactatttttaaaattatgtgaggcaaactaataaacacagctatttattcatttattaaatatctactcagtacttactgtggatcaggtaccatgctagtgcctcactctttaggaacactctgggaagaaaggcacaaaaacagttaatgttacctatatggcattgcaatgaagacttgtataaaggagagtattagagtgtgctgtcgggcagggaggggat

SEQ ID NO: 120973 - DNA, 1018 bp, Homo sapiens
gatgaggttggcatgtcgtttggatcccaaaactagcttccagatggctggggagtggctaaagtatcaactatcaacttttcttgatgctggttctgtgaattgtaagtttttttcattactgaatgttagtgaaatgttaggacagtatcaaaactatatataggaaatgagcctgagctatacacacatcagaacgatatacttatactattcaaaaatagctttgctcatcctggagagggagcgttttcattggctgacacaaagaaagcagatgacacattttaaatttgttttaaattagggtaaaaccatgtccttatcagttttgccatcattttccatttctaacagaatcaaccaattatttattgttgattttatttgcttcacttcaggcaccagcttaacaaatttcatgcgtagacctaactttaaaacttttcagccaaagtcttgcatagcactattcctgaaatcagaaaggatctcctgttagacataacaggaataatacagggacttctcatatcactcagccactccaaagcttttgtgaaattatactttacataaattcagaataatccccctctaccgaatgcctcagccagttaacttctctgtactccaaatgttttgtctctcatcttaatgcatgctatatgtgtgtgacagtattaataaagcaaaaaggctggatgcagtgactcacgcttgtaatcccagcactttgggagcccaaggcgggcagatcacctgaggtcgagagtttgacaccagcctgaccaccttggagaaaccctgtctctactaaaaacacaaaaaattagctgccgtggtggcgcatgcctgtgatcccagctacttgggaggctgaggtaggagaatcgcttgaacccaggaggtgtaggttgcggttagccgagatggcgccattgtactccagcctgggcaacgagagcaaaactccatctcaaaaaaaaaaaaaaaaaaaagtgaattaactagtgca

SEQ ID NO: 120974 - DNA, 1062 bp, Homo sapiens
gagaattattggctcttcttcctgagccaaacagtgcacttgtctaggtcagcagcttttccctttaggtaatattctgattgtactcagtcacatgtgaggtgtgtcccaggtggtttagtactaaagttataaagatttttgaaacaaaagtctgattaattgtattataaaattaatttcactctgttcaaaattgtccttctaatatcactctgagattccagtatccttttttgcaaagaagagaaagtagtaaaattcagctcacattccaggtaatttccttgatccacagcctgtcttactaacatgtggtccatagtgggtggtcattactgataaattgcagtagagacagcttcaaagtattgtacagatttatttctatgaaaaaatgtagttgataactgctaagtaataatctgggttatatagaatccaaatcctttgacgttttcttttttttttctctttagtttctacgctcttcaactcagatgacttggggagccctcttcaggcatgaaatcctgtcccgtgatcctttgctattagcaataataccaaaatatcttcgtgcttccatgactaacttggtcaaggtatataatgggaatctaaacatgtggaatgtaggtgaatacacataataagactttgaggctgggtgcggtggctcacgcctataatcccagctctatggaaggctgaggcgggaggatcgcttgagcccaggagttggagaccagcctgtgcgacatggcaaaacctcgtctctactaaaaatacaaaaaaattagcagggcatgttggtatgcacctgtagacccagctactggggaggcttaaggtgggaggatcacctgagcttgggaagttgaagctgcattgagctgagatcgcagcactgcactccagcctaggcaatgagagtgagaccctgtctcgggggaaacataaaaaagactgattggcattattaacagcccttcttcatcactaagattcctttactggacatattttcttattccttaggaagaaatcagtccttactgg

SEQ ID NO: 120975 - DNA, 1139 bp, Homo sapiens
ggcttcaagtgagccttacctcaacctcatgagtagctgggactatagatgcacaccatcatgcctggctaatttttgtatttttttggttagggtattttttttattttattttattttttgtttttttggtagacactagttttgccatgttgcccaggctgttgttttaactcctgggctcagttgattcacccaccttggcctcccaaagtgctggtattgcaggtgtgtgccactgcacccagccttgggaagtaaaatgataagatttggggttttgtgaaaaagataaaatggccacacatgccagtatggtcttgttgttggatgttgagaatgtcattgtttgagaagtgattgtgttccctacctgtgactgttacatgagtatattcttaaaaaataattttcttagaattagaaaatgggagttcagttataaccactgattccttacctgttaccgaggacttcatggtccaaagttacttcttttctggtaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaagtaagttaccacttcaaactgacttatcctcagtctctgaagtaggctgtgtatgtgtttaattgcatgttgtggcagaaagtcatttaaaggtttgggtttttttccttggggccaacttactgcctgcttccaacccccttggacaggagtttgccaatattcaagggatcctttggcagaatgtggagatttatcaggctgcatggttcttgaaatagccatgatacttggcaatttacagttaacagataaaagtaaatgtttaagtttaaagctcacttaatgaatgtcaaggaatcttggatggtggctacagtaggtttatatctgtcttttttttttttttttttttttaattgaaacagtcttgctctgtcacccaggctggagtgcagtggcgtgatgttggctcactgcaacgtccgccttccgggttcaagcgat

SEQ ID NO: 120976 - DNA, 1149 bp, Homo sapiens
ttttttttgagacggagtttcacttttgttgcccaggctggagtgcagtagtgcaatcttggttcactgcaacctctgcctcccgggttcgagtgattcttctgcctcagcttcccaagtagctgggattacaggcatgcgccagcacaccggctaatttttgtaattttagtagagatggggtttcaccatgttggccagactggtctcaaactcctgacctcaggtgatccacctgccttggcctcccagactgctgggattacaggcgtgagccaccacgcctggccaacatccagtatttttgagtacatggttttcatatacttaggctatacatacatgttcatgaattgtattcatttaattatgcttctgactttacttgttctccctaggggaatatcagttatgcgtgcttagtaaagttgtgttattttccaagatgaaaaattgcatatatttaagaatcattattcaagggcattgatttgtggggggtagaaagttattatgtggccttttgctcattaaaaacactggatctttatacttcctttcagaagacagatacttctcaggagtcaaaggtaagagctctttataaagtttgaaggagacctttgaacctttcaggtgaggggatacgtgcccctagtggatggtgacctcagccttgcttgtgttgtattgttttggagacaggtcttactgttgcccaggctggagtgcagttgtgtggtctcagctcactgcagccatgacctccccagctcaagtgatcctctcacctcaacttcatgagtagctgggaatataggtgcgcaccaccatgcccagctaatactttctatagaaacagggtctcagtgtgttgcctaggccggtgtcaaacccctggcttcaagtgatcctccagcctcgacctcctgaagtgactgtgggccactgcatctgtcgtttgttttttttgtttgtttttgtttttgtttttgagacggagtctcgctcacttgcccaggctggagtgcagtggcgcgatctcggctcactgcaagctctgcctcctgggttcacgccattctcctgcctggcctcccgagtagctgggactacaggtgcccgccaccacacccagctaattttttg

SEQ ID NO: 120977 - DNA, 1445 bp, Homo sapiens
gactttaaacatgttcaaaattgtagccttttttctttcttggttttttttaaataacagacatgagagatgggatcttctaatacttctgcgtcttctagtgttagaactattggtaaaatattcatttgccccttcatacccttccattttaccagctactcactatactccttatttctatactcttcctccctggccttctgcaaactgaaacaatcaatatgagaatcttttcattttgtaaagaataatgatgtcatcctagctctcgatatgacagccttttaggtgatgcaaccctcacttaagctttaagcggaagagtgattagcaagaatgcaggacaagtgactcaggctgaagaacaggttcatttgttctgtttggtttaaaagtaggcctgctgataaattttttacaactctacagcccagcttttttctggaagtctggaatccagtcttgcatatctcttaatatctcttgttctttttcagggaacattgaacattttggaagaggagaaccatattaaagatgctctgtctcgaattgtagtggaaatgatcaagcgagagtggccacagcattggcctgacatgctaatagaattggacactctttccaaacaaggggtatgaaacacagctatatcagtttggtatacttttccttggaacaaacttcagggtttgttgtttgattttgtttgtgggtttttttttttggcaacagaaaatagcctttggatatacataaaatgaaaagatattttagtttttaactagcttatttctattggtgtaggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtggtaagggatacccctacctataacatttctattttccaatatgagtgtttttgattaatcttacagtaaggaactagggtgtctaggtcagcaaaatgaaatcctattttataagcaaaaaaataaaaaactaggaaatgacagaaaaactggagctcattttctttcttttttttttttttttttttttgagacggaggctcgctctgtcacctaggctggagtgcagtggtgtgatcccggctcactgcaacctctgcctcccaggttcaagcgattctcctgcctcaacctcccaagtagctgggactacaggcgcccgccaccaggcccggctgattttttgtatttctagtagagacggggtttcactatgttagccaggaaggtcttgatctcctgacctcatgatccgcccgcctcccaaagtgctgggattataggtgtgagcc

SEQ ID NO: 120978 - DNA, 1068 bp, Homo sapiens
caaagcaggattgtatgagaataactgaaaacccatcctaacttgattgtcctaccctcaacacctatcagaagaggtagcctttaagacttagccatagtttttccagaattgttttgtaagccagcacagaaaatgactgatgtcaaaactgcattttctgaaaagcaagtacattgttgcagttgacctagatgtatattcacttttggcccatcaataaaatcatgaggcaaagctgacgtgtggtacaaatcttgtgcggattccagttaatggaccactgcatatataaaaccttttcccaagaatttttgtgttagtattttggttaaatgtagatcatttttgcccattcattgacaggtacaaaatcaaaagtataatttcttaatgaaatctccagtgtaatcaaatgtagaaatccatgctattctcttgtaaagacaagacttctaaagtggttctattgactttatgcattttggtggtcaggtttcggtggaacggcatgtctcgattggagaaggtgtatctgaagaacagtgtcatggagctgattgcaaatgtaaggaatgggtggttgggagacatgtttccaaggtagtttaggcaaagcgtgacttcttcaatagggagtttgtgtaaaaattcactgcttctaaataggtcagacagcacaagaaatcataatttaggccaggcacagtgactcacacctgtaattctagcgctttgggaagccaaggtaagaggatcacctgcatctaagaattcgagagcagcttgggcaatgcagtgagaccccatctctaccaaaaatgcaaaaattagctgagcgtggtggcgcatgcctgtggcccagctactcaggaggctgaggtgggaggattttctgagcccaggaggtccaggctgcagtgagctgtgatggtgccatggcactccagcctgtgcaacagagcaagaccctatctcaaaaacaaaacaaaacaaaagcagaaagcataattcagcatatgtctcttactaggtttaattaatcatgcttatgtattgacttctatt

SEQ ID NO: 120979 - DNA, 1046 bp, Homo sapiens
aggcacctgccaccatgcccggctaatttaaaaaaatatttttagtgggccgggcacagtggctcacgcctgtaatcccagcactttgggaggccaaggcaggtgggtcacctgaggtcaggagttcaagaccagcctggtcaacatgatgaaaccttgtttctactaaaaatacaaaaattagctgggtgtggtggcgtgcacttgtagtcccagctacatgggctcaggaggctgaggcaggagaactgcttgaacctgggaagcagaggttgcagtgagccgagatcatgccattgcattccagcctgggcgacagagtgagactccgtctcaaaaaaaaaaaaaaaaaatatatatatatatatatatttaatagagatggggtttcgccatgttgcctaggctagtctcagactcctagactcaagtagtccacccatctcagcctcccagagtgctgggacaggtgtgagccaccgcacccggccctggttggagtttcttaagatgaaattcttttagtccctattctctcagccctcgaaaggaaacactaacttttcttctttcagttttgtgaggagtttaaagaaaagtgtcctatctgtgtcccctgtggcttgaggttggctgagaaaacacaagttgccatcgtcagacattttggccttcagatcctggaacacgttgtcaagtaaggagctcttggacattaccactgaagtctgagagaacagatctttatatcttatataacctatagagatgctgtttaggtgagtagagaagagcaatctccaagaagagaggaatgatcccctagatgttatcagaacctcacaggagctctcattcaagatttaacctttcttttcttcagtttcttcatccatgtaaagtgtgtggtacatattacccattcaacaaatattacctgccatttagccaatacttactgagctctgactatatgtcattagccctcgaagcctttttagagtaatgcaatgtataggtcaatgaatctctgattaggcactgtg

SEQ ID NO: 120980 - DNA, 1128 bp, Homo sapiens
agagccagaagagctgcttattaaagtttgaatagaagacatacgatgagattggtatgtataccctgaggaaggttgtctgcctgcccagacacatcaccacattctaggtgcttatcttcaacttgatcatttgaatattagtatatccgtaaatggttggttaaggcatgtgtgtgtatgtggtgatgaccagttcacatgttaaccaaactcaccgttgactgaagtataaaatccatatgccagtttgttaatttatggtgagaaatactatcctggggaagaccatatactctggttcactgatcagtgcagtgttgcatgtaaattaccctttttttgaagacaaaattagaagcagaagatttcttggtggatatatgaaaataaaaggaataggtgatcatagtaatacacaaatttgaggcatttctttattttttagagagttccttgtcatatagacgtgttcatagtctgaatgctttctgccttggtagttctggcattgtgctaaaaatgtttgcctccgtgattcttccttttccatgcttctattattgaccatctgcctgccgattgaccctttcagttactattgtctagtctctgttaagccacatgtctcttgattacgtgtattattgttcattatggcagggtgggagtggagcagacaatctcaaggttgcctctgtttattgcctgcatgaatgatccttatacttcttaggtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaaggtacttccatagcatcatactgcttctgcttcctgcctttggaacctgctttgcttggtcatgctgattctccttggaataattgaaaggaaacttaaactacagcctgaatgaatcacaaggactcacatggaaggatatacaaattttcttatctttccaggtatatggctg

SEQ ID NO: 120981 - DNA, 1018 bp, Homo sapiens
ctaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtg

SEQ ID NO: 120982 - DNA, 1026 bp, Homo sapiens
ggcctcgaggctctaaattccccccaagtcctagaaaaagaacatagcgcgaggactggaagtcagactacagctcccttaagcctttgcgcgccaaggcgcgctccttccccacgcctccgacgactcccgcggccacttgcgccgcgatgcctcctgggagttgtagggcggcgacgtgtcatttaagtgaattcccaggcctggggactctatatcccgtggtgccccgcggctgtttctgacgcgacccggaggccagggaggtggggggcgtagcttgtgcagagccccaccccactctgctcaggccggccggacacggcagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggtgagcacctgagaagtggtagggcgggaagaagccactctttccggcccaggactctagggaggcgggacccagataattaatctccccttccggtgtcgagaccccagggaggaggggcacgggaggagaacacctctttcaggtcccgggaccccagggaggaagggcagagactggactctcaggtgacaggacctcagggaggaagagtggagagggaggactcccccttctgatctagattaccccaggagagaagtagagaaaggggatcccaggaagagcaccccgaccaactgcgtgtgccgccatagggcaagagagactgcatcctgggacgagaggcagacagtaaccaccacttcttctaaacttgttccacagggagaaggggagtacccgggaaaagagcaatatgttccacacggacacacac

SEQ ID NO: 120983 - DNA, 1044 bp, Homo sapiens
ctcattcactggggtgccactggaatagtgttagttcagtgctatatcttacattgtaaactcttcagagcagaaaccattcttatctgattctctttgtgcaggaacacacaccgcctgcgtacttttgaaggtcttttagataccactaccccaccctcttttattgctagccaccgtaggacaggatctgaccaattcctttggatagaaccaagataaatctttgcatagaaaggcaaaaacagtgcggaactccttaatcccataccagagaggtgatgctacctgggtatcctgggcttgcccccaccccgcctcaagggcatagagccttggcactagtggggtgaaccctgcatgctttctgttctaggtggagaccatgagagagtacagatggaaggctgcttttttccagatgtgtagaatttgagctgttatttgaaactctctgttccttattaaatggctgacctaatgtttccccctttatctccgtagtggtggagacccaagaagggaagacaactatagtaagtatcgttgagttggccatgtataacctctttaacgcttggagctgcctggccgctcctctgagggagggaggggcccaaactggacgcccagctccaggatcagctccctcaatgaccataaatcccacagcctactatttttcaagctgtgtgctatagtgtggttaatcaggaacagttgctgtgcctgggctgaggtatctgctatttgatgaaagtggccttttgtgtagcaaggtctcagaggcctttgctgataagctctttggcgggtgttgaatcattttcccaaaggggaaactaaggcattgttgcacgcctagagagccagagtaagttgacccagagccaagagcctggacctcagttcctttcttttctgcctagaatggctaaactgctccttaaatgatgcatttaaaaagtgacattctcccggccctggcctcactagctggcgccctggtttgtctgttggtaagaaagttggaacaatacttca

SEQ ID NO: 120984 - DNA, 1178 bp, Homo sapiens
agggaacggctctcaggccctgtccgcacgtaacctcactttcctgctccctcctcgccaatgccccgcgggcgcgtgtctctggacagagtttccgggggcggatgggtaattttcaggctgtgaaccttggtgggggtcgagcttccccttcattgcggcgggctgcgggccaggcttcactgagcgtccgcagagcccgggcccgagccgcgtgtggaagggctgaggctcgcctgtccccgccccccggggcgggccgggggcggggtcccggcggggcggagccatgcgccccccccttttttttttaaaagtcggctggtagcggggaggatcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcgga

SEQ ID NO: 120985 - DNA, 1048 bp, Homo sapiens
gagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgcttattttcatttctctctgcggagaagatccatctaacccctttctggccccagagtccagggaaaggatgatcactgtcagaagtcgtggcgcgggagcccactgggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgacgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgctccctggccttggaaggggtatgaaatttccgtcccctttcctccttggggcccaggaggagtggagggtcccgggagaatattgtcagggggaaggcagggggtgtcatgggaatgggtga

SEQ ID NO: 120986 - DNA, 1021 bp, Homo sapiens
ccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacttggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactct

SEQ ID NO: 120987 - DNA, 3209 bp, Homo sapiens
ggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctg

SEQ ID NO: 120988 - DNA, 1789 bp, Homo sapiens
aaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccttccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaag

SEQ ID NO: 120989 - DNA, 1086 bp, Homo sapiens
ccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagccta

SEQ ID NO: 120990 - DNA, 1043 bp, Homo sapiens
atccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctcttggtttctccttctccattgaatccttgctctagacttcctcccgccccctttccctcttcctctggggaacatggcatttgtcttgggtctgggaaaggtacgtctaatgtgtaggatatggggtgacccaccttgttgtgctgggggcaaagtccttccattttggctgagctggtcctgggggaacccatccatcctgtcttgatatagaaggtgggaagctctgggaatgggtggagggggagaaacagcttaggagccaagggcccttgcaattggtagtgctgccttcaggaattagatgatccaggcccctgtcccttagccagggaaagaactggccatgt

SEQ ID NO: 120991 - DNA, 1861 bp, Homo sapiens
aagaacccccttggacatcattcaagttctctccaagtatagcagagtcttagagacctgcgttcaaattctagctctactattcttcagctgtgtgaccttgacaagttacttaacctgtctgaacctcagttttcattaaaaagtgtttatgcctataattccagcactttgggagactgaggcggacagatcacttgaggtcaggagttcgagaccagcctggccaacatggtgaaaccccatcgctactaaaaatacaaaaattagccgggcatggtggcacacacctgtaatcccagctactcaggaggctgaggcaggagaatggcttaaacctgggaggcggaggttgcagtgagccgagattgtggcacttcactccagcctgggtgacagagcaagactgtctcaaaaaaaaaaaaaaaaagaaagaaaagaaaaagaaaaaaagtgtggttactaccacctccttacaagttttatcatgggaatcaaacaaggtaacagaagtaaagagcttggcatccttcctggtaattgatcaataatgggttatcatctctgaacttctgacccataactctcccatgcctccacctcccaggctaccacagatggatggggtatgttcaaagagtgagaatattccctgtcactcagtggcagagtccctaacacagtgtaaacccttaggtctaaataagaagcccaacctgactgaggggctctgttatatttctatcatgttacattctgtgtttttatcttatttttgtttttaccaattttctttctctaaaccaaccccttttattccataccttattaataacaataactaattcctagagcccattatatgccttgaactatattaagagctttacataagtcatcttgtttaatccccagaacaacaacacaactggattattgtcccattttacaaatgaagaaactgaggcccagggtgactaagtaattttcccaggttagaagcctggtctgtcacatcctagagtctgtgcttttaaccaccagactatggtgcctgtcccctatgcctgcctcagaacctgaaatcacaaacccaaggcctgagtggagggaagctacaagcaagaggaaaggcaagcaggtagaaatagggtatggcatttctccagtgtggtaactgactgcctccggctccctggtggaagtggctcttgtttgcagataactctgcaaagtgcagtggttaagagcatacactcgagccaggcagcctgggtccttatctgggtctaccacagactggctgtgtgaccttgagcagctcatatactctctctgtatctcagtgtcctcctggggttgtgatggggagcaaatgagttacatttgtaaagtgcttagaacagtgcttggcacaaaagaagagttaaataaacatttaatactattattttactacttttttttctttttctgtttttcttttttctttcctttttttttttagacacggtctctgtctgtcgcccaggatggagtgcagtggcatgatcttggttcactgcagcctggaactccctgggctcaggtgatcttcgcacctcagcttccggagtagctgggactacagacatgcaccagcatgcccagctaaattttggtggtggggggtatcttttgtagagacggggttttgctatgttgcccaagctggtctcgaactcctgggctgacgtgattctcccaccacagcctcccaaagtgctgggattacaggtgtgagccaccatgcctggcttttttttttttttcccctcgagacaaggttttgctctcttgcccaggctggagtgcagtggca

SEQ ID NO: 120992 - DNA, 1153 bp, Homo sapiens
ccaaaacctcaatatcagactagagaaactgggatatagctggtgcaggcacctcgtggagtggaagaactgccacctcccatccccaaggtattctgcctcaatgtcttccctcttctcagttgctcagcccagtgctggctttgagagcagctgcccttgatgaaactcaacccagcaaccccacccccacaattaaaagcttggagcagccctgtcaactggcagagctgccagcccaggctccaccccttacctgtcctgtcactgtgcaagttgcttcccctactgggttcctgcttcctccctgtaaaatggggatagtgatctgagtgtgccctgccttcctcccatgcaggtgggaagattaatgctgttgtggaggggagagtactttgtgaccccaaggaggcggacagcagaggagcatggtgatttcagttactaaccatctagctagatcctgtccaccctgctggggccacttcatgtagaagcttccaaaatgctctacctttctttggtgtggagaagacaggagttgataggaatggtactctggggcttgttctcatttcattctgatctgatggagccttggaattcagagagagaaacaggcaaggggtgggaatagagtgttgagattgctggagtacattggagttgagaattgagaaagggggactagttagagtccccccaacccaagatacctatacctacctttaacctcccatagtgccccagggttctgtgcatcttatgtttacatacccgggctcccagacacacccatgttcacacccccacttcgaagccaacaactcccttcatttccgtggactgccatgcagtcacctagctcctcctggacacaggtccacacatcaacacacatttacatacctggacacacacatttccacagcacccacaggttctctggcctgagaacatttaatgagcatttataaagcttccatggtctgccgagtcctgttctaggaacatcagaaaagcaccgtggtgccctgaaaatcattctagctttagaaagaaggtgagctaggtttgagtcctaggtccctcattttattagcagtgtgaccttgggaaagttacttaacctctgaggccctgtgcccccacc

SEQ ID NO: 120993 - DNA, 1061 bp, Homo sapiens
tgtcttcccaggctcagctccgccccctgccctaagacagagagaatgagagtgtgggggtggcggcggcaggggggatttagatagatgttagaaaatcacagataccttccagcttaatgaaaccagcctccccagtccaggcctggcatctagactgagttccccagacccagggtggggtcatagccagagagccagtgaaggtaaatccatgtgactcaactctcccctccctaggcccttatctccagaggccagagcttccatccacccaggcagcctggtgatctgtcctcactgccccctccccacgcccaccctactgggccatgaaggggatgggggcaagcccagctgactgctccaccctctgcccaggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgtaagtgcctgctgccaccccttaccttggcatccatgccctgtacacacctggcaaacacttccagctctaaccactctcccacctgccccggtttcccaggcttaagcaggaggagtccccatcatccagcccaagcctcgcctttgaccattcacccaagccagggtcatccccttctaagacaagattttggaccctctgcttctgccccctagtccagcaggtggacagacagcctctgcacttgccaactgccccctcttccctcaggcactgctgttcttattctctatcctccggaaggtggcctgggactatgggcggctggccttggtgacagatgcagacaggtaagggtctgggaccctccctctagctctccacacacacatcttgttccacactcctcaggaataggaaggagccagccctctctcattcccctttgctggggggatgagaagggactagccccaatgtgggcatgggggcat

SEQ ID NO: 120994 - DNA, 1053 bp, Homo sapiens
gttgtggggaatacacagaaacagccgtgctgtgcccagcacttgggaaaatagcagtggctgatcctaggatagtaatattccttccccttctacatgcactcaccaagccagaaccggacacctactccatgccagccactgtgctgggttctcagggtctaaggagctgaaagtagtacccccttctgcctctataacccctcaagagcatgggacggcgtggctcttttgttaggctcactgcctgatttctgttggaaacactcccctgctttccctgggacctggcttatccataactaaggcctcctcccaccccatctgttcccctctgctcacctacttctctacccactcaaaacaaagcctctttctctagtgccccccacccctcacatcccctggctccactggggtcaagcctcagaaggcaaacccactcccctgtcacccaggtgaagcggaccctcttcatcaatggaatctccaaatatgcagagtcagaaaagatcaagaagcattttgagtgagtaagccacgcttccccctaccctcaagccctgctgcagagccttctctgcctttgaactctaagaacatccttataccctagcctggagctctgccgtgggtgggatagagattagatccaggaagaaatgtccgattccagggtggtttagcacttgggtcgggtgataggcccctttaagaacaggaaaaataagacaaaaacctgaagagtgagtcattcaaaccccctaacccccaaacctcctcctggctcagactgggtcataggttgttgacccaggtccattggagtacatatcttcttcaaaattaaaagcagcattctggagtttgtgtgcagccatgacagggagaagctccttggtttccagtggattccaaggagtccaggagaacttgaactgtgtattctctgaggctttttcagctctagaattatgttttggggtgggtagagcagacctatggccagaaactagagaaaagggaggtggtataatgaggcaaagagggaac

SEQ ID NO: 120995 - DNA, 1009 bp, Homo sapiens
cttggggaactctcagttttgtagactaagaaaaaggcagcttgaattggagatgtgggtttttttgtctttttttttgagatggagtctcgctctgtcgcccagtctggagtgcagtggcgcgatcttggctcactgcaacctccacctcccgggttcgagcaattcttctgcctcagcctcctgagtagctgggactacaggcacgtgccaccatgcccagctaatttttgtatttttagtagagacagggtttcaccatgttggccaggctggtttcgaactcctgacctcaggtgatcctcccgcttcggccccccaaagtgctgggattacagatgtgagccaccacgtccagccagagatgtgtttcttgaaggtgatggggtcatggatgaaagtcaggggcaggtgggtggggtccctgcacaagatgatacatgaactgtgtttcagggaagcctaccccaactgcacagttctcgaagcccgcccgtgttacaacgtggctcgcctaatgttcctcgatgcagagaggtaagggactgggggcagaggagggtgacaccaagggccccctgccattgtggaggacatcttggctaccacacaggctccccttctagattttttcctagggcatttgattttaattcaactcgttggtgtgcctgttaattcagctctggaaagagcaaggcctggaggttagagtttgttgtgaggggaaggggggcccatggtccccactgcatctgaggacatgcccttctttggctacagtatgagaaatttaggtcagcctgcaggaagaacttctggccctctagggatgggtggggagaccttgggatgtggccacatctgaaacatgtatcctaaacaagaacaagacagctcctgtccttggggagtgagctagatgacccccaagctgagccagccccagccccagatgtaggtgaccaggcatctgggtcccacaggaagaaggccgagcggggaaagc

SEQ ID NO: 120996 - DNA, 1086 bp, Homo sapiens
ttgggaggctgaggtgggagggtcactttagcctgggagcttgaggctccagtgagctgagattccaccactacactccagcctgggcatcagagcgagacgctgtttccaaaaaaaaaaaaatgcttagaggagcagtgcctggcttgtaggaagccccaagtcagcgtgggctggatgctgcaggccccagcctggctttccaactagaggccctgtccctaaccctcccacaaaggtggaggccattgagtactacacaaagctggagcagaagctgaaggaagactacaagcgggagaaggagaaggtgaatgagaagcctcttggcatggcctttgtcaccttccacaatgagactatcaccgccatgtgagtccccaactcggccctcggccctgagcagccctccagggctccctgacccctgtgctcatggccttctgccagcagtgtggcctccaggtgggcctgtggtaaccagtgcccatctttctagcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactggtgagcaaacaggtgtcagggcaggctttccagggcctgggatgggctcagtaggtaggcggaggagagggagtgtcttggtgtcactgggggccaatcctgcccttggttcctggactgaccggttccccaccttgccagggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacgtgaggcctcatgcccctgtcactttccacgctgggtcacaacacacagataccaggccctgatccctcttccacttgcccagcccagcccgttctgcttgttccaaccccgtgccaccaaccagctcccaaaaacccctgtgtgcacttccct

SEQ ID NO: 120997 - DNA, 4957 bp, Homo sapiens
ggatgttctgggcttccaacatgggagccctgagagttgtgaggccaagggcccagctggggaggaggcacataagcaaagccacctgggccccctagactgccctgcctgacgcccccctgtgccctgctgcagaaccccatcatcacccagttcttccccaccctgctgctgtggtgcttctcggccctccttcccaccatcgtctactactcagccttctttgaagcccactggacacggtaaggtgcctccactcacaccacacctcgctgtggcctgccctcaatgacccatcctctctgggcagcactttgcccttcaggctcctggccctgggcagtcccacagctggtagggaaggggtagtgcccagcaccctcaccttgggaggcccacccttcccaggggacactccttggacattgtccttgttgggggagcaagtctggggcctgggctcacttgacctgtaccgttccctgctcccctccctccagctctggggagaacaggacaaccatgcacaagtgctacactttcctcatcttcatggtgctgctcctaccctcgctgggactgagcaggtgagttgagaaggatggggcaggagccagggtagggggacagcaggatagggagaggagagcagttcagcctccctacctcccctacaaagcaaggggcccaagatgggaagcctggccacccccaggcctcctgagctacccaccccatgtctgggagtctccccagtggctcacagaggagggacttcccctcccctggtgttctgtaccactccagctcccaccccatctctcctctgcttccctccagcctggacctcttcttccgctggctctttgataagaaattcttggctgaggcagctattcggtttgagtgagtgactggggcccctagggaaagagaccagacagcaggggtgggtatgcttgagagacattgccagccccatgggagggtgcaacaaagcttccaactcctggagggggcagaagagagaggatctggcggggttaccccaaaggcacccacaaggtgtcttgggtgtgtatacatggtagaagtccctggggtctgtgttggtgttcactctctggtaacctgtttggatgctaagatcatcctcaaggtatatttggggcttggggctccacattctggtagtttctatgggggtgtcttgtgcccatattctgggactaactgtgggcgtctctggagttccacttgggaggtttggggaaccatctctagggaggtcttggtgatacttagggagtgtcttggaggctactaggggtatccctgaaggtctctagagcccatatttttgggtatgtgtaggaggctcttgaccttataactctgggggtgtctgtgggcggggaggctaaaggactcacactttgggatgtttagcagtacaagttctgggaacatctctaaaatttcaggcttttattcagagatgtaactgtggagttctgtatgggcatcttctctgggaatcatgtgaggatatattgaaggtcatgcaccatggctgtgggcacaaactctaggggttttgctgtaggccatctgtggtgatctttgagtcacacttggggcatctcaggcactgataaaggttcctgggctcccccagagatgttgcgggaagggtctcaaagcttgtttgtggaggtatctgaggctcatgtcacactctgggggtaactcgagttatggtctaagtgggggaatcttctgggtgttcctggggctgtcagcctttgggttctttgagggtctcattgggttgtctttgggggtcctggacagttctcccctgaacattctagcagccttaggtggtcttgagcactctctccatgggtctttatggggcacaagttcttggagctgtctgttgccactctgtatgtctctggggggaacagggcacaggtgcttggggcgctaagctgggggtgtccacatggaagaagcatgttggtggtggaggtgttgggtgctgtagttctggcagtgggcgggcggccaccgggtcaccccaagggtgcagtgctggagcacctggtgcccgcaggtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcgggtacggccgcctggggcagcagcggcccgcacagcgccccctggtggcccaacaagaaacagcagccatcgcgctagggttgaggggcacaggagggctgagacttggggagtacagttgactcacggtggatccgggccatccccttcccatatctggggccttcgtattctgccatgggtggacataggtaaccctgaaggcccctgccagttctgacagtagcattctatgatgggagttggggagatctgggtccctagcgctagggtccctctgtcttaataagagggctctgggcatcccactctcaagtccacccaactcttgccccctacctgccaggccccgacccttgaaggcccctctccgtgccccatcactgcaaccgccctgaccctcctctcggccatagcccctctctccatctgctctgccctaccctaccctagacattaggtcctgttccccatggcttcttttccggccccagaggtcctggctcccttccccctccctccttccctgcccctctggtcagtccctgcctccctgagccatcctcctgcccgtctcccccccagcatcaggcctacgagttccagtttggcgcagcctacgcctggatgatgtgcgtcttcacggtggtcatgacctacagtatcacctgccccatcatcgtgcccttcggtaggcaccgccgcgccgggacctgggccctgctcggggggacccaggacttcaccctctccactctaggaatgcaggccaccccgagtggacagggcccggctgggagaccggcccctcggggctcccgcccggtccctggctcagtctggggcctggcctgtggggaggagggggagagccatcagctcaggccagacccagctggcatgtgggccccagggcaaagtcacaccaacatggccatacttacccacacctgtgccttccctcagcgggatgtgcttggacacagatcacatacgtgctgacatgttcacacacacactcccacacaggcatccatgtgcacacttttacaccaccctgtaaactcaggaaagacttggattccagggtgggatgggtccttgccactcatggagatagtctgctgtatctgagctatgtgacttggccaggtctctcttcctttttgaagtttagcaaagtttctctttaaccatcacccccactggtagcctctactttcctccctaataacatcctaactccttaaccaaccctccctggttattgaaggctccaagttcccaaactaacttccttgtcctcattagaaactccctatccctcagcctctggggaaatagaacttgtcccttaatttatacgtatctgtttagggacagggttagagaaaaatgatacgggttttaagaagatgcttgttgattcaaatgactagatttccaatagtagaattcctgatgaggagagtagaatgaggggttgtagcggaggaagctgaagttctgtgatcacgctggggcacggggcactatcccgtcctggggcccgggcaggaggagggggccaacccttcagcactctcaggaccagaacaacctgtgacagacacacaaaaggttcggcagcactggttccgaggtcagggcccatgtggcttcccttagggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacgggtgagggatccctacccagggaacggggggtggcgagcagagtggattccagccagagcaggccacaggagaagccgcatggctgggggtggcaggcaaggggcctgggagaggctggggccagtctgtagcacctgggagagtgaggactgcattcagagggtatcagaagctggggtggggaggcccacaggagatagcaaccccattctttgccccccaacaccagggttcctagctcccacgtctatgttcacatttgtggtcctggtcatcaccatcgtcatctgtctctgccacgtctgctttggacacttcaaatacctcagtgcccacaactacaaggtgtggggcaagggtggcaggcggatggctgcgggcaggagctcaaggggaggaatgcagagggccacagggctggcgagggctgagggcagcgccaacagggccaagcgggcgtggggtcatgatcagggctgaggacatgcccccacttcctgactcattctgggcccctcaagattgagcacacggagacagatactgtggaccccagaagcaatggacggccccccactgctgctgctgtccccaaatctgcggtgagtgccctcaagggttgggaggggcctctgacagactcagcctcaaagcccagtgttcccttagtcctgcagaaaggggaacctgtgccagaccccatgggggcgggaagagagctggtctccctggagggctgcccccgccccccagggccctgcccactctgctgtcctacatgccctggtgttcccgcaatccatgaggggcagctgttcaccttgcccccatttcctc

SEQ ID NO: 120998 - DNA, 1145 bp, Homo sapiens
ttaaaaaaaaaaaattataacataatactttactgaccattaccttgcctcattcactcaaatattcaaatatttaggtcttcttttttggtttctccataaaaaatttgtttctccactggggtcttgcctagttttttttattttattttattttttatttttagacagagtcttgctctgtcacccaggttggagtgcagtggcacgatctgggctcactgcaacttctacctcccgggttcaagcaattctcctgtctcagcctcccaagtagctgggactacaggcgcctgccaccacacctggctaatttttgcatttttagtagagatggtgttttaccttgttggtcaggctggtctcaaattcctgacctcaggtgatccatctgcctcagcctcccaaagtgctgggattacaggcgtgagccatcgcgcctggccatcaggtttttattagatttttttccctgtggcattgtggtttttgctgctctccctccccacatcagatatgctaggcatgtccttccttaccttctcctcaagctcctctgtccaccctcatccctctcactgtccaggaaacagctgtctcctgccccaacaactgactgttccctctgaggcattgccagagagggtagggcccccacctcccaccctcagggtcctgtcagctgagtggggggtggggggcagtgggcaacagctgttgcagtggggacaatggctgtattctatacaagctcctttcctgggccacctcctcctccctggctagaacaactgttcttgtggattggggagtcccatctgtctgtgctagctactctttcaggcaacctccaactccctggcccattttgctcatgtcttacaggcatatccagtgtgtgtcccactgcccggtcgcctgtgcatgggtctatcattgcctggaattggtgggcagaggaatgatggtcatggataagggaccatccctccaaagcgcatcacctcttctttcagtggtcacattcaggccctagctcctcactcaggtaggtggtttctggcctgttgtcccaggcagaaaggcactgtgattatgacagggctgagctcccagttcctgggctagaactccgcccattcccc

SEQ ID NO: 120999 - DNA, 1095 bp, Homo sapiens
gcctggagaagaactcctgctagactgagggagaagggttagggaactccaggggcattgaggctgtgcaagaggagggggtgactagaggaagggaggggccagggagcagtaggaatgcctggagctgggaacggcaagctgtaggtcttggtttactcttgccttggttcagtctccccatctgtgctatggtgagaaccttcctgcctcagctgccttgccaagagaaagggcttcatgaaagcaaaaatgacctacaaattgaggtcaggagcaggaaggtgtaaactgaagggagggggaactcctgcccaccccatgtccttgccaggtgaggcagaaccaggacatgcaagcctaaagtctgtgttgtcttcccaggcactgactcactggccctgccatgcccacgccactgctcccgctgctgcttcgattgctgctgtcctgcctgctgctgcctgctgcccgcctggcccgccaatacctcctgcccctgctgcgccgattggcccgccgcctgggctcccaggacatgcgagaggctttgctgggctgtctgctgttcattctcagccagcgacactcgccagacgctggggaggcctcaagagtggaccgcctggagaggagggagaggttaggcccccaaaagtgaggccacaagtcctggcagcagctgtatccacaaaatgctttcttttggagtaggataatcctggcaccagcactgaccgaagcctgcccagtggacagaagatatagtgagggttgtgcatgagagggatctgccacagacatgcctctccactcccaacagaaatgtctttctggaagaatgccttgcatctagcacaaaactgattattgcccctctgtcctccagcagttcctcccaaagaccactcctaatcacctctggcctcaggcgggaggggaactaacacccacccacccctgccctccctgcaaatgggaacatcaaggttcccagtgcttaactgagggacaagtgacaatttagcagagaggcaagatttgaatccagactgtcttccagactcaggacctaccttaaaataatatctgagt

SEQ ID NO: 121000 - DNA, 1043 bp, Homo sapiens
cgggtgcccaaaggcgccggccgccagtcccaggcccgaagggcccctcccactgagtcggctctggtctccccgcccctgagccgcgaggactggacgcagctggctgcggagctctgggcgggcgctggggtcgcctgttgcagcctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggtgcgcggggcggggccggggggcctggcggggcggggtggggtgggggcgaggtctgcgccgttctcacgctgccgggcgggacagggggccagtagggggacccgctgggctacagtgtctcaggggagtcagaatctttggtttctggatgcggggccacttttctgggccttcgaaggccattattagatgactgcctccccaaactccccagccacttacagatgtcccaggaacatagggtagggggaagaggtctggaaaattagcctagaagaccagcccagacctaactgaacaaagaatttagtcttctcgaaccccgagccagtacccacactgtgaacacacctgtctttacttaaaaaatcttgatgttttattcatcatggagtctttaaaaaaaaacaaaaaccgagtctcgctctgttgttcaggctggagggcagtggtgcgatcacagcctactgcagcctcgacctcatggactcaagccatcctcccacctcagcctcccaaaatgccaggaccacaggcatgcgtcaacatgctcagctaatttttttttttttttttttttaagagacagagtctccctgtgttgaccaggctggtcttgaactcctaagctcaagtgattcttctaccttggcctcccaaagtgctgggatgacagatgtgagccactgcacttggcatcatggagtcttgatttgtagacattg

SEQ ID NO: 121001 - DNA, 1029 bp, Homo sapiens
agccctgtcacaaggccatggagatacagtcacaaacacaactgagaacacagacagtcatgagacatgtgctggttaccaacccccaggccaagcaaacacacttccagcaaacacacatgacttgttggtgacagctgagaggacacatgcctggggagagagaggactgtgtgtgaggtggtgaggcatgcatggggcctgccaagttggggagggagtctgggccaagccacggtcccatatagggtggtgaataaggtgtagagtagaggtgcagcaggaccaacccttcccaccccaccccttcgacagggacctgagggagctcagggagggagagaagccagaagaccaggcagagactgaagagagctggcaaggcctggctagaaaaactccaggcaaggcctgtgtaagttggggctcccaggctgtccagcagggggccctggcacccagcaacctctgcttgggaggtggctacagaggggtgtgggtgttggctaggggcccagcaggatggatgccagacggacttctctccaacaataacagccctggctgttgccatccaccgagctggcagggccccagtttgggtggggagaggaaccagcctttcccagtctggcctgagaccctcaccacttccctccagttttcttccacctccagccccctctgtacacaactgcagccactggccaccagccttgccatgcctggcagatcttctgaccactagccctgccacccccacagacccagagaccaggaaaggagggtggggagcgaggaagggggccaaggcagagggcagaggagggctaggagaggaagagagagagactggacaaacatgagggcaggaattagggggttgtggacagacatgaagccactctcaagtcatggggctgtgcctggaaaaataccacctaaacccatcttcctgccctctggttagggctggcggggatgtgggggatgggggtggggtgggggagggttgggaaggaatatgtg

SEQ ID NO: 121002 - DNA, 1030 bp, Homo sapiens
gtcacgttgacctccgcaaggggcaggcgagtggacgggtgatccccatcgatctggtcggtatcagggaggggccgtgccgctgactgcgctggcggaggggtatggggatggggatggggatggaggctcgcgagcggaggtgcaggctcgcgagcggaggtgcggggctgtctctttaaccccggtcttttactggctaaactcgtatccctggcgtctccttcctgcgcacgtcttcatttactgatttactgtgagggtatatgagagggtgaagacaaacagtcctcggctttgcttaccaggagagagcagtcgtaggtcaaggctggctccaaccctgccctcacacctctaggggtctctctgcagccctgtggtagtccctttgcctactcctctcggtggcctccagaccctccaactttcctcctgcttgtgtaagctccccatgccaggatgtgtgtgatggggcggggctgagctgcctgacactcaagtcaggctgggaatgatcttggtctccacctcatttttccctttagttgaatcagagttccccccacctcccagtctacagggctaactgagaagcagcttttatacctctctccattccaaaaggagcttgaacatttaatatggattctagctcctccactcaccagctctgtgacttcaggcaagtgactcaacccctctgaacctcagctggccccatctattcagtgctagtactagcttatgggtggttgtgaagaaaagacaagagatctgcaggtagtggctagccccatatgaaatcctgggagtggagaattgcaggagaggtgttgggagtctggaggcagggaggtactcaatttggtggctactttcaggggcccacctcagcaggccaaggcatagttggagggacaccagatgctctgagctggtatcagatccctgtttgccgctgggcaaaggcagacaaaagcaaaacacgaaggctggccagctgaatgttaggatatgggcaggagga

SEQ ID NO: 121003 - DNA, 8535 bp, Homo sapiens
gctgcacctgcgagagctcccctgctgagactccctgttctcttatctcccgagcgacaggggtggctttttatctcctgggtgtgcttctgcttctttgcttgcaaggcttctcagaatggggccccatgaagcctgagggactctctcctgataacaccctgtgccacctttttcattctggatccgcacccaggagcccgtggacaaggcccactgcctgagcctgaactaggagcacctcctagggactgcccaggcttgctctgctctgacccttctgctggccagtctgggcacctggtgagtgcccagaaagggagggaagggaagctgtcctttcaccccaaacagcaaggcctgggcccagctaggcctgagtgtggggaatgtgtcagtgcacatctgcctggcttcccatgccacccaatgggaaagctgtttaatctgctggtgccagggggtctccccctacacaaatggggagcaggagagggacgctgaggcagaaggataggtgctttgggatccacccctccaatcttcttttcaaggtcactcttagaaaggggaagcggacaggagcctgtgacagagaggaactaagggaggactaggtgaccctggggtcgggaggggggagggggaagggctgtgcccccacatccattatgaaatattttcttggaaaaccggccagcaactaggaagcccctgggcagtggctggaaagaaaggttaaggtgccaacagcagagagactggaatctgggttgccttcaggagaggacagccccactctagccatgaatccaggggctccccagggagggtggagagaccagacttgcagagaggggcctggggagcctctggtttgacctcagtcatcatcgatgttgtcgcagctgctgcagatctgcctgttccgtgtccttcctcctcctcccccgacctctttgctgtgtctcctccatttgtctccctccttcccttgtcatcactgtccctgacccctctcgtcctcttgcctgccttctttgactgtctttccctccctcccatcatctttcctcctccttccctcctgctctccaccctcctgtttcccagcttataaactgcttcggctgctggataaaaatagcggtggcagcggccaggccgggagccaggtagagtctgagcaggcaggggggccgcgcaggactggcctgctgggccagggggctgggtgggggtcaagttgagtcgtcctgaggggcagggtgcagagggggtcttactggactcctccactggcctgttctgtcagccctgccccctctccccctaagagcctgaggaggcctatggcagggccaagacagggcctcacactgttcctgcccccagcaggcccctgagggagggagctgtcagccagggaaaaccgagaacaccatcaccatgacaaccagtcaccagcctcaggacaggtaaggggtaaggggctgggctgtggatccagggaatgggttttcagggagctgggtgtggtgtcctttggaattgggggttgccattgctggctggccttccagccaggtagctatgagtcaggtctgcatcaggggtggggaccccgtgtgccttggctgggtgctggctggggtgtctgcgggaagggcagggtgcgtgggcagcagtccttccctggcctgtctgtgtttccactgttgctctccagccagttagcggctttcggctcctcccgccaccactgtggggagatacttggctgcacccctccttccaatgcacatctggcagaactgccctggggcctctgccttagatgacctggcccaccctggttcttgatctgatcttcctctcaattccctgcctctggagcctgtgaactcccagtcaagttagacttgcagttatgactgtgaatatgtattttggaagaagaggctgtagcttaattcaatttctcaaagggatctgggacccaagaaggctgaggaagtgatccctgagatccaaagctccttcaaagcgtcaggctctgtcctgccctccaactcaggccccagaaacccatcacgtctgccctacccaccccatctccctcctgtgccaaaggctatgaaactaggccacttttgcctgtgggggctttgagcatgtagcttaatctctctgggactgtttttccacctgtaaaataagctaaaagtatctacttcccaggaagtggatctagaagtaagggaatttaaggaggcatggcaataagtccaggccccaggttgcttccctgcctcctgtgctccattcccaggctgcctgcccattctgtccccacctccgctctcctgtgggcagttccctgaaggcctcgccggctccatttgccttattgcacagctcagtcatttcccagcgtactccccccaaccccgatcctctgtcctatgtgactttgggagtttttccttctgctctgggcctccgaaccaagcctttagcttctccaagggaagcatgtatgtgagggggttgggggggctgcagttgcattaactcggacctgctcacgtggtgtgctcaccacgccatccctgtatgaggcctgccagcggtccaggctcctgcactctggccaggcctgtcttctcactgccttgggctttatccctgccatctctgaagagagctggtgttggctctggggagggtgtgcaaacccaactggagatctacatgggccgggctggggttactcagctttcaggcaaggcctatctgggagaagctggcgtgacccggaagggccttgaggtatagggcttggggcattgccctggccaaaggtggacagtccttatttacaccctgaggcccagatggcctccagtggccccatacctcctggcctgccctgggtggtatgaactacaaagttctatttggccaggaagaaaatggctctaaggccctctcttcacagcggccctgaggcaccctgcccacctgccctgtaggtccagaatagtatgggagtttcttaacttcagaatcctctctggggagtaacacagtccctgaccagacagcataattacttccagcctgcctggtgggagtggaagacacttgctgcttgctttctcactcatccacccaccccctgcccttcggcaggatttccaaaaccatctccggatgtgtgggtcacactggttcccagcctgcagagtcccccgagccttccagggctgataaccatggtcctgtcagccatgccattcagtcctatgaccctgaccccatccccaccccaaattccaacgagcaatgtacccttttctccccccacacccataagaggacacatgcaaacggacacaaacacagacgccctgtgccctgggacctagagagactgacaacggacaggggctttcctggggctcattgtggagtggggcaggatggtgcgtcatttggcccatctttcctcctccattgcagatacaaagctgtctggcttatcttcttcatgctgggtctgggaacgctgctcccgtggaattttttcatgacggccactcaggtgaggctggagggactgggctccatggggcagtgcccactgtgcttgcaggatctgactctgtgctggtaggcacagggaaagagatttcaacactcctctctgcaacccctgcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggtgagtgcccaccccctccccagcccccagcctgaccctcactgtgtcctgcacccccttggctgagccccagctttgcccacttgtctctgccacccttggcctctcccggcaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattgtaagctgggccaggagggggcctatgggaggaggcatgcccaactacccccactcttttttcagacccagcgttagccagagagaagcccagcctccgcctggagggagtggatgctgtgagcagctgggattcagaggcctgagtgggcctggaccagggctgggagggggcagagagaagggcagctcagcctcaaggctcaccaagagtaaagtaggaatgacagggatctgtcttcttgggcacccccaaccaccagccctagctcccctgctcatgcccgccctgtttccccagcatttggtgccatcctgcagggcagcctgtttggtctggctggccttctgcctgccagctacacggcccccatcatgagtggccagggcctagcaggcttctttgcctccgtggccatgatctgcgctattgccagtaagtccggctatctacctgcccagtgccctggtgtggtggggagaggggatggggcctgtctctgatcactgacaccaccccaggtggctcggagctatcagaaagtgccttcggctactttatcacagcctgtgctgttatcattttgaccatcatctgttacctgggcctgccccgcctggtgagtaaatggagggagctggggtttggggtataggggtctggggttccagaccacgggtgttctgaggacaaaacctgaaggaggccgggattctggagattctgcctctaaatccacctcccccgtctcccttacttgataggaattctaccgctactaccagcagctcaagcttgaaggacccggggagcaggagaccaagttggacctcattagcaaaggtccgaagagcctgaggaagctggggtggaggatggtataccaggcgggggatagcatgagcaaagagaacaaagatgagtgccctgtgttagctagcagccctgagccagaggaggactgaaggactacagcagggagagggggacaataggaaataagggccggcaatgataaaatgggggcagatcctggatgaccttgaatgcctgaggtgtttggactaaaggcagtgggaagcaatttcagattcttgagtgaggagtaacatgacctgaggctcctgggagaggccaggcccccgggtcttgagttgtagggatttggaggcgaggtctgggttagggttagagtacggctgggactggttaaggaggcgtctactttcaagtaatcccagccgttttggggaatgtttatgttgtcttctgttgctctgtcttccccacaacttggagatttcttccatcccgcaggagaggagccaagagcaggcaaagaggaatctggagtttcagtctccaactctcagcccaccaatgaaagccactctatcaaagccatcctgaaaaatgtacgtaggggaggttatcctatcttctaccccttgtcctctttctctcctccttttgctccctccccctgccacccatctcctccctttctgacctgagagtggtcactcctggattcttttgtgtgtgcgtgcgtgcccatgcgtgcgtgccgggggtggggattcgtggttccttttttttgagacagagtttcacacttgttgcccaggctggagtgcaatggtgcaatctccactcgctgcaacctccatctcctgggttcaagtgattctcctgcctcagcctcccaagtagctgagattacaggcatatgccaccatgcccggctaattttttgtatttagtagagatggggtttcaccaggtcaagctggtctcaaactcctgacctcaggtgatccacccacctcggcctcccaaagtgctgagattacaggcgtgagccaccacgcctggcctggattcgtggttctttaatgcacagccaccatgaagacacaggcatttgggtgactctaccccttctatctagatctcagtcctggctttctctgtctgcttcatcttcactatcaccattgggatgtttccagccgtgactgttgaggtcaagtccagcatcgcaggcagcagcacctggggtgaggatgccacaggtttccaggatgggaacagacaggatcttgagttgggctggaagtggggaagggagggagcctgggtcaccttctccccgtttcctgggtccatttgcccttccctgggctggaagcatcttctccattttactgttggggaagctgaggcccagtgaaggttaggcttgctatacctgcctctgtgagcctgataaccacccgttcatctcctcttccagaacgttacttcattcctgtgtcctgtttcttgactttcaatatctttgactggttgggccggagcctcacagctgtattcatgtgggtaagtggaggaagagggccccaggcccctgtgggaagtaagagtccagcctggacccagagagggaacccaagaaagtatggtagtaaggggaccatttgttttaaagtcgaggcataatttatgtatagttaagtacaagtcttaagtgtacaacttaatgaatatatgtatatacacatacctgcccagatcgagatgtagaatatttccagcactccagaaggctccaccatgcccctttcaagagtaaccccctaaggagaaccaggctttgaggtttcagttcagatcctgaggggccccagatggatccttgggggcctggctgtgccctggggtggcggcctgggctgaggccctgcctggtgcccacagcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagtgagtagggctggcagggaacttggtggcatcagacaggatctagagttccagtgggggacactcagtagagggagggcaaaaggagagtccctgctcccagagctgagaggagagatggctcaggaggggctcccaggctgaggggatagtgactgtagtggaggggggcgccaagcttacttgggtggaggtggagacaggtttgcaggaaggagtgaaagacaaccccaccatacacgttccctcaaggaggagaagccaggttggggttaggcagccaggatgggttgatcaacagaatgaggttcgacagtcaagttgctccaccccacccctccttccacccagaggctctgggctggggtacagccattctgaggtagccttgcccttccttccccgcttaggaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggctccctgtgtcctccagccgtggcttcatgccctggagtgggtagagggctggcagcctgagtctgggagatgagcatgacccagctgggccctggccaggactggacctgggtccaagggggaggaggggggagtagtcctcttggcctcagaggggctgcaatgccccctgctggggccacaggggagggacaggcctggaaccagaacaccaagactgttagccaagactaagaacgggtttttctt

SEQ ID NO: 121004 - DNA, 1001 bp, Homo sapiens
agtccctctgtcgggacgcgagatgtgtagggcagatgctaggaagaagattgggtctgggagcggtggtccgcgtggttagctgcctccgctctttttcggtgtcccccccagtcccgcccttgggtgtggggacgcctgccccacaagtgtttagggaggtcagtgggttcctcgcccgtagagacaccgtttatgccaaatgagcactcctcatccccgctcttgatggagtcatgtcctagacgtgaaactatggggctgtgatcacaagcaaatgtgtgggcggatccgttgcttgggttcttccccgccccctctttttttcggaccatgacgtcaaggtgggctggtggcggcaggtgcggggttgacaatcatactcctttaaggcggagggatctacaggagggcggctgtactgtgcttcgccttatatagggcgacttggggcacgcagtagctctctcgagtcactccggcgcagtgttgggactgtctgggtatcggaaagcaagcctacgttgctcactattacgtataatccttttcttttcaaggtaaggctgagatctccgctaggcttctttccctttagtgctgtattcgtgttgtttttgtttttttctgtcctttagggagccttagtctagatgtcggggtggcttgtggataacgctctggatttttatagggtgagggtagtggtgggtgaggttttttgagtcctcctcggttttctctagtgtgtttggggggtggggctttctctcggcgcctgctggccgtagcgaggtgggctgtggggttggggcagtgggcggctggcagctgcacgtggtggccgcgcggcccgggacgctgccatttttgcccctccacttccggacgcggctacggggcgtcggagggggaccgcagggtggcgggggtgcccgctcgggtgactcagcacggccttgtgggactggctttgtcacctctcttatcggacgcgttgt

SEQ ID NO: 121005 - DNA, 6081 bp, Homo sapiens
ataaagaactgtaggtagtgattttcacatttaaatttgtgtaaggattacttgggatctctagatacctgggttggaccaacattatgatttttctgccatactaccagatgatgctgaggctgctggtcaccattctttaagtaggtgggttctgtgacatttggttgaagaatatttagcttattttctttttccttctgaattttcaggcctcccacttagtgtgtagtctgagatctttaagagaatgcatttttagtcttgggaagggatagtactccggttaaaccagtctgaactcactgtctaaggtcctaacaaatgatatgacctttaggatttttaaacatggggccttagtgttcttttgtaattaatgagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgtaggtgctctggtttccacatttggcatggtttttttttttgatactctagaaggaggggaaaggagtggtttggcctttgttggggactactattgaagggggtaaacttgcagctattccaaaaagatgggttttactctggccatcttgaacttggaagggactatgtccagaataagtgggctcatggaactaactggttctaaagcctcaagatagggggcaatcagatttgaggctgagagaggtaaaccaagattttctttgaagatacgggctttaagaaagcaaaagtggctgagcgtgttggctcacacctgtaatgccaaggcaggaggatcacttgagcctaggatttcgagggcagcctgggcaaccgcgagaccttgtctctgcaaaaaattaaatattagttgggcacggtggcatgtgcctgtagtcccagctacttgggaagctggggttgggaggatggctcgaacctgggaggtcaaggctgcagtgagctgtcatccttgccactgcactgtagcttgggcaacagagcaagagtctgtcttggaaagagcaaaagtaagttgctgtttgtatttccaggccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggtattgcagttctgtaggcattcatacttatctgtgttctttggttttttgcttctttaaaacttgtgattgactttaaacttgttggcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtaagttagcttttctgttacaaggtagttgggttaggattttctgggctcacaccagtagcagaaattttgggcatcctgtctgtaaagcagttcttcacagcagttctgctgatacttactaattgctggtctcaactgcatatactttttaccctgttacacgcttgtaattgactcttctaggtgagcccattggcaggggtaccaaagtgatcctccatcttaaagaagatcagacagagtacctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacacacggaacttgtccaactgataacagaaatgtgatagccatgtgatttcacttactgattaccctgtcatagtgaagtgccatcatttctaatgacctcactttctcttcttatggaaatctgggtaatgtctattggcagccttacacatccagggttctgatcagaggggactgttttctacatacagctagtacccatctagatcgtggagggcattaaggctcagttttctcaggagctgcttgttgtgtgtgctctatcccttaggcttagggaggatcattgttccacttttagataatttggtgttggggctaaaaggtcctcttttgaaatgtaccacttatttttggtttctttcagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttgggaggttttaggcattctgctaggatattctaaggtaacagttttctgcaatacatagtaggtgtaagggttcaggaggctattagagccttctgtttgaatctggggaccaggtctggtctagctgttttttactgagctttctcaccctggttgatggcagattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaaggtaaaaaggcaaataatgcttattccctttaccactttcttagtaataacaataaattattccattcacattgaaagtgaagttattgtagttaagctggattgtttttcctcttcccacccttcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgcgttgactctgattgaagcctttttggaggagtggggagcacaattagggcttcctgggaactggcagtatgaggcattttagtcactgagttcatttaattaccctacaggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtaagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcgcaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtaagtagctttggtacttggtgtggcaaggagtttgtgcaactcgtctcctctatggatttgacttaatgctatttggtcaagtctcacatggcttaattttacttcaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagttctgctttcccttgtgaagtggatgttatccttccctagcttcttcatccctccagctcttgctgttttcatgagcacagcaagttgagctggttttgtagtgaaaataacagaataccagtgagtcttaagagttcacacactgaagctaaaggcagtttggaaaaactaccatataataatgccctttcagtcaaccaaaacacaggaccaagtccactgcagtaatttaatttaataaaataaaattataagagcaaaaagttacatttctaaagtaccaaaacctgcaacaggctcatggaacagagcctagggatccaggagcataggaggtggtggtgctgggcagggctctgcatcccctttcctcagcacagcaccatcttcaccctcctgggaaagcagcattggagcctacaccgctt

SEQ ID NO: 121006 - DNA, 1872 bp, Homo sapiens
tacagaggaaccaaaaagtgtatattttcctttgaatcacttaggcataatcctgaagagagagaggtcaatttttgtctaccttttcattatcttgcttattgtctcctttgtctctaccttccccaacaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtggacttggtcctgtgttttggttgactgaaagggcattattatatggtagtttttccaaactgcctttagcttcagtgtgtgaactcttaagactcactggtattctgttattttcactacaaaaccagctcaacttgctgtgctcatgaaaacagcaagagctggagggatgaagaagctagggaaggataacatcca

SEQ ID NO: 121007 - DNA, 1043 bp, Homo sapiens
cagtgtggtcccctctggagggcggaggggatgaggagctgcgccctaatccttatgtccgctttccttacagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtgtgaagaaagggcggggaagtgagctaggtcgggaaagagggtatttggccagcagtccaaacgggatatgacttggagagggcgggaggtcggtaggccggacagcagggcaggctggctgctctggggaagatgaagtgctatggagaagatttggggcttgactttgtgtgctttcttcaggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgggtaggtgggctcagcctctcttcctgggttggatgccggtgggcagggattctgtgaaggtttccattttaccagtcccagagctttgctggctggtgtgtttcgtgtcctcctcccaggggcacactgcacctccatctttgaggtgtttgggggaaatgcccttttgtttcttccttttctcctctccagcactggtactgaaagttcatgctgttatttcaagatgtctagtgcagaagagaggactcctcttgccctattctctgtgatttctactgtgccgttattatacttccttcctgcactggtgtctcacatactgtaaacccactgataaaattgtgggggagccattcagccttcccccagtactgcatgtgagagagtgctaacatgctgaccccatggcattttgcagtgggtact

SEQ ID NO: 121008 - DNA, 1037 bp, Homo sapiens
aggagagtccagggagaaaggaacattgggaagaggtcaggggtggatatgaggcatggggctggcccagagctccctcctctgcccaccttggtgagtctcagcgagccccttgtgcatgggctaggtatcctgcttaccagggaacatatctgaaggccccagggtcctcagagtccgatcaatgatccgcctaccccgctccagggaggccaggaaggctgcctcgtcctctgacaccaggttggcgatctgaaccaggcagagaagaagtggagctgggtctccttggaaggagggtctctctccacaactctcccatcaacccctttctctcccactggaatccagtacctgggctgagttcctttgcagttctggataagcatctccctgggggaggtggagagggctgaggaggtgtgaaaggcaaccaacccacccccacctccccaccctgggcctccctgaggacacctgccctggaggctcagacacattgaggggctgggagagggactcaaatggggaactggtttccctgtagggtggcagaagggggtcctgaggtcaagggctgagcagtttggaaaaggagcctcctcaagttctcctgcttcttgtaagcaaggacagctttcttagcttgctgataggatgctgggctcgatatttagggtggggacctctgggcacccaggctgggggcactgtctaggctcagtggtaggctccccaaagtgcccagggaggcccagagtgaaaaagaagctctgtccttaccagtgtctccaccactacaggtaccaggctgcctaggaagccaggtggtgcctttaagatctccatggagaaacgcacagctcgacgcaggatccgacgaagaaccagcctaaaggggttcagagcccagacatgaatccccagcggctcatggtcagcaatatggggagtgggaaggacgaggtccagtgtgtgctcccacctcaaagctctccctctccccattcctcctactggctcaaccagacccacct

SEQ ID NO: 121009 - DNA, 1125 bp, Homo sapiens
ctttgggaggccgaggcaggcgaatcacctgaggtccggagttcgagaccagcctgaccaacatggagaaatccgtctctactaaaaatacaaaattaaccgggtgtggtggtgcatgcctataatcccatctactccggaggctgaggcaggcgaatggcttgaacccgggaggcggaggttgctgtgagccaagatcgcgccattgcactccagcctgggcaacaagagcgaaactccgtctcaaaaaaaaaaaaagtgcaaggtgcaggactcctcacggatttccatatcaatgaccactctcccagctcatttagtatggctttctacgtatttttctacccaaataaataaaagcctcaattctcaaaactatttgtctctgttgtgagtttaagtctattttaaaactcaaaaatgagaacagtctacttctttctctttgtattcctgctacagcaatcctatttatttctggagcaatggttgcctcctacacagagatttatatagaaaaatgtgtcataaatggtcagttggtactcagcaacttttgagggtctttcggtaagtctattatgagtaggttggggcaaagaactcactgagctacaaaccaaggagatatagatacacaggtagatatatattcatttcaatagcctttaattaaatcagcaataaaataaaaacatgcacttcaggctgaggtttatgggatgttttccttgtggagaatataaagtacaatttaaatgtgtatgccaggcagcatctaattggaacataaattcttttcttcagacttcaatggaggtttctattaataagtatctgagagaacttatctgatgacttaaatgtcacatttgcattttatgaaattcagagaaaaaagaaaatgtggattagcatctgctgtgagctctttgccaaaacgtgcagcctgcaaactgtccccttcacttttctgtcttcctggctgcactaggggaacatggtgactctacagggctgcccccagctacagaatgcagggcctatagaatcacgactcgagagtttttcggggactgcacagtcaagacccagaaggaaacatcaccgtatttctttctccca

SEQ ID NO: 121010 - DNA, 1054 bp, Homo sapiens
tttaacattcttaaatttccaagcacaattactacactatttaaagatatgaacaactttgatgacagtaatggagcagtacaaaactgattcatcaaataacttgggaaaaaacctacaatttttattaatagatgatagataataacatttctattcatagataataattccagccataatgaagtagcggggatcagatttactctcctgacttaaacaagtagaaaactggacaaaatgtatgaaataacaattttcagaatgagacaacaggcagcacaggattgtgatcctaaagaaaaggaaagcaaatgaagagattcctgtaatcacccagctttgcctggaggcacattcaagaccacagcgtaggatgagcaaccccacacagagcatggcattctctatgagtttgaggagccgaagatccaagttcagagagtcttggaggactggaagctgcagggcagagttctggggaagaaggaactttacaaaaaaatgaaagtaagaaatttacacagcacttcctttgagtctttgctgaatattaagacacacatgtgtagggtagaactccaaaagatcagacaatagagtgactgggaactgaatgggctcacaaagggctaaaaatcattttagttcccaccaactaaagtgaagactcctcactgatcactcaaggtattctgcagagactctaaaagggccacatcttacttagtaatggagttaaactatccctaaagactgctttagacacgccctaacaaagcttgaaaacaagcctcaaaccaaactgcaagtgacttaactgcctgctacagcaaagaccagcactctttaaaagaagaccacaaggcctgttgcggtggctcacgcctgtaatcccagcactttgggagcccaaggcaggtggatcacgaagtcaagagattgaaaccagcctggtcaacatagtgaaaccctgtctctactaaaaatacaaaaattagctgggtgtggtggcacgtgcctgtaatcccagccactcgggaggctgaggcag

SEQ ID NO: 121011 - DNA, 1049 bp, Homo sapiens
ctaatccccaaggtgatggtattaggaggtaaggccattgggaggcgattaggtcatgagaccagagccctcatgaatgagattagtgcccttgtaaaagagaccccagaggactagctcaccctttctatcatatgaggacacagcaagaaggtactatctatgagccagaaggctggccctcagcagacactgaacctgccagcaccctgcgcttggacttcccagcctccagaactgtaagaaatgaattcctattgtttataagccattctgtttatggcgttttgttatagcagcctgaacaggctaagacactcacatcatgtctgtattttatgattgatttgagggcatccttagaaaactaaatataattgactaaaattgaatgtggactaaatgttaataatattttatcagtgttaaattctgtgagtttggtatttgtgttgtggttgttagacaacatccttgaccttagaagatacatgctgaggtatgtaggtatacaggtgtaaagggttacaatatctgccactcactctcaaagagttcagcaaaatggtaactgtaatattgtgagagagagaaagtttgaacaaatattaacaatgatagaatctatgtgaaggatatgcaggtgtttgttgtacaattcttgcaacttttatgtaaatgtgaaagttttcaaaatataaagttttaaaaaagcaaagcacaacacttcctcataagggtcaaacactggatttagaacagtcacatgacaaaaaacatcaactggaaaagggtcgccagagtgcagtcagcacatgttttgtgggcctgtttatgctcaggattgtcttggaaagtccaaagcacctgtggatagaggcatggagttacaggttttcttccattacaaaactaacaattctcaatcaatacactcgacccccaatgcttggctatgacatctgcccatgagaccacctcgggacagaagacacatccactccaggagatactttgcctgccctcctttccactgtgaagcctctcaa

SEQ ID NO: 121012 - DNA, 1013 bp, Homo sapiens
caagcgcgaccttctgctttgaagatctgcgcaagcgcaaggtgggagggggcgcagaatagcaagtctcgcgagatattgggtggctgaaagggaaaaagtgtcttgtggaagctcagctgcaggaagactaacacaaaaccatcaaaccactctggccaaagcgccttacgccccgcgcatgtccaaaacagaatggaagaaactacggctctcgcgagatagcggcggtagcgcttggctgggaacttagtggtgggattgatcgtgacgtcaccgagtggcagagggtgggaacgtcacgcgtacggaatttcagcacagttgctccgaagaaggctttgttaatttattaatctagccctttcaagtatttcagtaataggaatttattcacagaatactcaggaaaatccagtagtttatttaaggctcagtttcctaacctgtaaaatagagatcatagtaatgccaacctcacaggattgtcgtaagggctaaatgagatcatagacccagcacagtatctgatccataataactgctgcaaaacaatagcagctattactgcaaggagggcaacgccaacttcaccccgtccccaggtgatccaggcttcttccagaaacctgcagaaacgtcacgtcagagtttttaattcatcgcccagtctggattaataatgccattggtacgcactggtattagacaaagtcgagttgggttgaaatattgtgaaatcttggctttctcataagtttgggtaataaccttactgaatctcagtatcctcatctgaaaagtggagctaacaatacccgcctcgtaaatgaggaggcagattaactgaaacataactaaaacccagtgaggtagggattggcaaactctctgctaccccaccccaattactcatgcagtctccttcatccttccagaacatctctggctccatccctggaaaatatcaaaatatttagtgggttgggaaatgccctatttatagtacttag

SEQ ID NO: 121013 - DNA, 1565 bp, Homo sapiens
cttcgggaggccaaggctgggatcacctgaggtcaggagtttgagaccagcctggccaacatggtgaaaaccccgtctcttctaaaagtacaaaaattagccaggcgtggtggctacttgggaggctgaggtgggaggatcggttgaacccaggaggtggaggttgtagtgagctgagatgctgccactgcactccagcctgggcgacagagtgaggctttttgaatgtagaaattggctgttaagaggaagatgatttttaggctgaagaagtcgttctgatttctgtttgtcttagtggtaccagttcctgctgtcatatttggtaggacttaagtcctgtttgcctgcctgtcatccagctaagtagactggatggaaaaggtgggctgggtggggaattaggaaagacagagggaatgtcatagtagttttacttaaattttaaaacatatcaaatgaaaggttacggtgaatttagtgagtgtaagtcaaatgcttaaagaaataagccatggtgtgagaatcaaagcatgagaaaatagtatgaaaactggaaacactgtaagaaacgtgattttgtattgtcttccaaatatttcaaaatttctagaaaagcgtaaataaataaaaacatgatagatgagaaagaaggcttatgatcatgattcagtgaagtaaccttttttaaccattactaatcttgcataattaaaataaaatagaatgtgatgagatggggaatattgactggggtaagtgtaaccacacagcaaatattctgttgtcaaaaagaacagtttttgtaattgaaggatgagagcacaagtcagtgtatccattgtgcaaattggatatttatgccaggtaactgattaatatataaaatgatctatgtttaataggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctgtaagtgagtcttcagaaagagcatagaatatatgtatatgttctgaaagaggctgaataaactttgagtattttctgtctttaaacttttaattatggatgtgagtaaacccaaagctaaagccattggataatattttccatatctcagatggttgatcaaaattatgccttctgtcatatacttcctaaaataataatttaaaagaattatacaagtcatgcatgttcatcatagaaaatctggggaaaaaatagtaaaagagcaaataaaagtcacccataatcacactgctaagaattaactactggaacattttggttctttactaatagtttttttttttttttttttttttttaaatttgtatggctgtaccgcatttgtgattaggatctgtttgggttctattttagagtgattgaaaccagtcactgaaatcagcaaattttaatatcatttctttcagatgaagtgatagtaaaaaggctttatgt

SEQ ID NO: 121014 - DNA, 1149 bp, Homo sapiens
agctgtttgaccttagacaagtcataaaatctctctgagctttgattccctttcttgcgagatggggaatactaatacctgctttaccttagcagggttgttgtgaagcactcagtgaatatttgttaagtttctaaaatgtaaagtttgaacatagtggttcccaaaggcaggctgtggctaggctggctgcatcattatcacagggggagcatttaaaaatagaaatatcagggcttctcctgtatatactgagtcagtacatctggggtggtgtgggaggcacgggaagagcagtgatcttggaatctgagtattttacaagttcccatgtgatttagttggacagccttgcataggaattgttctaaggcatcaatagtggcatgtattattccattctatagagccacgaaaaatgtattggatgagagaaattgttctgaggggaaaaaaaagtatctaatgatagttgttctctcataattaaatagtttttaccctatttcacaatttgtgctgtgccagttagttgataataatgaaggatacaataattgtagccactgtttaatgaatgcttgcgagatgctttacatatttcgttttacttagcccttctcaaaatccttgtgaaataggaattgttattcgaattttatagggaaaccatgcttagggagggtaagtaagtgactaaggtcacatagctagcaagtggtgggcctggtttttaacctaggttctttgacttcaaaactcaagctgtttccattatgctacaccataaaatcagtatttttatgtttttttctcattttgagcaatagagtgtctcttacataccttgcttctagagtatgtaagaactaagaaaatacttagtttttcttcttttaatttttgcagatgaacttgagatgctttctgaagccagagcccgcttggctaatactcagggaaagaaggccaagaggaaagcaagagagaaacaattggaagaagcaaggtatgtgtggatataggaataaaaagcaaagtgtttttctcacataacaatcaacacagaatacttctgtgaccagatatgtggtttttttttttttttcccctctccaccagcaatcaggcaatcaattctgcagtgga

SEQ ID NO: 121015 - DNA, 1125 bp, Homo sapiens
acttttccaccattcttggccacctctctattctgtatactcttcagagttaagtactgtgagtaaggttgaaaaaaaatcacttttccatttttatccatggttgtaggggaccaaatttttagagccctttaaccgtgtggattgggccagggacacagcaaatgcatatgtgaaaaatctccaagtgtggctagcattgattgctttaaataaaatttgcagattttaatttaccctgtaatttcttgtaggcattcttgtagaatctacacatctttgtaagttatattctaacaggctggaatggcctctatgcaaagtgcagggcagggctatttgcttttaaatgttaaattacaaatctaccttgtaacttaaagcagttttttattgattataaaagtaacacatttttccttctagtattgttaatgttctcattttgggacataggtaatataatgctatatggcttggttatattcatttagcattattgtgtaaaggttttctaatgtggattgaagtccttatttccattatttaaagaatgaaattactttaaaatttgaaatacatttttctaaacttttctctctctcaacatagatgtgcatttatgtgtatatatgtacactaacgtttatacaaagttggatcatactgtacggttttaatgagaagtcagctgtaaatcttactgagatttccttgtaagtgttgaatcatttttgtcatactgcttttaatgttaattttaattttttttaagagagggtctttctctgttgcctaggctttagtgcagagttcactgcagccctgcacacctgggctcaagcagtcctctgccttagccccctgagtagctggatctacagatgcacaccaccattcccacctaattaaaattttttttgttgagacggagtctcgctatgttgcccaggctggtcttgaactcctgacctcaagctatcctcctttcttggcctcccaaagtgctgggattgcaggtgtgagccactgtgactggcctgtcttactggttttaaatcttctcgtctttggctttcaacatttttaatatgatgtgtctgtagatttctttttgtttatctt

SEQ ID NO: 121016 - DNA, 2029 bp, Homo sapiens
ggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatttaaatattatattcttgtgtttcttaccgagttaaagtagattttcttgatttaatgtttatatatttgctgtatctgcttcagatcctcttcagagactttaattggttgtttttaaaatatatgtaattttcaccattctccctgggtagtgagtttatggagttcctcatgctgtcatgctggaagttactcatagatactgttttgtaacttgttttccatctttcatattgtgaatagcttttcttatcacgaaatcattacagttatagcaacataggaagatgcaaagaaaaaaagtaaaaattaaatggaattccaccctccaatgactatcgttattaatattttgatggacatccttcatatctcctcaggcacatattcattgatagatatgcatacagttcttatgtgttgccctgtaacatgtaaactttctaacattttttacacagtggtatgtcttgggcctctttccatatcagagtagatttatagccttttaaaagtttatgtaaatgtctgtataatatcttataaattcatttaatttcttactgatagttgtttagattgtatccagctatctactatcataaacagtgcttagtgaacagctttgtaattaagtccttgttcatggtgtaacttatttcctcaggctaaaggctaaggagtgaaattgctgctcaaaaaatatgaaaatctttagactatgaatgtgtatttctaacttctctttgggaagagatgcaccaatatactttttcattaccagtgcagcagactgtccattttttgcagccttgccgttaaaacaaaacaaaaaactgaatggtgttaattagatatgcacaaatggtacttgttaatttaatttgtgattctttaattgttaaataaaacttttgtcattttagttacctgcattttttgctttgtgaattgtttccttttgctctttttacaccctttgagtgcattaaaaaaaaaaaaaaactttgcttagactgtttatatttaaccatcatactagttgcaaatattttttcctactatttgccttttaatttcatttataaattttcatagtgttacagttagaagttttatatctcaaagctattcaatgtatagatgagtggattaaaaggaaaaaaaagctgttgatttttttcatttgccatttatttaatttatatttagtaagtacatttccatccagagataagatatgtatttacttgtagttccttttggtttttctttttgccttattatgtgtatgtgtgtgtgcacctttaaattaaaactaggatttgttttggtgaatggtgtgaggtaaggatttaaataactatttcttccccaaataaatagatactttttttttaactgtatgggataatttatccctgtcacatggcatatgattttcaaagtgattttgcattcttttcagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatcgtaagttgcctttctgattttggaaatggaaaggaatagtaggaggagtcttacgaagggccaagtattatccttgtcagagccagatttttattatttatttattttacattttttaaaatcaattttttttttgagacagggtcttgctgtgttgcccaggctggagtacagtggc

SEQ ID NO: 121017 - DNA, 1100 bp, Homo sapiens
tcctatgtttagtcggctctctgtatctgaggattccacatctgtgaattcaaccaactgtggataaaaaatattccaaaaaactcaaacagtacaacaataacaaataacacaaataaaaatacaatgtaccaactatttatatagcatttacattgtattaggtattataagtaacctagagatgatttaaagtacatgggaggatgtgcatacgttatatgcaaatacgatgccgttttatatcagggagttgagtatctgcagggagttgagtattggtcctggaaccaatccccggtggatacttagggacaactgtatgtcttgtctctcacctagattgtaaaatccttgggggtgggaaccatgtcttatgtgataacaccttacctatcaggaatagctgtctggcagcatcaccgttctgcaacacaccaatatacaggaaataggcaaccaggaaaaaaaaagactttgaataattaaaatataggttgctgcaaaatctgtggatcttattcctaggagaatctcttaggcctcactcaggaacttactcatgtttagatgtgatttcaaaagtgtggtgtttggtttccaaacaaaatgtaaaaggaggaactatttaataaagtgtgtacatttgtaataatgacagtgatagtgatgtgagaaccaacagcttgatagggagggaggagacaaatatacacaaaactcaaagagtcatctggggtcattgagtgtggtggcccacctccctgcccactgcatgttcttagtcgccctaatgtgccaagaaaaggttgaaataatgtttagtggacgtagtttaggaaggcaagaaaatatcaaatgtagtgattattgtaagtcagtaaaataaaaataccatgctagctagaccaaacattgattttaacctagagatcctaacaaaaccagctggacagaattttgaaatctttattcttttttttttctatatttcctgtgaaataatttatgtgaaaaacatttgaaagcacaatccaaatgtaagtggcacttctgttaattgggattcctgtctttctaggactccttctaatggagct

SEQ ID NO: 121018 - DNA, 1003 bp, Homo sapiens
atctttaaaatgtttcagtagtaccagaaagaatttagaaggaaaaaaatggaaattgcttttgaaaatgtaaaaccgctgtttaattcatgctgtaacaggtaataacattaatatattatagtgatatgtttggtaattgtatttgttttaaaattttaggtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggtatgattgagctggaatatttcttcttgagatttaggtagttgttaggtgctgtgtatcatggacaaataatgaacttatttttccctgttggtattcataaacaactgaaatgtatgattaggagatgcatgtttagattaagtgttatgaaaaggacatgctttaaatacctccatcccccgtgttcagtgtgatagacctttagcaaataaacaccgccagggtgtttttggttcatgggtattaatggcttcgttgacagttgttacagttgccgttttctgtattcagctctgctatctctgaataaaaattagatgcctttagtacttaaacatcacttatttagaataatatgaagaggtgagagagactaatataaaaatgtttatagattaaaccttttagctattgaaaggaaggaagtattttttttactgaatatattcccctcacatgatttccccctactcttttggataaggacatgaagaaatgatttcttatatgaagtctgtatctggtcttttcttctacatgcattttattccttctgttttgacagagcaaacaactgtgattgtaaatagaaatc

SEQ ID NO: 121019 - DNA, 1867 bp, Homo sapiens
catcagtggttaaattgtaagttacatttttttgttgtgtaggcttcatttcttataaatggtagttagcagtgtaattgtgatctaatatcagcatcatcactgattgaaaagctatttggaaagcttctttgtattatttatatataaatacttaggtttcttacttagtatgaaaatcttctcatttgaggtgggtaaactctttttgccgcaaatggcaagaacattttgtgcttttttaaatggtagaaaatttttttctccctaaatctcatttactttgttgaggtactaactttcatgacagcaaataaatgtgtcacacagtgagtggtgccataaagtacagtaatttttatttctgtgttgaattggtcttatgaattttaaagggaaaaatacagaaagagccactcctgttcttttggagatttatttgggtcgtttatgagcaaccattaaaaacatgtggttctctttgttcagttcagtaccaggaactgaaatcttccgttgaactatttttgttgaaggattggtgattttggagaatattcataaagcagtctgaagtcatttttcttttcttgactcttggataacttactttattgtttacccagctagttacttttaaagaatacttaatcaagtcctttaatttggtaaactgtgcttatttcaaatgaaagttcatgaaatcttttaaaaaaagaaaagcagctcaaagacttgaataaacaaacccccattttatttgtatccatcactaattcagaactaggtttcttttagcttgttttagtttttgaagacacagttctattggtttgaaatacataaatattttatttcaattgtggtaattctttcatttcagttgattgctaaattataaacattattcaaagtttgttgtggggaaggaactccagttatattgtataaactaaatgctatacttaaattatcctttccactcttaggttcaggagataagcccttctctgtaagcactgtatgccatggctgccagtgtgtttgatttttgctgccatgaactttggaaccgtgaatctaaattatggccctatcactgcctatcaagcaagatgaagtccagctttgtcgtggctggtgtctcctgaatggattaaaaaaaaaaaatgccctgaggtttatattggaggtagtctttgagccattcattactcatgattaatatttgaaacttagcacttaagtgaaaatccttaagatactcatttaaaactaatagaaccatctcagattttatgtagaatgtggtagaggatgtgtgtgtgcaaggagtttgttaaataaatagaatcagaatgcagttacaggtcagaaataagtggaaaagacttctgaattgtaaccaagtccatgtattttattctgctttggaggcagaattgagtttagaaccttgccagacttttgtgtgtaaaataagacagcaagagcaaacacagcaatgacagttaatataaggaaaggaaaagttatgagagcataccatgctgtgtccatttttacatggtggcaaaaagcccagtgtattttaatagctttaaagacactaagatacattgcaggggagtaaagtgattgctatttatagtggtatcccaaattaataagaaaaactttatttcttttcagtgtcatgtttttttaaaagggcgggatggctataattcagtgtaggaaacattttcacaaatggttaaaaataaaagagctttagtacttttatttattcacacattcagtaattattactgcctatctaccacgtactggatactgttctaggtcctggggataacagcaagga

SEQ ID NO: 121020 - DNA, 1554 bp, Homo sapiens
aaaagtgaaatgagaagtctgaatttaggcatgccgttaaatttaatagtatttgaaatagtatctaaactgctgtgttgaggaagtttggctgaaaagtggattttgtcacgttagctgtaaaaatggaaaggctttccttagagatagaaaataggtccagaagtaatactacttctccctgtaatttactggcacagtcaactgtagtcaagaaatattatataacatagacttcttagaagtaaagtaacttaaagaacacagataacacacttaaaatccttctcagtgtacttgtagctcttatgaggacccctgacttgtctgaaggttatatttctgcaaaattggctgcacagtagatctcattttctcagtgattttcattataaagtcagatatttttacacaggaaaaaatttccttaatactttaaagagggaaaacttagggcaaggatttagttagtagacagttctgggtagagtgctatatgttgtcagatatcagcaggtttatgcttatgttgccttgtgtagaggtgggggaagtgacttgtggtacaggagaggaattcacagtactttggaatactctctctttcccaaattctgttctttgctatgacccttataggcactgacagatttcgtagttgtctctggtaagaactttatgagctggaacagacatcctgatacaaccaggttgcttctgttatgcctcaacatgaattgaatttgttttatgcagtttacgtatttcacttcctaatgtatgcagatgtacagtgctcttgtattgctttgttcatgtattactgtccttataaaggtttttagtaaggttttgccttcctggttagcatgcttttcagggatgcaatctgatggttgctaactcatagatgcaaacaataattactttcttggacctgcgtctcatcagagtagagaaggttcactgataaaaatgctggtaattggtatagagattaaaggagaatcactcatagactcctgttgtttgcaaatgttttggtgattgaaccacatcttgactattatatgggatcatattgctgattgatggactgggaagtggagctcccattgactgcctgtttattttgggtatccttaaacctgtttttccagtggtataaggttatattctgggcccccaagcaagagtttcagtgaggggtgctcttaatgtttctgaacctcactgtaacggacttttactgaagacagtattggagacccaaggataatgtgtttattttggaattacttaagcttagtaaccttaacaaacttagcttgaaagtaacagttacactttcataagtcccatacagctcccttttgtaatgacccgaggaaacacttatggttccactgattcatctcctggggaccatcagttttccattggtctctggccagtcttttttagacagtttctcttctatgcatttaaaaaaataacatttctaggcgtctttctataaataatacctgtgctttgtagaagttttaaaagaag

SEQ ID NO: 121021 - DNA, 1024 bp, Homo sapiens
ttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactg

SEQ ID NO: 121022 - DNA, 1031 bp, Homo sapiens
aaagagtatttgatgttatctattacaaacctactattgattctaatttttggtaacagtatgtgaacctaaaatgtttacttatatgtgtttgcagcttggaataatttgagacatttgttttgattgtctttaatataaaagtagctgaagacaagtttaatattattggtgttaagttactattaaacaaagatgtatgtaagtgcatgtagtgtcatggaaagaatttatacatagtctcataaaattgctgaagataatatttacaaaaaacctttttttcctaaaatacaatgttgtatttattagccacttaattattttgctcaacaacaaaaaagtcttaatatatctcataatttgaaatgacttgggcaattatgaatggtaacttttaataactaaatttaatctagagatttttgtattcagactgccaaaacaacttggtaataactcaagaatttataaaagtccaatgttagtattttcaataaaataagaagagactggcatagagttagggaaaatcgggcataaaatgacaagttcctcaagatttatgggctctgggttacatggactacaatgagagttaatactatgtttttttcccattctgccagccggagaagacctcttatttaaagggcagggctccctccactgttgttaaatcagggctctgcttctgacaggatatttataacatagggcaagtatacaaaagaaaaatgtttaatgatgagttttgcatgttatacagtgctatatatcatatggtttaatttaggtcctctgaaatatcagagttagaatgaaattatcaaaaggagaaaagtcacatggcatggtgcaaacaagatgtgcctatttgtatttatgtttgctaatgaaattcagccatgattcccactttgattttaagagtcttagaccaccatttggctttattcattataattaaatatcttgcccacacgcagacacaagggcagcaaagaaaggggcatattttatcttttaaa

SEQ ID NO: 121023 - DNA, 1033 bp, Homo sapiens
tttattttcatttttggcctgattttctagcattgaagaaaccatgtctaatgatcttgagtattcctaaagaaaaagaaattatattttacataatggtttacatgtgtgagttccctctggcagaagcactataattagtgtgtcgtctctgagggaagagactagctgtcttaaagatgcagtggccacatttgactgcaggagctgagtgcagaacattatgattttgttgaaagataaacaccatcccttttcacttattcattcactctccttcctgcttctttggcaagggaagcaaaggacaactgagtacaagcggttttcttcctttcttattcagcaaaccatggagaaatatcttggcttcttgacattaataagtgcttcaactatatttggaaccatttgggcagcttttcaaaaatgaaaaaggtacaataaaagaggaccgaacttcctgttttactcataaagtagcagattcagcaaaggcttactctcctctgggaacagtcatattcttccctggagactggagattgtagaatattatttccttgcacagctttcattgaaactattaaaagacagcttgaggaggcataatggcagacagtatgaagcttttcagtattgttactaaacgagaataatggtagtgtaaatgcttgactgcctctgaagtagtcaaaagtgtctctgattgtcagggtggtggggtgggacctaaaggctgtcctagaaccgaaacagaaaaagaatgtgagcgcatatataatggttttgtgtaagatgtatggatgtatctgttgtctatctgcattatcgtctacacaccatctttgtgtagtctttgctgtatattaattcttgattccctgcaatatttgaagaaactggaattgaccaagaatcaaatacggcacatttcagaccagtacctatggctgcacagaagtagtgaaaagatatgaagaaaccattctatgaataaagatgacagtttcattaggagagcaaataagaa

SEQ ID NO: 121024 - DNA, 1055 bp, Homo sapiens
tgtttttttaaaacatagaaattaacaactctcccacttttctaccctagaggaattttatacatataagtgaaatatatgaaaattacttacaggaaagcaaaatagtaaggagatgtgtttaaaaagcacaggaataagaaccagaagacctggtttgacgtctgcagttaaccaattttgttgtgatgcctcttagttactgttagagcctagactggatgatctcagaatctgttccatcactaaccagattattgattttgtttcatctcacaacaaccctgtggaataagtgttcctgtctttgagcaagttacttaacctctctgtaactcagtttctttatgtagaaaatgtgaccaataatagtgccttctcttggggatgttaagaattcaatgaattaaaatatgtgaggtccttagaacattacttgcgatgtatttaggaccctaagtgttaataatgatgatgatgattttgcagatgaggaagctgaaattcatgacagttacttaagttttctgaggttacttagagcttatacagctggaacttgaattcaaggcttatgaattccatcaaaccacattatttgcacatatttatttcaaacctcgttacctggttttgaaatactaattgactagcacagcatctacacagctggacccctaatcacactctcccagcgttttttataggttgtgttacagaaaaaagcatggaatgagaagttgtaatgttgtttgtccccaggcctctgaatgcccatgggacatatacaatccctccttcaaaagtaagaagtcttacagggcatcactacctaggaaggtagaagagaattctgcttttttccccaagcactatttgtgaccgcttcactttttttaccctactttagttatgtctacacgtttcttacttatttggataaagagaatgaacttcattttacattatacagcctattaaagcagtaaaataattgtttgcttttgaaatcggctctttgttctccaattctccaatcttttccactaattgtg

SEQ ID NO: 121025 - DNA, 1067 bp, Homo sapiens
tttgaaataatatgttcagtgggtagttatgtactaccctaaccatactgggaaaagtatgaagctgagctcctagcaccatgctggaactataattggagctaataaatgcctgtttaattgacctttgcactctgcacctcattcagcactgaggagcaaagctccacataaccaacaagaaagaactttgctgtcaattttaagcctctgaggattatcttttaacttcactgataaaactctttaatcattttgcaaaagtggcttttaggtgactaggtaatatgtataaaacatttaatcttcatggttacttttatcacagaagtccattctgtctacctatttgttcctgacagcaattttttaaaaaaatgtattcaaaggagcaatgcctaactattaggttctggatagaatattattataatagaatattattctttgtaatggtacttgatgaaggcagattttactcatgtgactattttatgagctattaaatggaaaatatttaatgaggactcaagttgatagttgataaacatttgttatgaaaatcacaagttacacatgaaactatatgataggggtggcactgaatcatcactatccatttaggaagcttttgtctgaaaaattttagataccaaaaataaccacttggaaaacaaaatttgaagaaccccaagtagcagaataatatggacagtaagacgcatctatttgttagatgaatgtgtgttctcatagacacaacctaatttttctgataaaagtgcttttgttagtgggatgcttttgtagagttgcagacacatttttattatacatttttatgtgtagtcatcaattaagaaaagagtctagacgtcttgttttcaaatttggaagttatgttctcttcttggataacaaattcacatgcagccatgaaattcatcaggttcccatgcagactgtagttgtctacattcttaatgaggagcccttctctcatcctgttaagaaattcccaacataaaatattttgtgctatatggctaaataaaaaagctagacag

SEQ ID NO: 121026 - DNA, 1050 bp, Homo sapiens
agacttcagagagaatagagtgtaaatgtttcttatcagacttaaggtctgtgttgatgttaatgctggagggtataatgtggcatgtccaacccccacttcccatcatggcatgaactagtctttcaggttaaattttagaatgcactggccaaggagaaagtccattcagatggttggggggccttagaactttacttttggtttatggtaactagtatgatctttggtttattctcttagtctatttcagcagaaccgtaaattattcaagacagatgagaatgtatacagtttccagaaatttcctaagaatttaattgtgaaatcttggtcgccaggttatcttagcatctgatagttacatacttttcttcaaacctaagttgaaagtgtttctttctccccagtggaaagaaaaatgtgtaatgttatatgaacaaactctctgaggcccttccaaattttggtagcagtatttctcatgcattcagttgggagaattttgccactctctttacttttatcccaagatggcttcttagcactcatactttctttagaggtaaggtaaggagaaagaattggatgttcagatttagatagatatgtgcccagggaattcctggtgatacagggcatggtagtaagagtccagatctcatctctttcttacttccttgactttgtttgaactgttttctccttttggatctagtcctaagctttgacccacttgctccaagatacatcgtatttcctgatctgatccacacctggtgaggacctgtatcctcaggtagaccaaaggactgcgtcttaatcatcttgggttcctctctcagcaaaggacaatacttttgtttatttgtagctcaacataaaagattgatgaatggatggacaagtgtacagaacgatggtctgaagagacaacagccacctgatagagtccaattttaatctccctaatcagttttaggcccctcaaacttaatgtgccttatataaatgtacacttcattacctatgattaatttgcatatgggt

SEQ ID NO: 121027 - DNA, 1037 bp, Homo sapiens
aaaactttactaacttgtgagtttcatgatgtttcttggagaaaaccaggtggcttagcagttacttaaaatgttggctatttgtgggagtggtttcaaggggattcatatttctaaagagagatcttagctaattcctaagaccttttggcaaaatgatgcatcattttgaactaattttctagagatacattggtcatttaacttaatgtcacaggttaccagctgtatcactagattacccccaatgaatttacttagagtgaatttgctaatgaggaagccaatattgtgctgatagagcatggcattaccgatagaaattttaaagtaggttttaagtactcaaatatctcacttaagccagctttgcaaagaactggtttttttctatataatatatgatgatagaggagtatttttaaatttccatgattgtactggaaatggtgtggaagtatttaaaatacttggattacacagctctcagtatcgtagttcacaaactattgtaagcaaggatagaacttctaggctgcttggctgtggtcccacctagcctggaggtatttattctaaaagactcatgaggcttcatttatactcctgaaaatttatgtggtgctccctgtgctctaccaaggtgaaagctgtctcaagagtctgtcagtcatatttgcatgtttagacagtcatggcactgacatgctgttcagagacgcagcatatgtagggctgctgctaatagaaaatcactaccagagatgtaagcactgtttccattaatatgtcagtttgacttttaaaaacatatatgtacacacatgtatgatcttttagatagaatgtacatatattgtacgtatatgtgtgtaaacatgtatatgtatgtgtatacagtctcaaatacagtctcatttaaaatgattatcctaaatgaaccaaaaatttaatgaacactattttacgtaaatgaccagttaacattctactgtctttgatggtttttcaagggcttttgagtcagacaacttgcc

SEQ ID NO: 121028 - DNA, 1037 bp, Homo sapiens
ggacagcacttgatttttgagtatggacaagaatccgtatctgtacaactgaactacatgtgaccattattaacatccacatgtgtcctgagatccttatagctttgatacctgcatttattcaataagcatgtgccaaacattgtgttagaaatatattgggagggaggtatggtgtatggagataagaaaccagttatccaaatatagcaaaggaggtgaataaataagcagtgccatgtgactgatgttgtaactaaaagagggacagtcccttagatacggcgaaaggatggcacaatctgcctgaggaagtgaaggaaaacttttagggtgtttaatatttgactttataaaacagaggggaagggaatgaatagtgattttgaaaagacaatacaagcacacagaggagcaggaataaaatgaaaaataaaatagatgtatgaaagtagcatggctgttcaggcaaagatgaggaactggatctggagtacgttgagatgagatgaagcatcaaagataaagtgatgccattttgagaaggacttttaattgcgagccagtttacccagactttatgatttagggcagcagttagcaaactgttctgccaaaatacattatggatttcccacaaataatagtgttttctctagttatacaaatttttgtctcttaaatttctttttccttttctgtcttttttttttttttttttgaaagaaacaaggtcccattctatcacccaggctgtgatgcagtagtgcagtaatagctcactgcagcctccatctcccaggctcaagtgatcctcgtacctcaggctcccaagtagttatgcaccaccatgcctggctaattttttaaaactttttggagagatggggtctcactctcttgcccggactggtctctaactcctggcctcaagcaatcctcctgccttggcctcccaaagtgctgggattacagatgtgagccaccacacccagtgggaaattttcttttaaacaacagacatagtcattaaggag

SEQ ID NO: 121029 - DNA, 1766 bp, Homo sapiens
atatacacatctataatttcttaagtttgtattcacactctcatcgcaaataatccttatcttttttgtatctttttgtgcttgcaaacctgccttttacagatgcggcaaattaaaacagaaagttgttggtttcgtttttgttttgtcctgagatacctagaaaattagaaaccaagttgaaatggtcttatgacaatcccaggtatgataaataaatgtatcataatttaacatttttcattttaagttgatgaccctcaagttatttcagaaatgtgccaaagaagctcctaagaaacgtttataataataaatgttaaaatgttttttttaaaaaaataacttcctgtggttctttcagtaagctttcatgacactttttatctgcaggcaagtggctgtattctcctgtgtcttgacatgcaggcttaggtgaaatattgtgggcataaaaattgcgtttggtaggtctgctagaaaggggtcatgtaaaagtcatctttgatttgttaatggaattcttttttagatgtagtatatggcagtagtgatgtgcatcctaagggaaaaaccggtctcttttgtaaaggtttattttcatatttatacactgtagttctgttgcgtgtttttgatttagtaacaatttatgtgtttttctgtcgcagagcactgcagcctgtggtgttgaggctcacagcgatgccatccagccctgccacatcagagaggccattcgacgctacagccacaggattggcccactttccccattcacagtacgtaataacagagttataaaaagttatatttataatatgaaagaattttgattttcaagtggtcaaatgaagaagcaatggaattgttgaaagcaatttgtggtgactgtaattttgttgtataaaagtggcataattctcttgggaaatgaaagtcattttcatctctttttggaaggacactttttttctacaaaatattattttctttcaattacaaattaagtttttttgttgaggtttatagtttctatttttcaaagcttaggtttataaaacgttattctcaaattatatgtatctaaatattgctagtagcactttatattttaaaattggttagattggcattaccacttctatcagatatccttctcctaaacatgcttttagttggaagaagaagagatatttctttactggctttgaactaagctgaaatgcagacagccttttacatcttcaaatgatttgaaaacttataatcagggttttgtgttgttttaatggggaattaaagacctgatatttcaacagtctaaagaaagtgtgtgcaggtgtgtgtgttttaattaaatgctcatcttatggccctttaaaaaaaagatcttatttgtgttaagagaaatttcttcaagtcctactctgtttataaggaagtagttcaacagaaagtaaagtttgatatacctaactgaggaaagtcaaatttacttttttgatactctgttttaacaagctaatgaaaatgtatatgtataacattatacataaacaaatgagaaaataaatagtattacatagtatacatttttacctgagtggattttactattcataaaagtcatgattttgtctatattatcttttttccttatgtttagttaaatagaatgctttctttccatcctttattttttttagttgttgttaattatgtagatagattctctgtgtaacaggaagaacatgttttataaa

SEQ ID NO: 121030 - DNA, 1033 bp, Homo sapiens
tctattctgtccctttggggatttcctttctcattccgcacctactgtgattgcgcgaactctggcatctcgtttatcaaggatctaagattatatgttagccactcctctacccactggatgctgcccttaggctaaaactgtaaagacaggaaatccacccactgacattcccttctaaaagtacatactaccgtttccagtttcagtctggttttgatcagtctacagtgctttcatatacttggtttttttttttattacctattcaaagtttgtaagaatttcagctattgtactctgcaactcattcagtagctaaaactatggtaacaaaatcttacctaaaagacctcttcagttaatttgattcacaaagtatgtgagaaggagttgtaattaacctagtgatatgtatacataaattaattttttatgtttttagaaattctttacatttttctccgtatatttaaacatttcttcccgatcctgttgaaaactattaaattggagttattttacaacaaagttttcctgaggaaagtattatcccagtctatgtctgtattctcttgaatttgaacttagtggcatcagaattaatattgttccacttcagaggctttaattatttttctactcatttatacacttctttctatattcagacttttgctatattttgagttttactcactggaaacctcagctatgatgctataatggttcaagtaatcctgcatataataataaaatctctacactcactacgtgtattacaagccaagaaatttgatgtatagttatatctgtaatactattgttgtagccttggacatgtcccgtattttcactctttcatctataaaattgtgtaggagttggaaacatttagaatagaccattcttatgtcccatccagagataataatgtatgaatccttgaatttagtgaacctctattattttttccttaaacacctttctggttttaattaaagaaaacctttttcagtcacctataagaaaa

SEQ ID NO: 121031 - DNA, 1103 bp, Homo sapiens
agagaatatttttgaaaaatattagcaatagtttctgtatgtttcttttttcatcacaggttctttcttgcaagattttctttctatatgagtaaattaaggttacatcagacaagaacatcttctgacttcttgttgtaacatgagcggtagccaatggtaaatctgacagtgtgagaagtattaaacattaaatgctttaatatactatgtcatatagcataggtgtaaaataaaagacccaaatacgtaagagagttgttgaaaacaaccattgtgttgccttataactgagagttaaaacttggatttcttggggccagaatatctagacattaattatgcattttatgtgcattattttttgtgtacaattctgagtatacttttttaattttgtgatagtaatgtgcagtattaaaacactttaaaaattaaaatttctgcacttgttttttttaaatggccagccaaaaaagcttccaaatttcgagactggttggactgcagcagtatggagataaaacccaatgttgtcgcaatggaaatcttagcatatttagcgtatgaaactgtggcacaggtaagaattctaatctgtcatatcgggccacactggctggtttttctttatctctgcccatgatcaattcttcttctccctgctgctctaccagtaataacagccatgaattctctcctgtggcatttacatcattttctaaaatttagttcagttatgtgtctctgcatcctcaattcaagtggatgctaggataaaaaagagttcttgtacctttatcttaatgagaaatggaatccctgcatgctttttcttgacattgaactcaaatccacatctgccttgtttagagattatttttgagctttgaaaaacacctttctacgtatgtgagaatttaggagtacttaccaaattctgggtctggaatctcgccctctaaaagactttctcaagatgtggtctttagaccacaggcatcagcatctccttggttcttgtttaaaatgcaaattctggccaggcgcggtggctcttgcctgtaatcccaacactttgggaggccgaggtgggtggatca

SEQ ID NO: 121032 - DNA, 1050 bp, Homo sapiens
tctggaaatatttcttgtgagtctgctaatgccaggcagtattctaggtgctagggatacagttggagatatatggtccttgtccctgcattctcggtggttacaatctagcaaggaagctaattctgttatgtggatagatccaactgaatattaataatgatcctttccctcacttttaaaatcaactgtttagagcacagtcacaaaatatctgtttctgtcctaaagatctgtcaaggagataagtgattaatgtacatctcattgatcttgccaaattgctgcctgttaactttaactttagaagtattccacagatgttaaacaagtgtttgtgagctatcgcagcatactagttagatggaatgttgcatgtcagaaagtatttggaagatttgttacgttggggagatagctttaagggggattatcataattctgccatatttgacagctttgggtatatgcttcgatagcaggacttaatgttttccatgatttatttaaaagagaactcttctgtatgtggaatcctgaagattctatatagaaggatcaaaatatcatgctttgagttactattaagtgttttatagacccgtggggccagattaatcaaaagaataatcagtggattataaagaaaatcttacagatttcataaaatcttcactatcaatctttccctctaggttactagttaaatgaataatgtctaatgaagtccctatatcaaattagactgcttagcactgtggcagtgtagagatatttaactaaaggttacatacgcgcttggttctgtatatgcttggtactattacacatgcagagacataaggcatggtcttctcccacaaaaatttgtaatatggcttaagaaattataagcatttgtgaaagaatatctgatggtatcagtgttcaataaatggctagagtagggaagtatacctttggcctgtatgatcaagattcatatgaatgaagaagagtgatggcagagcattccatggaaggaaaggagtaggagtagacacacagagg

SEQ ID NO: 121033 - DNA, 1052 bp, Homo sapiens
tcctattttccctaatccagatcagaatatattatctgatattcacaagtatcttttgttatggggacatgatattttctatctggatttggtaggaaagcattggaataatgattgctatttatttccacctttcctacatcaagggaagtaaaacagagtcatttatttgggtaaagatagacatcagcactgcacactgtgaacactcgtgtccactgttggtgatgcatgatgcaggccttaccgggctgctgtttttagtcttgcctaaacggatatttgactgccacatggtgattatactgttcaattaagttttttatagaatcactcaatattttctgtctcaagtaatttcagtttgttctttttaaaatgagatccttctcttttaaaaaatacttttcaagggttttcttagagatcagtcttctagcttgtttgtaaaacaccttggcaaagatgaattttaaaatatcattgaatttaagaacaccacaagatttgccactaatttacatttaatgtttatagttctcaaattgtggttgttgtaataaccaaaatatttttgccttgaatattttgtggattatatttccctattctttctccttacccacattccccacagtaggtgggcagatggttgttacatagtttggcctttatttatctttattggtttaatctcaccaagttagtgtttctaaatatgaaaacaagtgtattctctggcaagatttttgtctttttaatgtttcagtttatttagtggaattaacagatcattatttgtttggtatagataatttcccccatttctttatgtgcatccatgctgaggagctgcctttagtttaattcttattgttgccactactttatagaaaatgtgcaaatcaagctgtttaatgtaattcgatttttttctatatcattgtgttcctcatttagaattaataattttggattaacgcttgaacccacaaggcggaggttgcagtgagctgaggtcgtgtcactgtactccagcgtaggcaacagag

SEQ ID NO: 121034 - DNA, 1797 bp, Homo sapiens
aactgtgatctaaaggcagtgttcttttaggtatcaattactttagaaatgtgtggttatcttggtttggtacaactgcaaataattttagttcaactttgccttgggccaaaaacatgctaagttgtccaaagcagatgataaacatgtatttctgatgtcatcattgcccaaacaggatatggttgtttagtggcatggtttcacttatgatgcattacacaaagagcaaatattgtttatgctttattttttaaatatttttatattataaaaatggccactgagaaaggttcattaaggaataaagcataatacataaagcattagtaaaattgaacaggtaacttttcaattttgatgggaagatcttggctagccaaacctgttacctaaaagggcattccacaatcaagaagagaagaaatggaacattttgtagctctataatagcaggctactgtagacctagaaaactgggggtcagcagggtactaaagtcaataaaatatctggagatgcagggtagaaaaagcttgggtacttatgcagtctgtacacttcttctttatagttatgtattacatactggtaaccaggataataaaatatcagaagttgataaaactagttacagtgaaaatcttcatatgtacaaataaacatgagactggcaacttcgttaagctttgtatcataacaaaaatcttctctggccaacataacagagtagcttttatattctactcatccaaataacagtttaactgaaaaaaatatgctgggcttgtagacataacttaactgtagacagtagaaagtggaactgttaagagcataggccttgcctgcttctaatttgataggttatagtttcaagagttaaccacaactgtggcagttcatatgaaaccactttggactcagagactgcaatctcttgcttttaaagttcagtagaataatcagtcctggcatcattcaatgacttaactttcctccaagcatcacttatggttgcagaaactttgtttactaccttctcccctagcatgtatgaaaatggtatagacctaccaacaggcttaattttagttttctttcttctttatagatataaaaactcacttggtattctagcttcttctcaaaacattgagcaaacatacaaaaaacagcctgagttctttcctattgttttcagctgatgtatgtgtgcttggctttagtttcatccataatttacttcattactattagtttatgtgacttgaaatataaaaaaatctgaatttttacatccattttgccttactagttcatcatcgtgatagttagctaactcttacacatttatttttctctagcaccagattctagcacttgggcatacctatagtagagatccatgatctcagaacatccttttaaatgatcaaataaagattaaataatgctcagagttgctttagtgtatttgagggactgagaaagaagagcagggaaatacatacaactatagcttccctccaaccccacccacctccatcctaaaataaggcaggtgtgtctaagtgtagctaatgtttctttcattctaattttttcatctaatcaaatattgtcaaccaaagaccaaaatacagtcactgaaagcttcaaatagctttgagttttcttgtcagtgaggaactgtggtcacccacagaagagctgtgcctaagaacctgctttgctgcttgtagaggaacctgagaagctcaagtttgtcaataatcaagtaaactatctagtctt

SEQ ID NO: 121035 - DNA, 1009 bp, Homo sapiens
gagctgtattttctaacgttaatgttaccagttctgctttcttagcttgtatttgcctagcatatccttactcatcattttttgtattgtcatttcatttcagaggtgtttgttataaatactatataacagtattctttttccaaatctgagcacaccactctctcctttttataagggatttaattagccctttcacacttactttgataattgatcatttggttctattctttcattctaatttgtgacatgaaaaattatttaattctgtatgacttatacttttattttgaatgcaagaattttttaaaagattattttcagagaatcccaattctgaatttggtatactatatttaatacatgtaataattagtgctgatgtaaacctattgagaacatttctttttttctttcccttgacttcatgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggaggtatagtacattcttccctttttacagaaatagaacaatcattgcagtgcctatgctgtttggtcctattctcatgttctttaaatgttgtctgaaatctctaagtcagtggttttatgtctgatggcagcgatgtgcagaggatcagcccctgaagtgggagtcagatctgccttcagcatcaactttgggaaacaacttctgttttctgtttccttatttcccgttttgaaaatgattaggtttccctactctggatctgacatttactgattttattttatgaagctaatttctaattaaatatttacctttcttgtttcaaatcatccagttttatttgtaaacaaaactaattcttactgcttttatgttggcatatatagtgtgaagagctattcttctggctatagttgcaggctctgattggact

SEQ ID NO: 121036 - DNA, 1705 bp, Homo sapiens
cttccttagaatgtaactgtatgagtgttgcgtaattgtaccattttatcctgatgtgaatgaatctcccaggaatatcctgattttggttttagtgaccagagctaaacattttctcagcctaccaagttattagtggaatctcttttccttttctatatacattgctgtcttaacttctccctagccaaaaatgagccatccctaagcaatacttatgcaggtatagtgttttatagttctctatttgtctttactacattatttcatttaatctttacaatgatctgtaagtgtaataaaatctgtactttgtcaccttcctgagccctttttaataacctgatagtgaaatatggaactgacatctgagcttagggaaacccgacttttcatttcattttacatatactgcatctaatttgataaatactgtatacaacatgtattggttttcctatgcaagcaatctttggatacagaatttgaataagggctactttctctgacaaactgagggagaagtatatacaaattatctctgttcatcatatgatgaaagcatagggcagatgagaaatggatagagaccaatgtcttttacatattaattagcaattgcattgctataatcccattttgcaactgtctttggctttcaaatacacctggaactattgaatagaatactaaagtaattatatcacctgctgatttgtgtaccatggtaaacatggtaagataagtcattactgctaaataagaacccaaccccatacttcctttcatgcacttgcagctagttgagctggttgctatttccactggtatgactaagtgagtttcccttagagcattgactcccatctgcaccttaccaagttgcgccattctttcttatggttcctctttattttttctcttattgatgtaagtgcttaattatggaaccaaaactatacccagggttaaacactagaatcagaaaagccaaaaggatctttggagcttatttgatattcacctctctttagttctcacttgaagaacctgaggaccaaaaagatcagctattctgttaaaaaccgtaacaacaaaactaatgtgtgcattgtatttcattttgaggtaattttacatgagaaattattagagaaacaattcgttctctatcaaaaaagcccacattatttttcccttgaagtttggatgaaagttagcttacattttacaagaaagtgattctagtgatgtacagacatgtttggtatgtatctatgtatgcacacacaaatatgtattataattaaggataaaaatatcacacatatatacaaatacatttatccacaaattatttacatcctaaattttttaatgggaaaatgtcattaatacttaataataatttgataataacctttaatctttgtgagtactaaaagttataaacttttttatgagttcttcacaatttaatttatcttttctaaataaatgtcaataacatttacgtcaggctagctatatgctgcatgatgttacctcactaaaacatgaaatcataggcatttaaaaaatgttatgagacaaagaaagtcaagatggtttgggaaacattttctaagtaatgatttttaaagcttcgactactgtattcgactataacttggaggtaataatctaaagattctggaacactctt

SEQ ID NO: 121037 - DNA, 1030 bp, Homo sapiens
ccagctaaattttgtatttttagtagagacagggtttcaccgtgttggcctggctggtctcgaactcttgacctcgagtgatccaccagccttagcctctcaaattgctggattacatgcccggcccaggagttgtatttttttaaagttaggtgatggaaacagatttgagagcaaaaattaaattctttaatagtacagaaatactgaaatcaatcctagcagtttttttaattccttcaattttgacattttgctattttgttttgattttttgtttaaagcctatcacacgtaccacctcagcaaagtagatttgaaatgtttggacaatacccatccacatattaaaacacttttcttcccaaaggaagtatagtaatttattcttttaggagtgttgtgacttaaatgcgtctttttcttcctgtttcttgatccaatgtaattaaataatagatttgatttcataacttttcaaaagcaataaagaggaaattatgttcagcagatttgtttattttttttctgtgcccttccaaagtttaaatggtatcctttttccttgcactaacgggaagtgaaatagctctttcaaatcaatgtccttgagaaatgaatgttaatttaaaaatacaccttaaagaacagaaacataatttttccctggaaatatctgatgattaaatctagttacatgctactttgaaataataccaagattttaataactattcagttatttaaaaatcagtgccatgcaatatatacacccagtaaagtataatttaatgaattgccaaattagtccttatcaagttttagtttttataccaaggtataatacacctttaaactttgtcaaaatcatttccttcaaattgtgtatgtgtattttatgtgctgtattcacttgccttgtttatattgaaaaatagttttctcctaatgttattaaaaaaaattacagaattaaagaagtcctaatacttcaaacagtataacaaccagaggagtctttcctgtttac

SEQ ID NO: 121038 - DNA, 1149 bp, Homo sapiens
aggttttgttttgttattgctttaaatttagctaaataagagtgtctgagtcaaaggtgtctaattacattgacagtcatccactgagaaacgcagtcaatacaaaatgctactgtttgtatgactggattttttgcaaagctactgaaaggtagtcatgccataatctggaaattgtatttagcacattcctataaaacctttcaatgtaacttggtatagctatgtatctgcaacagtccttagctcttgtcacctgataaacaagtttcatgcttttctttaattttaatttaaatttcagaatgaatatcacaacataaataaattacagcaatctcatttttaaatgggctttttaaaaactcataactacttaatgacatagtctttccaccagttaattatcccatttcagaaaatatattccgaatcttctatcaccgactctcttcaaaagagctttttgtgcacctccttgtaactaaatatatcattctatcagacaatactgccaaatacctaggtgattccctctgatttctcaaaagattttattgtctggctcattgtgcttttgtctataatactcctgttacaattcttgatcatttcagtagccatgtgcatgatccttctagtatcctggactttcagtttttcattttctctccaatggcactgtcctccaatttatttcagccattaattccatgattgtaccctagaccttgttgtttacaatgactgcaactcctgtgtaacttcaatttagagtattctactctccaatcaccacctcccattgtctgtcacctaatttaaaggtttatgctcaatagttataattactcctttgcatatgtacttagtacccttggcctcatttcatttgtcttattcagctggcaatactcaacactggttaaattctgctctttagcagcttttaaactgtaccaatgcagctgaatattgctagagataaatacaacatgcttacagtaattcctgaccactaactttagagttttaatgagttgttaatactgtcctgtgatatatgtataaatacatatatttaataaatatatatacatacatacatttgataaatatatatttaataaatatgtattatacataaat

SEQ ID NO: 121039 - DNA, 1093 bp, Homo sapiens
ggaacctttagataatatattttagcaactctcagaatctctgtcacctctagggatgttgtttctcatattcttgtttatttagtgaaattactaattccataaaatctgtctgcctttctgtatataaccactgaagtctctgctcaagtttttttctaaatttaatttaataattttttttaatttaatagttgctattatgcttaaacatggctttttagtgattacccctggggcagcaagttttaatggtcagccagtgattaaaagttttcttatgggttcaaacattttgaacccataaggcttccacttttgctgagaaatctgtatgtatattagggcacacattcaaagttcaggcagtttacaagtctgcctgtggtttcacttcatagtctgctcagggtgtacaggatctcgtggtctacaattgataagtaggcagctgaggacttttctggtctttcctaagcatgcatgtaacctggtgcatgtgtaatctgttcagattctcaggaatatattggaacttttcaaagcccccaatggctacatagtggcagaaaagatttatcttttcctcacttattgcaaggttcatggctgagatatttgtattaaaagatagactaacaaaggaaaagcatacacatttatttcatataaattttacatgacacaggagccttcagaaattaaaacctaaagaaactggaaaaactatttttatgctacattaaatgaagagtggacatttgtgcagaagtctgattggataaagagagatatgatctaatagtaataaactggagagatttcagcaagacctttttgttcagtcttctctgtatccctgtgcgacattccttgcctctgtgtgtggggtacatgagggccttaagacctacttcagagaaaggccagagaattcttttgtggcctgcttcaggggagaagggtaggagaaggtaagagagaccttcctactacagcttacaggggggagaagatttctcagtcattgcaaggttcatgactgagacccctataacaaaagacagattaacaatagaaaggcatgcaaatt

SEQ ID NO: 121040 - DNA, 1046 bp, Homo sapiens
gtgtagatttataatttttattatttcaactttttcaaatgttatttgtgttactttgtaaattactttctaagatgaatgtaataacttttcccaacagtattacaacaactttattatggactgaattgaaataattcacctaaaagaggcatctgtatcctttgccatatcagacgccagtgtaaatactagataaggtgtatattcatataaaaatttgtttactttgtgtttaaaagtgaattgatactggataatgtctaatatcaagaaaatttggatattaaataacactaattttaatagtgtgtgttttagtgtgtaagtgttcatataacacatcacccaatttaatacctttcaattagaatttgagtctttgccaaaaaaaaaaaaaaaaaaaaacagcttatggataaaaaactggctgtaccacaattgattttggggtgtaactctgaatttacagctcagaacaatggtatcattttcaaagatatcatgactagaattatgttattcataagtatcacataaaatattagtctgatattgatatatatagtcataatggattttagaactatacacatattgcaaaagcttataataaagattatcaatctacattgtaagaaattgtttttaaaagcataaacaatccctaatttctttttttgtttgtttcttcaacttttattttaagttccggtgtacatgtgcaggacgtgcaggtttgttacataggtaaacttgtgccatggtggtttgctgcacagatcaacccatcagctaggtattaagcccagcatgcattagctattcttcctgatgctctccctctccctgccccctctaaaaggccccatgtgttgttccccacagtgtttctacgtgttctcatcgtttggctcccacttataaatgagaacatgcagtttttggttagctcttcctacattagtttgctgaggataacggcttgcagctccatctatgtccctgcaaaggacatgatcttattcctttttatggcagcatag

SEQ ID NO: 121041 - DNA, 1054 bp, Homo sapiens
gagaaatttatgatagagttgtgtagcaagtacacatttataatttatttaaaacaggatctctgactgttcagaaactatgtagatgaattgtgagttatgggtgaatctacatggttcttgctggcctccatgactgaagaaagcttgatgtttagatattgggtgaggctattgatggctctagatccaaggatgacaacctgtctctccgtaaaccctttctctgggatgactattttgatctgtgcctgagataactgatcatgctaattgattttgaagcctagaggcctaattaggcagccaattaagtaatttcgaatagtgacttcatgataagtaatttgagccagttacgttcaggtgtgcccagtaacaatctttcacctctgtagaggtggaatcaatgtcattgaatcccatattgcatcattggaaaatgggtctgctgcattgacagtaagttaagtacagcttgatcaaatctggtcagttcaataggatattgtgcttgaagagcagaggcttgacaacctacgaagaaaggtgactggagaactgaacatcttggtcatccccttcagtggggaggagagaatgggaatgtagggactggattctaacacaactgcataggtcatcctgacatactacattatggattttagaatgcagcagtgatgaacactcagtcaaattgaaatgtgtcttccttgccattggatttgagtccttttgctctgatttttttgatcttgtaaccacactttctgatgagatagccccactgaccagcaaggaccacctacctcagggtgactagtagtagtggagtgtcttgttttcccattacctacatattcttggtaacagatgctatagaatgtgttcatatcaggatatgacctctggttctgcaccatcatagtataaaataggtgagtgagtagggtgggcaataggaatatttctggaagccattcctatactctgacagctagcgataaccatacaaggaagtggctgggtatgtctcaccccaaatcaaagg

SEQ ID NO: 121042 - DNA, 1184 bp, Homo sapiens
ttaaaccgtttcataattatctgcaattttataattttgtaaacgttccaaggaaggtatcatcattattaaaagattcttatgacagataatgtctaaatattgcatgatttatttttaatttccaattattgggtatgtcaaaagagttaatagtattgcttttgatgcctgattttgagagctggatttcttattttggaagatattcaaagtgaaaataaaatgaagtcaccttaatattataatggcaaaatatatgatttgtaccattttaagaagttgcttgagtcagtgaaaaacaattgaggtttcctaactttggaaatcacagatgtaaaatgttgattagtcgtgcatattctactactttttaacatgttaacataatttgaaaatgtacattttatgggcttaactagttgcaaattaagcagaacaatataaaactgttaatattttaaaaactaagcataaggtagtttggtaaattttaagaacacacatgttttagttggaacagatgtgaaagacatattattttaaaggaaaatggggtccacagctatctgtttggaaatgtctttcaattacagtggcgtccatgactgttggattagaatgaagatttggctggaagttctctctgtcctattctgtgtttccttttgaataagaaacagcatgtgtgaagtacatttactataatccattccatactgggtaataaaaattctgtgaagaatgattatgcatgttatgaaattattccgattatgtttttttccactttcagctcactagtatttttaagtttatataaattttacagagtgtgttgatatattaatttatttttaaaaatgggaatatggaataactaactctcattatagataatcgcattccattggtggtgtgacttcctgtattttaccaaatgtgaaacagtattcactgaaaaagaaataaaaattttctgagtgagcaataaaccaaccaattagaaatgaattcttgcattttaagttggcaagttgcagtatgagattatttgcatttaccaattcatatgttaaactctaggattacactgaactttaaaaaataagacagttgaaagggtaacttttagttcacattacaaataaaatgaatgattatgttacccgtatcattcactt

SEQ ID NO: 121043 - DNA, 1027 bp, Homo sapiens
accttcagcatgggagtcatggccatcatgaacatgtcacagtgctgcagagattttgtttatggccggttttgaggtcagcttatggccagatttgggggtctgttcccagcacactcctaatctgccttcttctttaagattaactttattttctccagttccttaattctcttgtccagtagaaacccaattttccaccttctcaccatcctagtacgtgagaccctaaattgatttacttaaaaataaatgcgcgtgtgtgtttgtaaagtaaatcaatttagggtcttaggtactgggtacaatttaggtctcaggtacacacacacacatgtatatatcctgtaaatataaagttatcaaatacatatattacatttttctgtttctaaggagctctttccctaataatatttatattagaatctacaaatttaatgccacttgatcctcccagatttcaaaagagaattaatggtgacttttgtgtaaaaatgaagacatatttatgtacagtacagaatggagattgtccttatcagtaatttaaacttttcagttattagaattattcataagtgtttataaggtggggctattttatttaaaatgtggccttataataatgtttatactgatgcagaaaaattcattggaaacatatatatcatttccctttaatttgtaatttcaaatgttttatccatagttttagataaagcatttgtcacttgtatcattggctttctttccagtgttaattttaatttctttccattctctttttctcatctaatttctgtgtcatttttttcctaaatccgaaaaaattctcatgagaggtattttcatgttagacaggttaaggcagaattttgtaaactactggttcattcagctcttaaattttattaagaagcgttttgtatcttgttaaactatttctaggcattttaaggacttgggagtgttaaaattcataaaaatctgttgtaccatggaacagtttctgatcagcagagat

SEQ ID NO: 121044 - DNA, 1470 bp, Homo sapiens
atagaaaatatattgaaaatgaagcgctagaatactgatctttttgtttttatatatttgacagtattcccattggaaatctcaatttctcagaaagcatagcagtgaaaacttgcactaattttacttttaagattaaggaagtcaggaaagaaatgttaaaatattcatatattttaattatattaatattagaaaattataaaagtatacatttttataatattggtataataaagcattgtttaaaatgtaggttttacactttaatagaagcttgaaagcattgaaactaattcctgaagaagtctgtttcttgatgcataggcataatatacgtgttattcagtctttttatgggatgattaaaactttattcagcttaatgaactataaaattgtttgaatatgtttaaaaataagtatttctagttttctaaaactagcttttttagtgaccagtagagatcactctagacttttataaaatgttaattgtttctttttataaaatgctgcattggataattattcatgattcttattaagttattagtattaacaatattaaaacttcttgggaactgggaggtcacaagactttttacttgatgattaatgaatatttcttaggtatttatttataatatgttttaaccatctaaggtgagattacaattttttttctagcttcatagggaaaacagattctatagaaataattggaaaatcagtttttccctattgttatcacaatatccttccactgctgaatgattctggcaggtaagtagtgggaaattgtgttcctatcgcttttcaagagaacaagtttatgggtagaagagagaatgtattagatacaaatagattgtttagagaaagatctggtgcttacctgtcagaaatcaacatgcatgtgaaacttgattggttgctagattgaaagtagagctgcatagttcacttttaggatatttgagaaaacttggaatatggactggattgcgacgatactatggaatatgtattaagttagatgtgataatgctatcatgtttttatagtacaatatccatagtcttaaaagagatatgagctgaattaataaaatttaattaaatacattcataaaataaatacatttgtaaaataaatgtgtcaaaatgttaattggtgaatataagtaaaggatatataggcatttttcagcttaaacagtgaattctgaaaggtaaaccattttatgtttaagtgatacagaaatttgatttcaaatggaaatcatacttgaggaaaattcactcatgtataaataaatttttaaaaatgagtgaatatgagtagcttgggctatacagcaattttagattttagtttatagttttagtctttaaattttattcacagtaaaaaaatggctagttttcacagtttatttatatatggcaaatataaattgaagatggt

SEQ ID NO: 121045 - DNA, 1097 bp, Homo sapiens
gaaattctgaacaacagtgatgatatacaataattcacatctttggactgtatcacattctggggtctgcttcatatttgctgggtggctggattccttctgttttcctttttcttgtcttcttaaacttgtgaatctgtaactcattgtaaaaaaaaaaaaagtttaccttaaggtctggttgcaaactgcttgctaggcttgactataattggctgtcatgaaagtgttagtctgggcattcttttacaaattttaaatcacgtctgtctagtttattatcaatctattagatggcggcctttacaataaagattaaatgtaatgtttcatgtataccattatctcatgcctagtttgaagatcttaaaaaaatgaatgacagggattgtaatatagtttattggatgaatcttagttttctttatgattgtaatattttttgtctttcattgaagtgtattcagtttatatagttctttaagtagtttagacattaatagagtttctgatagcagatcttctataaagtaaaatgcttatgttataatgtagattgttcagtatttgattctatgagcttagaatagagtgggttaacagaagctatgtatttttttgtttctaatggaagctttgaaataaattacaaaatgctgtgtgtagtaaggaataatgcccacagacagagtatgttagtcgtctcgatttgctaattctgattcagaagaaaattggaaacatctttgggaaactatctccttttttgcccctttggacaagtatgtatagaactcattttcttattaggatgattatatatcataggcagtgaattttatatttatgaatagagcttcctgttttcatcagttgggagcgatggagtatttttcaaccaaaattataaaggcgaacagaccaattttctaggcatttttttgccatttatccatgccactctaaatctgcatgttagacttcttcctagtgtgacagtaactaggagtggcataaagtaaatggggtgggcggagacagtgaattacaaaagattatttggaatgtgcagggaggtaagggctagggagacagga

SEQ ID NO: 121046 - DNA, 1100 bp, Homo sapiens
tatcctcacctctataactctagaaaacattttgatcaatgtgagataatttaattttgtatatttcaagtcattactttgaaaattagatacattacagataccaaatgcaaatatatacagaaatttcatttttcaattcttaatgcaacaagatagcataattaggatctttaatatgctatttggaaaagctagcagtttatcaaagaatcatacctttatgtttaacaggttcatatcttacaggattttaaaaatggtaacacttaccccaaaagaagttttgctgacatggtgtcactgtgctgaagaggctgtttgatgccatagtccctcctttttttttcagatagaacttgtaccctctgttgtaaatactgcttgcagccttaaactgaaaatacaaaccatacccaaaccttgttttagttttacagtatgcctggagtacatagactttatatttatttttttctgtcaagaaattatgtagctggtaacatgtgaaaagcaaagaaacaaaacaaaaagagaatgagcaaatatttgaaggacctactattactgcatagactgtggttagagagcactcactgactctgttggtctcggtggctggtagtgacctgcggagattaaccatttaaaaaccagagacttcttgctgtcctcctggagaaagtttgcaccgcacttgtggttctgtggttgtttgtgaggcgaatgaagcattcacacaatccaaaaaagcaaaagctttaaaactccttttttttgcaagcactattactggagaggcagaatcatgtggtttgtgacctcacagtactcttaagtaaagtgggactgcctaccactgtggcttttcccccttgctctttctctctctctctttctctcacaaaaggcttgtggtaaggcctttcctggcatccagaaggatatagctttttaatttttgtgactcatgaggatttggatagaatacaaatgctgaaggagcccaaactcctgtaaggttaagcatttgtagagcagagctctgcagttaagggctttcctttctactccccgctcaacctctgcctttttgcctc

SEQ ID NO: 121047 - DNA, 1532 bp, Homo sapiens
cttttgcatgacttcactattgacttagagttgtcatatcttagtatcctagaacaaaggttagaacagtatggaagattggtatttgtatgctttggagagggatttgagatgttaccctgttttgccgtcaattttcaagtatgcacgggtgcatcattaatcatgagaaatgcaaaaataaataatatagtcccattggatttttttctatgaatacttaccttttccttttttttaaatatatatatacagttgaggtatttaggtaacccctaaccttttgcttcaacaaagaagtacagtataaaaatattaccacagttttcatgtgagcagctcttgaatcggggggagggggaaagccctctagatgaatatttgttgaaaaaaaaagttgtgatacagaatgtcttaactcagcctcagtacagtacttgaggaccaccagtgtgtaaaattgaaagcacatgaattttgaagcactagaaaaggtttgtaattgattagcgctgctttaaagtattggagtacagtgagttttgatttgtgaatggttctattcaataaatattaattctgtgtgtttgataaaatcttagtgccttcaatgagttagctccccccgcccctgcagtttatttaaccatcaaatatttcagtgttcttttaacaaactggaacatttctatcttaccgaatttaactttagcatgactgatttaaacaagtcaaactatcagttgttagctggaagagagtaattgaataaattaatattttgttcttttaagataactaaaatatatcataatgtaatcatgtatatttcatgccttgtgatatagagacggattgatcaggagagtcagacagaccagccagatctttttccacaatttcttttcagtgttttagatttcaaaacattttttaaaaataaaaactaaaaatctttaacagtttgtaatgtaaaattaggattattataatttaaaataatttatatgagtctttgggaattactttgacatttttagcttttgatatgtgttagagtgattttctgtgtttgttcttaactttgtaattctgctccctagttttggaatttagctctgtattttaaaaagaagctataaaactttgtcactactgaatcttgaaactataaatatattattgatatggaccacaattgctgttttggaaatcagtgttcacacatcatgttcaagcagttacaaagattttatgtagataatcagtcagctgatatattttcatgagtcattaattttaagatactctatgagtcacatctgtgattttcagcaagctatatttatgataaatgatggacagattttgagtagtacagattgaaaatttttgattaactcaaagtgaagtatgctgagagatcaaggacacagacatactctttctctagcatgtgcgcgcgcgcgcgcacacacacacacacacacacaccactcattgtatttgaggtgaagcagttgttaatgtgt

SEQ ID NO: 121048 - DNA, 1028 bp, Homo sapiens
tttataactggaaaataacatctttggattttataagattgattattttagtcttgaaattcctagtagatgcctaatccctgttactggttttatagattgacatttgttaacttacatgcaaaaaaattttgattatatttcatgacagaactatagtacctcagttacataatttacaatttttttcctggtttataatcattattacaagttctgtagtcattggtgtgaatgcattcacactcatgcatgtgtatatgccatgtataaaaatgttaagacaaacatagccagaagaaatttaagttgaacatatatgacacgtattttgtttcggtgtaaaaatacatcgtgttcatgtgaagttctgtggaatatcacgttattattctgatatttctaaagaaagactgcatatatatgtattcaaaccttattgatgattgttattgtgatttggctagcatttaactttgtcttttttttttttttttttttgcttttcctgaagcacaaaatagatgtaggtgtaagatacatgactataaggaatatgtaaataatggtatggttcatgtaatttaggggaacctacaaatgtgtatttaagttcttgagttttaacttagtctattatgtaaatatatgtttatagttgatggtatataatgattctggtagacatcattgatgtaaaaaatcgatgtaactgaaatgtaaaataaaattaccttatttgactttgtggtgaaaattatttgccttacataggatatttagatatacctttttagaaatgtcactaatctgatgtaactaatgtataattaagagaattggcaataggaatagtagagataaaagagtctttaaactgtttgccaaaataatcttagatatatttctgggaataatgttaacttggtaaattttctaacatcagtatgataatttttaaatatctcaaacattatcgaaattgcgtatgtatatatgtcagagatttccttgttttgtgggcagtt

SEQ ID NO: 121049 - DNA, 2530 bp, Homo sapiens
tcagctttttatataagcttatatgtgatcatttgaagtaatcagaaatgataccagttttattgtatttttattactgattttagaatttcttgagaagttgcctataattttttttttttatgagagctacatctggaaatgctcaaaagttgtttgccttttttgagagaacaatctgcagtgaaagtataacttctttagaggtgatgtttaagttagcaaatgctgaaccataatgtgaggaagcataatattgtgaattatttggcaaacatacctaatacaggcattagctgttgaaaccatttgtaaagtacaacttacagaaagctagaaagataggctacacagaactttatctgtaaactctgaggatgaaaactagagtacaacttaagtttattcaataaagactaaattctgtaagtttaagtttgatttgtttataggttccatgattaatgtgtaattagagtatgaaagaagcatttagaatcctttaaaatttataggtgataacatcattgtcaagtcaggagttttgtttcttaaagttagaatttacttaaatatactttttctctaaaaaaataaaatcttatttctacttacagtagtaccaaagtgagttttcgcaaaaagaattatttaatatgtatttaatatttgtttcaaataaacaaaaataaacataacaaccaacagtggaggggcgtcttagatttgtttttagctttctttttcatggcttctagaagtgtatcatattataaatacattcaaaatgttttgctctgaggatatgtagcattcctataaaggttaaatcaataaaaatgatttggacacattcctaagcatggctagaacaggtagtccgttgttttaggtacccttgagtttctggagcagatcattatggcgtagcaaaagaacttactaaaagttgctttctatgtgtagatgcatcagcttaaaaaaataagattttctggccttctagaaatgagtatttttagagtaacccttgtatatattgatttaattatatattttaaatgcagttaaagttttggagcttttttttcttcgaatgctggagatacaccataattgataaggaagaggtacgtacaggaaaaatgcaatggcaagcttttccagcaaatttagaataaatgacagtcttatggttaaagaaagtatcacacattataattgcaaaatagggattggatgtgattctttttagtcttgccagtttagaaaaaaattctgtaagtcattggcatgttgttctgttcatatgggcagttcaaaaggcaagctttaatttgagcttttattttagaaagcatatgtatatctcctatgttcggggttggcttctcactatattattgttgctatgtagttttatgcatttgcttgcattttttgtgttcatgtcataagttttaagtatgtaagttttcagatcacactgttttcacagcaagtttcaaaaaatatttttatgccagtttataataatgagtaaggccatttttattaaagtttcctttaaaacagcatttaagatgtttctggatcaaaaaaattaagtgaattgaccatgtatttgaatgaagaaagtttaaaacagaggtagaaaatttgagttacatgtattattaatgaagttatattatagaaaatcacttcctatctttttgtacatctaatatgtatttactttgtaagtaaatactttattaaaaatactgtgttacagtatttcttggagcacaggatttaattttatagtcaagaaaattgtttgaatacgtctgagtaaaaatttattgtacatatatagagtggtttaaccatttaataattaaataatttagcaatttaagccaagtattttgatgttttaaaaaatatttaagtgtatcttgatagattctgattttagtgtgtcttgtgtcttgataggaccagaatatttatgaaaataaaaataagcctaataatcagcacatggctctaaattttcttcctgggtacttgtgagtgataatgttaaaaacagatcactttatgtgttttctctagtcctattggtgtacaaaaatattctgcaatatgcttatgcgtgttataagggagggatattgttaaatctttactacataatcaagaataaagctttcgtgacagtactcattgtccttatctagctaacacttttaaaatgaagtggttactagtggtaaaaagtttttaaaatgttaagttttccttctaaattacagagagagaaataatgtatatgtgtttggttttgaaaactgggagaatagaagaattctgggtggacactggagtttataatatgtgaaaaggagtttcttctgtggaaaggaggttggattaatgatcaaaagttggagtacattgacttgtatatttccatttctttagaaatacactgtagcacattgtctttgtaagtagtatctccataggcattatcttctta

SEQ ID NO: 121050 - DNA, 1030 bp, Homo sapiens
aaagttttggattagattgattatgtacttagaatagctatttgaacctaatagaaaaataagaatattaatgtttttggctatagtcatcttatggaatcctctgtacttcttattttccttattaatatagcttgttaaacacaactttatttttcttattaatattactggttaaacacataaccattgactatcacctctattggaagaaaaggaaggaaagaaaggaactaattttttcttgtgaacaagctttacaaatgtttattggggacacaatttggaattaatatattttggatatgcattttgtctttagcttatttctaggagtattaaaagttggctatctattggctcacaatcttggctaatttatctagggagttttgttttaaaaaagttctgaaggctttctctccacaagctgctcttccccaagacttactccccaggtaattctgttgatcagccagatttggataccactgtaacataagaagtcttgtataggctagtgaattctttaatggaatactctttcaatcccttttttcttaaagccttatagtcaagtaataagattacttagccttatagtcaagcaataaggccataactatcttagtttgcaagatatttatggcaagtatgtcttctttaatgtaaatattcttatttttaatttttcttcttatattaccttatttctatgttttatgtcaccctgcttattacatgtcattttatactcacatgagtgtaaatagtttatacttatgtgtcttcagctcaggactagaatttgtatgaggcaagcaaagtgcctagggcacaaaatttaaggaggctgtctctttgaggactgtgcaagagtgagtacctccttaaattttgtgccctggatgcctcccttgtctcatccagagaaataggctgcatataaattatttttattttagtttagcataatctcatgcatacttggatgttttataaaaaaattgatgacaaaacgaaatagtat

SEQ ID NO: 121051 - DNA, 1043 bp, Homo sapiens
cagctagtcaggcagaggcaagagaattgcttgaacccaggaggtggaggttgcagtgagccgagatcgcaccactgcactttggcctgggcaatagagtgagaccctatctcaagaaaaaaaaaaaaaaagaaatgtttattgaattcctattatatgccaggcatttggctagatgatgtgaaaagaaagtaagagtgggagagagggaattcttgtgtatctgtgctaccaagagagtgtgtagtttagtgtactgtattgtatctctgtgcttaatgaagttgcctgtggggctgctcaggagggcatgcgaggttctagctaccctctcacccttcttcgtttcaaccctgtagactcctttaaaaatctattttatttattgggctttctcatagcatttcctatgaacaatggattttgcaatttaaaaacttcagtatcacctgtctagtagaattatatatatttacatatatacataagtagagtgagaatcttacacacatagaaactgagagaatgacaggtggtagatgcaggtaagtatgtgaaaagagttacagatatgctactataggaatatggaggtggatcagagagttttcaatttggaggatgaaagccagtgaaaatagtgtcgtttgagatttttcttcaaggataggcaatatttagccctgtagagatttgtaggtagggtgacagtgaggataggtagggaatattgcaagtacgggagacagcatgatcaaagacacagaggcagggatgaggcatttggagcaaatagcttactgtgtctagagagaaactgggtcatagaaaatacagataaaacatgattagtatcaaaatgtggcaagctttggcagactgaggagttaagtctttttcaaagacaattggaaacctttgaaaaatgtttgaaagataaaggtacggtgtgcattgatactcattaagaagaattgataatgcatcatgtaaaatgagttggctgtggaaagacctattgtagtagtccatgtaagagggaa

SEQ ID NO: 121052 - DNA, 1078 bp, Homo sapiens
acagatgtcctatagcagaagtcaacaaattatggccatggacttgctgcctgtttttgtaaataattttttactgtaccatacccaggcttattcatctatctgttgtctattgaagccttcatgctctgtgccagagttgagtatttgcgacagagactatatggcctgtaaagctgataatatttactatatggtcttttacagaaaaagtttgataatctctgatctgtaaaagacagttgcctttaagaagaagactacaaaaattaaaaataaaaataaaaaacctatgtacctaccaaaattaaaaataaaatattaaaaaaaccaaactgttcccacaaaaattaaaaattaaattaaaagctgtagagtattatattcttttgttatttatacttaggagagcttctatttagtgcatttgatggaccttgggccattttaaaaaaactgagaaaaaataaaggctaaattcagcactttcttattaaatacttttgcaaacatcttcccaaccaatgtacctaagctgaattcggaatgcaaaagttattgttggctacagctctggaagaaatgtacattttccttctatttcagacctcatagagaggccactcctaatagttacattcatcatttatagtctgaagttattttttttgcccttaggaatttctttatagaacagggaaatagggccaaaattgggagaatccttttaaatttactggtatttctattgttatgagatttttaggcttttgattgtataaaattagactcaatatacatttaattcttgcttatgtatatttcaaatgagaaagtgtggacttattctgctatgtttattttgtgttacagtaatttcattctgtgactccctactgctgctgttcatagttctaagcctgtttatattgctgcttttcagtcctctgctgctgtcttccccaatccattcactattaatgagttgttgttcttttggctccctggtgtctaaataagtaacaatattgtagtgtcatttctggggaatggtttcactgaaagttgtctagttgtc

SEQ ID NO: 121053 - DNA, 1114 bp, Homo sapiens
tacattttgcagactttccaattcatattggaaaactgtggttcctggagatgaagttattttgtgtgaggtcatagcagatatgtagcagaagtggggaaaaagtggagcctcttgattttggtatattcattctcttctaaacagtacaacttttctcctgcctttattaatatgcttactgggtccatatttactttgacatagaaagccacgcagcaggtgttaaaatacaatatgctgagtgtacaaaatgtcaaacattcagatgaatcctggcgaatgtagtcaattattgcagtattttcaaatgttcacatttttggcatggtgaatttgaaaaattgaaaagcacattgcctccatcaggagtacagcattacctgtattcagtagccgcttgagatatgagatgacgtgtacagagaggaagtcttattttcaagggattttacttttgatccaggagacttctcatattgagaataactatattctccagggaaagggaggcagcatggttccgtctcctctgagatgaaaacaatgtcagaaaacaagctgggggcaagggcacattgctgttagcaaggggtgctgactcaacattaactggccctctcagagttttagtgggtagccccacagacttctgtctctgcgaagtggggctctttatggagctctttcatttatttcaaaaatgtttacctggctgggctcggtggctcacgcctgtaatcccagcactttgggaggctgaggcgggcggatcacctgaggtcaggggttcaagaccagcctggccaacatggtgaaaccccttctctactaaaaatacaaaaattagccaggtgtggtggtgcacacctgtaatcccagctactcgggaggctgaggcaggagagtcacttgaacctgggaggtggaggttgcagtgagccgagatcgtgccactgcactctagcctgggtgatagactaagactccatctcaaaaaaaaaaaaaaattaataaaacacttaccatgtgctggacacttttgggagcagggttgataagtggtgaacaagacagatgagatgaaggcccttctctcgtgtagtttcctaac

SEQ ID NO: 121054 - DNA, 1052 bp, Homo sapiens
agagaacttgcccaggatcacacatctgtgttgaacatttcatatttgaaattggttagtatgattcaaatcaaattcaagttgaaaaaaggttcctgctgtgaatttgaagaaaaatgtgtaagatgtcactattttaccacatccaaaataatttcagattactctaactagaagctagccaatttttatatgcatttttttgggaggagggggcaaaagtaagtaggaatcagatacatgtgaagaaaaaaaaattcaaatcaattttgggggttacatagttgtagtttttgttctgaattgctctggtggaggatcaaagaaaagcagaattaatggagaaaaagagatatgtagaaaaaaagaaaacattgcctttttagtgtagcagcttgttcattactaaggatggaagggaaaggtaatgcttaacctttcccaacagaagaaggctgcaagtcagggcagggatggctgaatcagcaggtaaggtagttcttttttcctcctggaccatctccataggagatagggtgactggagaagggaaggtggaaggaagatcccatgtcagacaatgctttttcctatttttggaattctagaaacatgaaagatgagaggatgtagatttgaagactctaaaaatcctgaaaagtataacattttcagttcataagtatatctggaaaagaagaagcattcttcttggcacatgctttgccttaagctactaaaagtctacctgaaaatgcaatttgaattattattattttttattcaacgcttgtaaaaactaaagcagcctttctagtgtgacttttgacatcaaggaggctaagtgaagtagagaaaagtaggagactaggttggggaggctggcccatagaacaaagtagaagaaataagccagggcaatggcagcttggctgatgagagcctgggactgagtggaaaaacatagaggcccagtcagccattgtggttaaaagctttgtgaaaagtgtgcagaggtggctctaaaatgcatttgtctggttaatatgaca

SEQ ID NO: 121055 - DNA, 1016 bp, Homo sapiens
aaatagaaatataataacacctacctataatggttattttagaggatagtgtatagtaaaattttgtcatttgtaaaatgcaacataaatgtaaaagtcatactatccttagcgtgtaatagaaattttgaaagaaagacaagatcacttggaggaaattaggtcctgaagaaaatggttatgatggattaggtggactgaaggcatgtgttacaggcacagggaagggaaagaccagggaatgtgaagaagtaagaacagctggtttggaacagaggatgaatgttggggagaagaggaaaatcacattgaataggtagaatcaggctaatgatgcagggctgtaaaagctattcagaaaagtctcagttaatggagcaggcagtagggtggcctcatgaactccccaacaagatagttgaagggagggctttggattgccacctgacagggaattacagggactggatccattctacctctgtccacagaagtgctccagtgttgtgaagcaacagagatattttgatttggtggggaaaacaagaggaaccaaatatacggaagacgtagaagggaagggatgtatagaggcaaagaagccagctggaaaagtactcgcacaaccccagtgtgatgagacccaggaaatatatatgccatttaaagtcagtatcaacatcatggagaaggaaagtgcaaaaggaaggaatgtcttaagatggggaaacactcatgaaatgagtctgaagtcaatcgacaagaatattaagcacctactatgtaccattgctgttcttggcactagtctgggcactcttctaagctctgttctaagcatggactacaaacatgcttaagggcaggaaatgtgtgggaggaagccaaatagtgatagaatgaggcttactattttttttttttgttttttgagggattaggtccattagattttgtatttcttcggtgcctactacataatttgctaagtgaattaatgatttttattaaatgaa

SEQ ID NO: 121056 - DNA, 1011 bp, Homo sapiens
catcaattccataggacagactttttttttcttttcttttcttttctttttattttaagatggagtctctctgtcgcccaggctggagtgcagtggcaccatctcggctcactgcaacctccacctcctgggttcaagctgttctcctgcctcagcctccagagtagctgagattaaggtgcacgcaataggacagactttctgtgttgaattgcaagggttgttagtaggatttgttgagacattaggcaagttaaatcttgagaagagcccatcctctgagcagaaagaatgccattcctgagaacattctcaatgaaaggtccatgaaagagataggacccagaagagaaagaattaaatgataatattctttcagggattatcccattcttccagattgcattacttcttttccagtgagcttcataggttcttcggtatgtatcattttgaactaaaatgaaggcatctaattaggctgaaggatgagaacttcctattgcaaagaaaggtacgtttctattgcaaagaaaggtatgcttgtgatcagaagtgtttgtgatgtcatggggcagagtataaagcatgtggggccttgagaggacggtatccctaattacctggatagagacatggaactaatgttagtagtaacgctgttcctctggctggattattcctctctgtacacataggtatgcatataatagagataatataaatttataaccacatatatgtacgtatatgtggaaaagggaatatatttcatatggaccaaagaaaaacattttgccaaactgtcattattgattaaataattcagcatgaagccagcaggcagatatccacaaaacttaacactacacttgcttttgaaaaacaaaaaaaggttttaaatgtaatcgctcgaaggatgttttttaatattaacccacaccaacctgcttcctttggcttgagaataatacactttaaaaaaatctgttgtgccttgaaaagaagagt

SEQ ID NO: 121057 - DNA, 1074 bp, Homo sapiens
tgcagactggcttctttcacttggtaatatgcatttaagttcctccatgtcttttcatggcttattaatgcatttcattctaccccgaattgcattccattggaaggatgctattatatatatatatatatgtgtgtgtgtgtgtgtgtgtgtgtgtgtgtgtgtgtgtgtgtgtgtatatatttgagatggagttcgctcttgttgcccctgctggagtgcaatggcatgatctcggctcatggcaacctctgcctcccagattcaagcaattctcttgcctcaccctcccgattacagactgggattacaggcacccaccaccacatctggctatttttttgtatttttagtagtgatggggttccaccatgttggccagagtggtctcgaactcctgacctcaggtgatccacctgccttggcctcccaaagtgctgggattacaggtgtgagccactgcacccgaccggatgctattatatttttaaaatcatcaaaggtgctctacctgaacctgaggatactatcttatcttccattttccttttgttgctgactttgtcagtggtcgttcctattagaaagcatttcacacatttcttcctggagaagcatgttttctatcatagcaattgtcaccaaatggttttctgtatcttgggtgcatttttaaattaaatatttttttcctaatcttgcccatagataaattcctgaacatctactgtttggtggtcatgcataccaattcaaatacggaacataccaagttaaaataacaatacagttatgtgactgcttagttgtctcccaaaatatttgactctcctaggtaaaggggggccttttctcttaaaaatgcctggcattccttaagtgtgctgtgctatttcccacttccatgtcagcccatttctttgcactggggggcagggccctgttgttccctcttgggcatgcctttcccaaacaccactttcttcaaagtgaatcgctgtctcatctacacccatttgtatgtcatttctgtactttggacacacctctaatgtgtacatatctttctttttt

SEQ ID NO: 121058 - DNA, 1049 bp, Homo sapiens
ccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaatttttaa

SEQ ID NO: 121059 - DNA, 1082 bp, Homo sapiens
ttggattgaagatatttgaaagcagatgcattgatctttacttccacatttcctacaactctttttgtaaagctaagcatttcgaggtgcaaatgagagtttcagagcttgattgattgttgaataaagtcttgcctaccatagtgatcatatttataaaatattaaacatgctaatggttcccttttgtccaaaatgtattttgctcagttactttaaaatagatgtgagaacttcatagtttgcaatggcaatgtagacattagaatttcagaaattttcctcttatgaacaattagatgttttctgctcatatggccttataaaatctcccccatctctgaagatttggaaaacaggtcatgcccagtgtgcttcaggaccaactggagttttccagttttctaattgctagcatctgtttcctacaagaatcactggaccagaactgctttcttggttattgatgggaaacctctcctcaaatatctcaaaatgcttttcagacctctgcccagttagcttgtgtttgtgtgtctgtgtgtgtgtgcacacacaggcacacatatgcacacacacacagatgcacatatagaccatgtattctcaaggcaggggggtaattatcaccccaaaagtaataaaattggttcatatggggtacaaaattacactctttttatataaggcataaatatatacatacagcccttaaatagatatacagtgtatctgtggtattaagtctatataaggggtgattagggaaaacatgtttacaaagcgtccttgagggaggtgataatgaaaatagggtggagaaacactgatacagacttacagcagatatactggagtgtaaatacacaggtatttctgcattcacatacaggccacccatgcatatgatgcatatgtatctgttaggcataaacacacgctatgtagtttacccagggaattgaattcacagtggggcaggactgaattctgtggtctttctaaaattctcttcaataaagaatctctccgtgaaggatttgttttcactttcaggatccccattaaaatatttttttaaa

SEQ ID NO: 121060 - DNA, 1140 bp, Homo sapiens
ttcacatattttctctttacagtaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacaga

SEQ ID NO: 121061 - DNA, 1054 bp, Homo sapiens
aaaacttggactgggattctttcacaacacaacacaagatctcttggtgtattattatagcctgcattatcagtgcatctaatagaattgatttcatcttctatgactttactgtgcctttgggtattgactaagaaaatctcagcctacctttcctagaacaggacacataacccatgagcaaacttaataatagcaacaatgtattgagcactgactatttgtcaggcactatagaaagcacttttattcattcattcagcaaatatacattgaatgccttctatggtcacggcctcagattaggctctgcagatatagggatgtataatcccattggatacaaaagcctatgtagtgctggcctttattctcctcagttcctttttccccaaaaaggatgatgctgttatgacctctaaagaggcttcctttgctgacgtagggcatgtgagaaggaagtctagtctccagagtgagacatcctggagagaactctctacttgacctctaggccacttgatagtgtgaccttgagcaaggatccttactgctctgtgcctcggtttcctcaactacaaactgatgaaaataatactgcttacctcataggttggtggtgatggctaaatgcattagagtatgtaaaacacttaacataatgactggcagacagaacacatgcaagtaatgtcattcattaccatcatcatcatcctcagtagtagtggactttgtacatggaattctaagttttcttgccagggaagtctaccttacttgcctctcattatatcaaactcttcccctgcagttttcaactcatctttgcacaggggcagcagtgccctcacctcagggacactcagaggtgacagaaccctacatcagaagggactggctcagtttgggagtgaggaattacaggccctcccagggagcagagatgctgcagttcttctcaggctgtgtctcttccaaacctcttttcttgtctcttccaaacctcttttcttgtctcttccaaactcttccaaacctctctagataagtg

SEQ ID NO: 121062 - DNA, 1047 bp, Homo sapiens
accagcaacagcaccagctgggaacttgttagaaatgcaaattcttatgccttacactagatccgatgattcagaacctccacaggtgaggcccagaagtttgtgttttaattctgatgtgctcaagtttgggaactaactacatgagaactaactatagaatggaataaactgtgggactctaaacacagcaggattttctagctgtaatagtcccccagacgtcacctagtttagtggttctccaccctggctgcatattggaatcacctggcagctttaaacgacaccaatgcttaggtcccaaccctggatgttagaatttaattggcccagggtgtagcctgggcattgggatttttcttatctcccaggtgattctaaagtacagccagagctgaggaccactgatcaagaccagccctagcagcatatttaaatcacctgcaaactctaacaatacctacctctcctatctcagaccaattgaaactaaatctcatggggcctgagcatctgtaagttgtcaaaagtcctcttccctgatacatggggaggttgagagtcactcatcaagtgtagcgctctcactttatagatgaagaaacatggaaaattcttccccaaaagcccatgatcagggcttagttcctgctgatgttccccctcctcctgggcattcatattttaactgaggacattttaaataagagtagggatgggagactctcaggcccttccaccacctttggagatatctgggggcctggtgtcttcccctcccctgccactgtccctgctctgagcaagctgtcccagggaagccctggggaagtgtgctcatgatagtgagcaggaggcctccagcatgatcattactggagtgtatttttcattgatttgataaattctgttttactccatgggatttacaaaagtaggagaaaggatttctgcagcagggtctaattctgctttaaaatgccacaaccatctttcctaggaccacagaagtgcttttgcttagataaatgtcattctagacct

SEQ ID NO: 121063 - DNA, 1058 bp, Homo sapiens
aagtaggcacataaattataactcaaggaactaatcataggtgttcacattttatgtagttccaaactgtaatttaattttttcagcttctgattgtagaaaatgagcaagaagacatcagcagagataggagaataaattaaaatatctttttttaaaaaaattcttacatcagtctaaatatatcttcactagaatacagttaccaaagtatagtctgataattcctgggggttactaagatcctttcagggatctgtgaagttaaccacaatattaaaagtggtaaaatgttacctctttttaggtacaaggatgtttttgcctttttcacttatattctcacataggtgcacagtggagttttctagaggctgcatgatgtgtggtgatgtcattgctctgaggactaatggaatgagcttttgtgcattcctgtgctttaaaactttgctcaaatttttaatacagtaaatacacactgatataatccacataaatgaaagaactttggtgtcctcaataatttttaaaagcataatggatctctaagaccacaaagtttcagagccactgctctagaataagatcgctcctggtggatgacaggatcatcttgcaagagctgttgacatccagcctgttgaagaaaggggaccacatgcatgcctgaggagtctaattttctctgtcaagatcattacttggtatgtattatacaattatttgttcctggctagaacaaaagctccatgagggtaagggctttttgactgctttgttcaccactctatgcccagggcttataacagtatctagcacgcccccaatatgcatttgtttaaatttgaaagcattgattaaaatctaagacattgaaatatttaactgtttactatgtgctaaccttgttatatatattatctatagtattcccagaatccctgggtggaagatacattatctccattctgtttaaggaagtgaagtaacttgtcccaggtcacacagtctgtcaggggcagcctaaggactcacacattgccgcctctgctcca

SEQ ID NO: 121064 - DNA, 1005 bp, Homo sapiens
tttttaataactcttagaacctacagctaatagcctctcttagttgcctgtctgttgtttcctattttgtattcttgatacacatgtgctgggaatctgctattgtacatacctttgaagaaaccaatttgctattgtacataactttgaagaaaccaatcttttatttctcagtgagaatgtataaaagtgaaatcacacctatggaaaatccacattcccgatgagaaggcaaatcttaaaattgggaggactaggaggattgaattaaattataaaagtgagtgcattttcactcatatattcctcttatttccctcttcattctcctcctaagcaatctcatccaaacctttaattgccacctgtacactaacaactatgaacattctacccctgatccaagcagcctctctgaggtaggtaactgatgtctcctcttgatgtctcatgatatagaaagccatctgctaaccaggtctccttccattatttcttgtattcctgaaccaaaccaccctacatccagtttttccactcagaagctctccttctccctcacccaatcattctgtagctaatcctgatgatgttacgtcctaaatatctctcctatttgacagctcacttttatccctgctccaagcttcaggcatctctcatctcgactattgcagttgtctctgtcttggtctgcgactggtcctctcttgctgttcttcaatgcatttcactttgaagcttgaagtgctttagttttttggtttcaaagctcaaatatggtatgtgtaaaacccacccaaagcttcccattcctttcaggatgaaggtcagtattcttagcctggccttcaaggtcaacctacctcaaggcttttccttcactcctgagtcttctgtctccagccatgctaactttctctccttctttgagtttacaactgttgtcatattcccagggtctttgcatgtgctgatttatctgccatatacactgccagccgc

SEQ ID NO: 121065 - DNA, 1036 bp, Homo sapiens
ctctggaggttaaatctgttttgttttgttttttttccctgaacagtgactgagacccataattagttactgctaatcacttgggggcacctgccagatgagaggcccagtgtggggcagatttgaacgctgctgtaggacattttatgaaaccttaacctttcttaaagtgactaaaatattccagaggcatatttagtatcttgcttctccacagtactgagtgacccccggggcccaagagcctgacaagctactctaaaagtcccacttaactacctgaaaataattgagacagtagagagaattaaacctgatggatagagttgagagtatttggattctgtgccaaaaagtgggtaaacatatattcttgatgacacttggtgaaagatgactgccatattccatttattctggtatgatattaaatagggacatggagcttttttttctccctatttgcaaaaatgagtacttggaacccacttcatatggtttccatcagagctgcttctagtctatacagtgactgtgaattattaaaatgagcagaagcagtcttaaggcatactgcctggggaaaggaagtgactttgtaaaaataatgtcttgccctctaggctgatgggctgcgtgcagccctgaacagggtgccttggtggtggtggaggggtaggctagatttcatctgccactcacttcctgggccaggagcccctgagaagtacacaaagacacaaccatcgtgggggccatgaaaatttcaaagtacttcaaattttaaaagatgtaaattcaaaggtaactcttgagttctgttgcctaagaacattacttttttcagaggcagtttcagagatagaacccagggttaggatgagctttatcattattattttctttagtctcaacagctgaggatgtcatgggcttcaccctgcctgtcttgacttccttgaatctagtctcagtttggtgggcatgaaattcttgattgacttggtgataaccagagaaagtcagagttttgatg

SEQ ID NO: 121066 - DNA, 1040 bp, Homo sapiens
aatcagaaagtgtcctacctcagcaagatttttttttctttttttactcttccttttgtggacagtctttaggataccaaataatctgacatggatttaattttgacttaattatatctatatagtttaaggtgacaaaacaagataatcagataccagataagttgacaatagccaggaggcatgattgctgggactccagaaaaaaaagtggggagtcttgtggcatctcattttcactgcatatttctcttccagacccagaaattcatatttctttcatttaacctcctttttaaaaaactattatgataaaatcacttattttaagacattaagtatcatactccattctgtcagaatattctttccacaaggtttaggtttcgtgaatctgagccatgaagtctgatgatgggtattttccacaaagggtggacattttaggcactgtgataagttggtggggagatatttttaggcagggggaaaagaagcaaaaagcatttccagcactccttgtattggcctatgggcaaggctggccatggtaattgtttttatatttggctttgggaagatgtattcagcagcctggaattatagcagggggtggagacatcagaaatgatgcttagccttcatttccaaggtttacgagggtcggtggtttcatatgtaatttgttttggcagagtcttttcttttttggcacagcctgcttctgaaatcattgtgtcttgatattgatgcatttaagtttagcctttgtcttgcaattattataaagtatacatttaacttccatagttgggtaggaattaaaccttttgctttctatcacaaatgagtcttgcagcattctcttctctattttcctacatgtctgagataccttttcatttttgaggaaatttatgaattgaacttctcataatataggtaacagcacaggatgtgatctggatctgtttatttctgtatcactttgttctgtgcaaaatgataaatattctgatatgctcatttctgctgtccta

SEQ ID NO: 121067 - DNA, 1064 bp, Homo sapiens
tgataactctgtgacaataatgatatccagcagaatcagatgtcttctaaaggtctcttcctccgggtttaatcatatgtataaacatttgtcaggaaagaaattagagagttttggaaagattaattccttgtgtagaaagccagtaatgtctctaacatccagatttattgggggaaaagaaattttttcacttattcatacaacatttattaaatggctacttctgtgtaacagatgttgaacagatatctttatgtttcaggtggctagtctttaaggtaggaaacatattgtctttactttaggtcttttaatgtttaaaaagtgctatcatgttatttgaaaatcttggatgaaaattatcttcacatgtttgcgaaaaaatgaaatggtcgcaaaccctcccttctccaggcttccttcttcattaaaatgagtcaaatgcaattgtctatgtcttcattgccattaacgttctaacatttaaataaactgtcatcttgttgttggtgatgttttctggggggaaaaggttgtttgttttttgttttaattaatttcttttgccttacaaatatcttttcctcctaatagggtcttcacccaaactcataccaaatattcaagctgcactgctgcttgtttctcattgtaatgatatgagctggaggtttgaagctggaggtttcatacactggaggtttgaaactcatttacacacttaacagtagaagatgatggccacctctgcagtgccaacttcctctgccattggcttgctcttgataagcctaacaatagtaataaatagctttcattcacatgttattggcagaggggggccttcaaaagactttcatgtagatctgtaaggtaggcaaggccatgttccttctccattctgcagtcaagaaagccacagctggctgggcatggtggctcacgcctgtaatctcaacaatttgggaggctgaggcaggcggatcacctgaggtcgggagttcgagatcaggctgaccaacatggaaaaactccgtctctactaaaaaatacaaaattag

SEQ ID NO: 121068 - DNA, 1101 bp, Homo sapiens
tctcaaagctgcagtatctctcactccctgctttctttccttttcactctgtttctctccagcactccatgccccatctgaaaaccaaaggtgaaagatgacaggataaatcttactttggctaccatagcaacgttcttgtgctttgctgcccacttttgaagtgttgccctcctgtgaaaagttattttgcataacattgctccactcttccagaggctttgggccttctttaagcttcttctaagcaatcatgagaggatggtcttctgtctccaggtggggcgtctgaacacatctcccccagtggtgcaggcattctctactatatacagagccactcattccctgttcacttttttgtttctaagaaaaatgcagtcagaggtgatgaatcttcaattgtattacataagccctggtttgagccatctatttacaaatgactcagctgtacgttttcaaaatttaaagtgctattgaaattaacctataaaatttctagactactacccatttatgaagggtgtgcttgttatctttacttgatcccagagagtctctctccacccttatccctctgcactgcgccctgtgccccagagcctgacctctgtgttccacctccatggccccctggccctctggtttccagctgggtttgaccaatgggaggtaccagcaggagatcagagaaagataacaagttggggatatttatttctctggcactctctttgtagcactactgtagattgactacatcctgcagtgaaagatgtgtcagggggccatctccacacagccgtctgttctctccagaatatccccaggttctggaaacccctcccctcctctcaactcttcaaatctagggagagtgctagaccagggttttgtactatctgttgtggttttcctgtaccctgcccatgctgtaaatagtccctttgttatactcttttcaaattatccaatttgaacatgctgtctgtttcctgtgagaccttgactaatacaatgtccaaaactcttttgctttgtgtgagtgctccaatattgcttgttttgtttaacaaatctataattcactgtagctca

SEQ ID NO: 121069 - DNA, 1037 bp, Homo sapiens
aaactttctcaccaaactgactcccctttcctctggagacaggcagcattgcatttttgtaggctcctttgcagtaaggtgtggccctgtgactgagttctgaccaataatgtggacaaaagtgatgcacaactaacttccaggactggccggcccgtaataaaagcttccatgcactgctctgttttcttcctccacataccagcaggaattatggattcagtgatggttctcaggctacaggggatggtggagaaacaaatagaaaaagtctggatccctaaatgactgtatggagaagggtcacctcctcccagcacaacccacattaaaatgtaaaaataggaaataatatacttttacaatgttaagtcactaaaatttggaagttgttagttccagcagataacttatcttgtacgtttacataagagttatataacataatttaaatgctatgttgtcatttggatcagacttaaataagcctcaacatcacttgaaaattatttctgttaccatgccatgaagaaaactaaactgagttttctcagtttggagagcaaataccataaaatgaaatgaagacaaattaatttagacctgtttaaaactttaattgatttgatttactctagcttattcaccaataaatggaatgtggtgaaatgatcgtcatgtatctttcagatttttatgttctatttacatgggttttcaagagctttgttccaacgagcttgttttgtgattctgagctccttcagaaagtagtttcatatttaatacatcatgtttgattgttgctaagcatccttttggtgcaaattaataacaacacaagcactagcttcaaaagccaaatacaggatggggctggagcaaaggatgctagactgactgccctctgacttgcaaaaccaggagatttcacatgtgaatctctgtaacaatttgtttttcttttgttttggcttcttctccagtaaagaagaaaataagaatacaacattgtgattgtgaattgctcaatgttg

SEQ ID NO: 121070 - DNA, 1073 bp, Homo sapiens
caggagagaatagcttgaacccctgaggcagagattgcagtgagccgagatcacaccactgcacttcagcctgggcaacagagggagactctgtcttaaaataaaataaaataaaataaaatagaataaaatagaataaaatagaataaaatagaataaaatagaatagaataaaatagaataaaatagaataaaataaaaaaaatacaaaataaaaaacaaactaggtctccttcacctcagcatcagatgactattatcattgcctaacccttctccctgactgtattatctcttatttcaatccatcttactcactacatacagatgagttttccttaaataataatctgattgtcactctctcattgagattctggtgccactacctgctgaccaaactcattagcctagaactccgggccctccataatctgacaccagccttacctttctaaacatctgagaatgtcctccccagagcgtctacttgctgttccttactacagagtgtccactcctccccttgcccatgttttctgctggctctggaatgctctcactcaacaagtctacttatttaaaggttcttttgccctcatggtgtagctcaagtttcacctccatataaagtcagtgttaatcatgccaggttgtagagtgctctccagactccaaattttgtttcccttgtttctaccttcatctatatattattgtgacctcttccatctctccatgtgcattgctagcattgtgttgtgtcggtcttggtgttctcaatgcctgtgtagcattccttaatgaagtatttaaatacaaatgcagaaaatacgcaagtaccaagtatttaaaaaattttcaacatgtttctattttaatgagctttattagtagatgtgtaatgttgttcttgtaagtgtaaaagataaatctgtcataaacaatgtgcctcattattttcactgttttgacattagaagtattaagaaaacattacttacctgaacatagcttagcttgcttctgaagagcttctgtaaaaatacgaatttacaaggcccgttttcttt

SEQ ID NO: 121071 - DNA, 1081 bp, Homo sapiens
atatttccttccatataactgaatatatgtacatgtgaatcagaattatataatttcctctatgtaaccaaatatatgtatatggaaatcagaattatatagatactatattattagattttatattatttataattagatattatataattatatagatattaaaaattagattttctcacattcaattataaaaggtatatcttcaccacaatataattgtagcatcatttttagtggcccaaattctctttaaagtatatttcaaaaaaatgatttgcagctgatttttctgttatagaattacatcattccttctggtgacttgttgatgttgtctccattttggctgcatagaaatccaaagtattttcctgagcctgaattgttcaaacctgtaagttatctctttcagtatatattattctttcattttaatttctttttatttcagaagggtaaattcagaaattaattaggactatataattaagcagccatatttctctcgtaactaagaacaaagttgactacaaagtacagaacagatttgcaatatagatagtgcaacatttacaaatcagttagaaaagtttttgtagtaaacttctctaactttaaaatacattttacatgaaaccagaagggcatgttcaagtgaataagcctgtttttgatagaagacttatttcatgttcttcaggcaattgcttctgtcattggtttccaaggagtacaaaaaaatacaaataaagcaaattaaaaccgtgatctgctgtttcttagaactggaaagttacagggccgaacagaatgttaagaggtcatttagtctgttctctgcctttaggtaaaactgtcaaaaatggcatccagatgcattcattctgcatcccaagctttttctaacaggcagggatgtcagtgtcttactactaaatttattaccaagagcaattttatgacggagcctgagaccttattataaatattcttcctcttcttaggtcaattctgtggttgatttaccttatcatttacatttaccacttaacagaattttttaaaaacctttttattt

SEQ ID NO: 121072 - DNA, 1054 bp, Homo sapiens
aaggtctgaatgagttagtaaatgcctaccattccccttcttttctggcaaaacatggattatttccccaaagttattagttaaatttttaatgaatattacttcaaagctgtagaaacaattatatgtatatttatttatttacttactatgtctgcatgtatgcatgtgtgtgtgtgtgtgtgtgtgtgtgtagggggaaggggcttgaaatattaaggagctagagaagccatctctcaaagaaggacatcctttagtgattctatttgactcatgttctttttttttttttaagcccaagaaatttttgtgattaattttggaatttaagttagcattctttctgactccaacccatccttccaggcttagttgaaatttcagccctaagtgagaagagacacttgaattctcttatatgaaacttagagatatttatatccaggtattttttgtgtgtgttcttgtttccaggatcctttaaggcagtggccgtgtgtttctcattcccttcttgtctttgaggaagcaatgtggcgtagtagcaaggttgaaggctttcagtatagacagacataggtttgaaggctgctctgatactttcaagcttgtctccttgaacattttaacctctctgaggctcagttagctggcagatatctatgaggaataaatgaagtgatccaaaatatttgtgacattagatgggcaataaattagttttatttcctccctatctcttatagcacctatgcttaggctagcacataacagatatggagcaaatttacattgagtgaatcaatggctaaagtaatagaatttcaatttgttataattattaacaaatataacatatgtaatgtgttataatacacatcattatgagtatgcaatcctaaaactatgtataatgttttataaactttttttgctatttctgaacgcaagaatcatcatttcttttacttgattttcaacatcctaaggtttgccttcatcatgtttatgccaagagttaaacagatggtttctgaattttagcccaaat

SEQ ID NO: 121073 - DNA, 1082 bp, Homo sapiens
ggtcttagaacttgggtgctcaataaatggtaattctcatttctctacaaagttgttatgaggatttaataagataagcctagctggtatcaatgaatattagctctttctctccatttgtacccattctccttctgtgtgccattcctgtttgcattgcttagcattatggtcctacaagcttccgcatgaatggtgctggtgaaattggaactttcaacacttctaaagagaggcaagacttaaaaaactgttttttgtgggtttttttgttgttgttgttgttttgttttgttttgtttttttgagatggtgtctcattctatcacccaggctggagtgcaatggcgtgatctcggctcactgcaacctctgcttcccgggttcaagcgattcccctgcctcagcctcctgagcagctgggattacatgcgtgagctactgggcccggctaaaaaactgtttcttttaaaatctgtcttgcattagattagagccatgagatttgtctgtcacgtcatgttcagtgccaacagtttcctgggccaggaggttctcacattagcctaagatgctacttatattatctgaaattaaagggtaactttttaaatatacttgttttctactaaacaggaggatttaacctatccatgatgatatgtgtgggcatttttcttcctttttcttctaacagatagaaattaggaagatgttttaagtattatttatttagccttacttttataaaggcctaggttgttaaaggctttctcagtcatgatattctagtttcccttaacttgttgaaaaatttactgcataaagagaagggatagaaattctggcctcttttctcaaaggtatgttagccagtggaatatacatttcatctgatatggtcaagtaaaagtagtctaaacccttccccttctttatgtacctataatattcttctctggtttttccttaaataatattcttggaaactgattaagctatagcaaaattgagaaacaaacatcaaaacaactctcaaagtagcaacaaaacaggcactcctgtcaaagaattatttttca

SEQ ID NO: 121074 - DNA, 1099 bp, Homo sapiens
gctacttgttataatgaagatattattaggtgtcataaaagcatagaagagcagttacatctgcctacatgagtaagaaaaaactttaagaggccatctagagtggaatgatgatgcccttgaatgagcaagtagcgtttattccaaggattttgtgagtagtatactcatgtgtttcctgtgaagccttaactgtgtattttaagattacccttacattttcttgcctgttacaaaaaaataaaaagaacagttctgatgcgttatcatttgtaaatgttagttggtcctattttaagagtttattttttaattctagcatagccagccatgatcagttgtttcgtgctcttccatttttgccttttagcccctctattttttaatgtctctcctttcgaaaatgatggagaatttttacttttcattgtttttactgaaataaaattcatcagcttaaaaagatctaaaagcagattgctgaatgatatttccaggttttatttttaattgatgtgtccccctctgactcaatggcttttatacaggactattcctcgttaaaaattcatggagagaattgtgtgtggagaatggatgggaatcaaaatgtgggatggttttaagtacaaaccacttcaggaacctgaagcatcatttaacaaaccagcgagaaaacaaaacttattttgaaagacataatctgtgtaatatggagaaatctattaagatttttcaggtttcatatgtcaataaaatattgcttgaagtctatgcaagctacttctgttctagggaaactgtcagcaagatactaacttttccaaaaaccagtggtaagatttaatattcacttcccttccccacattgttttctcttggaaaaggtatactaaggttttgtgtcaggtggtggtcattgaaaagtcttatataatgtaagtaatgttcatgaacttgtctgaatgttattattttaattattcaggacgttttctgtataaggttatgagctctatcttccttatgtaggccgtttagcttaactgtattaaggtaaaaggtctgtatctaatttaaaacttaaaaccaaaaaatt

SEQ ID NO: 121075 - DNA, 1465 bp, Homo sapiens
taggtttagaaattcaagcaatcaaaaattaacacaatatattataatacaattatatataatgtaatattatatgtatctttttaattgagtacctacatcatgcaaagccctatactgaggactcagctttgaataagaaactataagtgataaatgttatgggaagagtgcataatgctatggaaatatatagcaaataagcacagcctaagctggcaattgagtaaacctccctggagaatggacttctgaatttagatttgcaaaatgagtatgacttagccaggaaagagggcaggaaaaaaaacattctctatagagggacagttggagtggacagagagcagggtgagttcaaggaaacctagcagaccaagctacagagacctcatggagagagtcaaggggtgagaccacagagaggcagacaccacactaggaaggaccatatgagccagaagagtaatgggcaccagtttgaagaaatatgcatttttagaaaatttgttctgcctgtcgtgtggattgggaaaaggccaggagtagtgatatatgagagataatggtggcttggacaagagtatgacagtgggaatagaagatggattaaaaacatgtttaggaggtagaaagggaatagaaacatgactgattggatggggatgggagaatggttggagaagataaggaaaagtcagacttcattcccagattcctgctctgagcaactgaggatgatgatgtaatttcctaaaacggggatcatctgcagggaagatttggggataaaataaggttagtttaagacctatgaaattttggatacccataggacatccaagcagagatgtctagatgacaaactgaatatattggtctatgtcttaggagagaatacagggatggaggtttagatttgagcattttccacatatagatggtaattgaaatgttgataataaatgatatcatcaaggaatagtaggtatttgtgtattaacatgaaagtaatagccaaagcccttggcaatacctgataaaagtataccagagtttgagatgttattttggtggttttgattataccttgaaattatgtcaaaactgtggttgtttcttactggaaaggtaaattttgatttggcctgcataaaccaggcactgttataagtgctggtaacactgaggaataacatagtctttgcactggaggagcttacaatgagatgtagaagttaaacatgtaagtagttaaaattacagaaataataaaaattactaaataaatactactgaatcacttggtatatggccaacactgtgctaatcattttcatgacttaactcgttgaatttccccaacaatctgtgcagcaggttactatcatatccctcttttatagagaaggaaacaaaaagcatcaaaagtctaaatagcttggccaggtgagtggttcagggc

SEQ ID NO: 121076 - DNA, 1016 bp, Homo sapiens
actcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtat

SEQ ID NO: 121077 - DNA, 1052 bp, Homo sapiens
cgcagggcattgccaactatagatgctcggagtaattcagtgtattcagagaacacggtgaaacaaggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggtgcgggccatggtcttggggagggtgctgggtgcgctcgagcaggctagcgtcgggagccgccgctgctagtgagaggccggggccacacacgctcctccccggtacctcctccagcatcaccaggggaggagagggtcggggccacaaggccgcgctaggcggacccaggacacagcccgcgcgcagcccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagtgaggaggggccccgggggcgaggcgggagtgggaggaagggcacggtcgccgcgctggaggtcgggaccccggagcggcgaccggccggggtgggctcgctgagtcgcacccgctctgctggccggtcctgggctcacagtccctgcagccctcggaaacagcgctaggatccttgcggggagagggagaggatgacggtattagacaccagttcttccaaaccttttcccgaaaggaagcaaccctaagagctcagagctggggggagaatcaggacaggcagggaacacatggagttttcttttcttttttttctctctctctctctttctttcgttccttctttctttcttttgaggcggagtctcattttgtcgccaggctggagtgcagaggcgcgatctcgactcactgcaacctctgtctcccgggttcaagcaattctcctgcctcaacttcccgagtagct

SEQ ID NO: 121078 - DNA, 1033 bp, Homo sapiens
taagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgagacaaaaatagagttgtggggctactcaggatgtgtgggccgtgtggcaacataaat

SEQ ID NO: 121079 - DNA, 1318 bp, Homo sapiens
cagctccaaaaatcccatcttagcatctggtttctcaaactattcctggcactgactatcacaggctgggttcctaggaagcaaacttagtgatagagagtcatactcaggaaatgtgttacagattgctcttgcagttcatacctgtggaagaggagaggaagcagggctgggtagagaaagaagttgggctgtattgcaggttcaacaaagcttcaggggactccttgaaaagctctgaatgtgagatggccaaacacaattgtgcagaatctggccggccttttcagctttttaccactagtcactggatacaggctgacccaggaagggggtcttgaatttgggtgaggtgaccctctttaaataattctgaagagaattgataggtgaaggctctgtggacaatactctctgcagctgggggaatagagtcttttggtgctagctgggcacctaggtggcccatctcagcaccctctacagctgctctctttatagtataaggatgtgggataattaacacaggcaagaaaccgtagaggactaactttatttttcttttagttttttttttaattgacatataatacttgtagatatgcatggggtacattgtgatatctctctatataatatatagtgatcagatcagggtaattagcatatccatcatctcaaacacttataatttcttgttttgggaatattccataagagcaccaactttagacagctgaccctggaaggctgtgtgcccacaaaaggagtgtttggttcagagaaattgcgtgagctaaatagagtgcaggtcactgagtctgacagaggtcaaggctagatgtggggagagcactgcatggaggctcaggagacagagactggggcctttcctttctcaactactgaatgactggtaaagttgatttacctctctgaccctcagtttcctcttccagaaatgaaggtgatggaccagtcattgcttgtgtctagaatacataaagatttctcaaaactcaacaattaaattaaaaattcaaaaattagaaaaggggcaaaaggcaagcagacatctcaccaaagaggatatacagatggcaaaataagtacacaaaacgtcaaagttcaacgtcattagtcatgatagaaatgcaaaataaaactacagtgagatatcactacacaactgtcagaatagctaaatttaaaaccaaatagtgataacaccaaatgctggtaaggacgtgaggaaactgaatcatccatatattgctagtgaaaatgtcttggttcagccactctaaaaccagtttgg

SEQ ID NO: 121080 - DNA, 1863 bp, Homo sapiens
attaatgataactcagcaagccattcaagcaagaccttgtctgatctctaccaggcaaatcttgtttgctatcttacacgtgcaacacaagtaaaaactcttgtgttgtttcgaatgtgccagaggatcactcactctctcactgtaatggaggatggagaataataggctgggggggacatagatgtctctctctctaggaccctgctctccttcctccaggccttgccagtacagtcaccttacagctgtctttgcttccctctcttctctgcagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttacttaagtagtccgagtatatttaatcgttgaatttcttgctttgtacatgtcctctagttgtgactctttgattagtcttttgcaaaagtatgtgtgctctaaaaacctcagctattctaatc

SEQ ID NO: 121081 - DNA, 1422 bp, Homo sapiens
ggggaacttctggggtggtgaggagaagaggacattataaagggattgctgacacacatagaaccaggaacatttagtgatgcttgtgtttaaagttgtcattgcgcacaaaggagcaatgtttataaataggctttagatttttaatgacatttcaggctgttctatttattatcatagtccaaagtttcattcagttagttgacaaccttttgtcaaacaccagctgtgagcctggtactggataaagaagaaaagtggtcaatgcctttcaataactcacttgtggtgatggagacacgtgtgcaaataattataattcagtgggataagcaaatgttataatagaagtgtgcatgaggaattataagcatcagggtgaagaagtactcaacctgccaaaaaaatacatagaaagctagagcagatatatatttgtccatttgaaagtcacttaaaaaaatcagactagttttttttcaagactatattttggtcttctttcctgaaactttcacatttggtttctgcctaggaagccccacctgctttttcatattaagggcttctcaaatctttgactctgcaaagaacgtctgttttacttacatccttgttttgctcagtagcaagctttttagaaacccttaactgttctgtaatatttaaggtatagaaataaggttttaatatcccagttcatgtcacgtgctagatattgaactttgaatctccaggaactactagaaggaactgacaaattcaagaatttgactttgtctctctgaattgggtttgaattttgcttttgccactcactatgtgaccttgggcaagtcctatacagtctccaagctttgtaagtgctttgtaaagatcttgctgagaaatagaggtgagtgtaaatgcccagtcctgcacttgacatagagcagggggctcagtaaatcttagcaactattttctgtgttggaatttgaattctacattgtcctttttttgacttgacagcaaatgcattatgttttcagtaaatgcacattaagttgaaatcagcatttgctaaatatctgttgtgtcccaaacactgtctgggtgctctatagctggtttatttagcaagcttcatggtcctgagaagtataggtgggtatattctcattaagatagtgatatggtttgggtctgtgtccctgcccaaacctcatgttgaattgtaattcccaatgttggaggtggggcctggtgggaggtgactggatcatgtgggcagatttcctgctttggcactgttcttgcaatagagttctcacgagatctgattgtgtgaaagcatgtggcacctccccctatcaccactgctctgaccatgtaagacatgcctgcttcccctttgccttctgccatgattataagtttcct

SEQ ID NO: 121082 - DNA, 1035 bp, Homo sapiens
cattcattaaagcagagctgccttatgtaagaagcttcccttacaagccctcatttgttttttattttttctctggtgtaggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccaggtaatggagcccttgttgtgtgtcattaccaccgacctattgcccctatgcttcaaattttatcagttgtatgggaacaaagaaaaataacatattcggtggataggcacacacacacacacacgcatacgcctgcacacacacacacacaccctaccttctaggacgggggttctcagtggccgtctattagaatcatctagaaaactttaaaaaaaaatactgatgctcagaccctacctgcagaccagtcacatcagaatctccagggggcagagcgtgaatcggtatttgtaaaagctctctttgttactccatttacaatccattttgcatgacacactttgaacaaaaccaagaaaaaatactttttactacaccgcctctcctccagagggtgtttttgtgatgtggcttatgaaggcagcattcttgcctcctgaggatgcaggtggtgctagcggcagttgatgacagaactgattctcctccttgggttgttccgtggagcacatcagatgggaactgaggggacccaggagtgtgatttctttatagctaataagccctggctttggagccagacagcgctggatttgaatcctggctctggtacatattagcttaggtgatgaagggtaagttacttcaactttccttgcctctgttattcacattttcaagtctg

SEQ ID NO: 121083 - DNA, 1011 bp, Homo sapiens
ggggttgttaaacttaaaccttttaaactctgtaattacttcgtaaaggccgtgtatttgcatctgaaatgcattgagccttaagtttagtcctctgtgtatggagctttcataatgatgggaacacttccaaaaataaagtaactctatagaaaatgttaatcagcttatccgcagtgaccctagtgagtttctccattgtacacatgaggaaatggacatgacagttagaggtttgcccaaagccactgtcatcggcattatgaagatttaagcaatggtcctacttaccagaaaacatggtcatgttttcatgtaagacactgtggaccttagtcaaattgatctaaattaagattcagggactaacaagacttttggtgtttggaagagtctaccacatcaatcacaaagagctggcttattccttaaagttacctgcagggtttaaaatcagttatgggttttctgaggagtctatttgcttgaaatcaaaagctctgtatctgactaaacattgctcggaaaactgaaaaggacttggttcaagtaacttcacactgccagggaaaactgtgtgagaagtacagtaatgactcaatttgtggcatcctttttaaattttttgtggcattctactttttttgagatagagtctccctctctcacccaggctggagtgcagttgtgtaatcttggctcactgcaacctcccctctggggctcaagcaatcctcccacctcagtctcccaagtagctgggaatataggcctatgccaccacacccagctaatttttgtattttttgtagaaatgggttttcaccatgttgcccaggctggtctcaaactcctggactcaagcgatccacctgcctcaacctcccaaagtgctgcattacaggtgtgagccaccctgcccatccattctacttttatagttgacaggaaaacagccttctactaggaactgatttttgaaaaccattttcagtggattggtgcagaatg

SEQ ID NO: 121084 - DNA, 1032 bp, Homo sapiens
gaggttgcagtgagccaagattgcaccactgcactccagtccagcctgggtgactgagtgagactccgtctcaaaaaaaaaaaaaggcaatgtgatgttctgtgcccctgtctatcagcccttcagtgggttgagggttgtgttacttttcaatgtaaggaaaaagacacttggcatcacatccagttaaacaatttagatcaattcaacacatagctactgtcaccaatcttgacaaaaaccctgggaactccgatggggcagatgactgggcatcctgccaagcagagaggtggtctccatgtcacttactgtcatttcacattgaggttaataattggggtgggaactttcattgtcttctgagtgtggtttcttttcttttaatgaaatgcttttctaaatctttatgctatttgacagtcctacccaaggtctctttaaattgctgtaattgcaggggctggtgaactacagcccgtgggccatatccagcctactttttttgtaagtcgagttttattagaacacagccacattcatttgtggtgttggtggctgctttcatgctccaacagagctgaggagtcatgacagagactgtatggttttcaaagcctcaaatatttactgctgtccttacaggaaaagtttgctgacttctttcattctctctctttttctctttcttttagggtatcatagatttaaagaaaggaaataaaggatgcagtggctcactcctatagtcccagcactttgggaagctgaggtgggcagatcacttgaggtcaggagtttgagatcagcctggccaacatggcaaaaccccgtctctactaaaaatacaaaaattagccgggcatggtgaacacctgtagtcccaggtactagggaggctgagttgggagaatctcttgaacctaggaggcagaggctgcagtgagctgagatcacaagaaaagaaataaagtccctggggaaactgttccagtgtctattaggtggtgcaaaagttactgtggtctttgc

SEQ ID NO: 121085 - DNA, 1395 bp, Homo sapiens
agcaacttaaagaaatcttaaaatctttcaacacaaatgaaaccttcccacctttgccttgaagagacaaaggtgttcttctttatgcctcctttccttgaaccctcttagagacttgagcacctttctagctgcttttgacattctctgactttaactcagttttacttgaaaatgttcttgtccaggataaatctatatgaaagctcctctaggagagccttattattggtgagggaagggagagaagtaatacttcctgtttactgaatgcttatgatgttccaggcactgttctatggaatttatgtatattttcttgttgaattctcagaataaccttatgatgtcaggatcgtgccaattttacacattaggagcagtggcacagaaagataaagtaatttgactaaggccacaccacgagtcagtggggagcctggactggctctcaggcatgtggccttggatcctgagctgggaactagtgcatacactgcatctcactcttacccttccatcctttggagaaggaggagtggaggtgtggacagatgcttgaaacctagaccatcacaaatatactgttgcaacatatttctcctcaatttctacttgtttccctttctaggaccccatgatgaggagtgggggttgatggagagacatattcaagatatttatattcaaagaagcaatcaagattcagaaagatggggttgataatttttacttcaccctgggaggcagcatagtgcagtgaaaggtgagggctcatgcgtcagatatacctgggttttgaatatcagtcctgtctatgccatggtgccaggcctgtgtctcacctgtaatgtggatatgactcctatctcatgggatgtctatgcagattgaatgatataatatgtaacattgataaaattaccagcttggttgcccctttttctttcccacaaggccagggagatgagccatactggagcattcatggagagctggagtgaggcggagggacattatatctgattttcaactcaagtagaaatccgtctagggtcaaaatgtatgagtcacataggccagaagaagtggttgcagaggcaacaactgcactaggaactttgactataaaatgccttaaagattgaccagtacaagaagagtagaaaagaaaatcagagtgtgaggccaggtgcggtgactcacgcctataatctcagcactttgggaggctgaggcgggctgatcacttgaggtcaggagttcgagaccagcctggccaacatggtgaaaccccgtctctactaaaaaatacaaaaattagctgggcgtagtggtgcgtgcctgtagtcccagctactcaggaggctgaggcaggagaatcactggaacctg

SEQ ID NO: 121086 - DNA, 1144 bp, Homo sapiens
cctctagcagtaactatttctaagtctgctgaaggggtaagtaacaaaggagaaccatcagctatgagtgggagcaaaaaaggtggcagctgtccttgtattttctcttaaaaattgttctatgcttcctccatctcctaacagatgtcggctttcaccaggagactccatcttatgtatgggtccacctcacaggtgtacctgccatgtacctgctacaactcatctctttgccaaactggagccatagagaagagaggagggggtctgggagagctcaggttcaaatccattcagctactaaaaggctggatgatctcaggcaaggcactttctctctttggatctcatctttctttgtaaaatcaggagacttgaacccatcacagaagggccaccagattttgatcagtgtgacaatttatctgtgccttacctgagtgtgcctactgtcttcctggtgtctatcaggaaaaacactggcctgaggggtcctgcaatgtgctgtagggtggagaacactgcgctgccagtcagagggaagaggccaggctcaatgccaacctcatgccactgaaggattgtgtgctcactgcaacatgaaagagctttcccccaggcttttgaacgtgtgagggcaggttagtgaaaatttctatttaaattaggtcacagggttgggggaaaaccaagagaatgtgtaataactctgtgtgcttttagggagaatgtgagacatttttttttctttttttaaaattacactttaagcactagggtacatgtgcacaacatgcagatttgatacataggtatacatgtgccatgttggtttgctgcacctatcaactcatcatttacattaggtatttctgctaatgctatccttccccgagtccgccaccccccaacaggccccggtgggtgatgttccccaccctgtgtccaagtaatctcgttgttcagttcccacctatgagtgagaacatgcggtgtttggttttctgtccttgtgatagtttgctgagaatgatggtttccaacttcatccatgtccctgtaaaggacatgaactcatcttttttatggctgcatagtattccatggtgtatatgtgccacatttttttaatccagtctatcat

SEQ ID NO: 121087 - DNA, 1083 bp, Homo sapiens
ccactgcatcataaaatagtcaaaaggtgggagaaggaggatggacaaaataattaaatttgaactggttctctgaaaactcaaaataagaattgattagatctctgcacatatatgtgcctgctcaatatgtgaagtacaggagaagctgctgtcaagctcagctgttggatccttaaggttgcccttggttttggtgtaagaatgtgagtttagtggttcagttccatttttgccttccacatgaaggtgccattagggtctttatgaaaatgtgcaacacaatttattcttaagccccaagggtcatcttatctttgattatctggcctagcttggagatgaccagggaaaggagggaatgtatagatccccaaatatggaaaagctcttcccccctccttactcttttttctaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtgagccttctctcttctctccttgctcacagatctctctaccactttttccctagtccctgttttctgaaggaatgggaatgcgtagtttgtggaatctcctttgtagaccaaacactacttgatctagtcgtgttatagaaaaagagattgaccgtctcattagaagt

SEQ ID NO: 121088 - DNA, 1040 bp, Homo sapiens
tggtattttcttcctttctccctcttctctgctcctggctatgtctacctgggactgactccatgttggaaaacttttgatctggaaggaaccttaaacatctaaattattcatttgtttgacaagtttgaaactgaggcctgaagaggttaagtaacttacataaggtcacacgctgtccttgtttctcttggttcatattttatagcttgatgtgacctagtttttagatatctgatctcccctaacagaaaaattctgagtctacatgtttctattaagtccaaaaaagccagatttaattagccaccatatgaaggcctctctccaaggggtgactttggaatacacgaaatggagaaaacatctttggtataagcccactcttggtacctccactgggctcaaagccttcctcaaataaataattcatgaggttaagttacctttgggaacataagtggaggaagggacttcatgggtttccatgtgctcagggcgtggaaagatggctgtgccaggggaaggtgaggtggagctggagaaggacgggagtgtgccacagacgttgtctgtctccttggtccccggcttgatcaccaccaggttctgactcagacagtctgtgtatgctttgcatttcatcacactagaaggcacatctgagaaggtaccccgagcacactgcttacaccgcacatcctcagtctctgtccctttcttccgcacaccccaacccacaggacacaccgtatggggggcacaggtagcgttagactggaacatgccaggtgggcaagtgcattctcggtcagtcaaggcagcacaaggtaatttctcaatcattggccatgggcatggctgactacagtcatggcatttctctatgccattctcatgcctggtaaaggtccccacagggcaactgctgcagacgcgcaggcttgtgttggtacaatgctcagagacataggttcctgctggacacttgtcacaggttagcacctggccggtggcacggtcaacatggcggtatgtgc

SEQ ID NO: 121089 - DNA, 1512 bp, Homo sapiens
aacagaaaatagctgcactaagaaaagcagaacacaagcaggtacatacacattagttttaactatacataaatactataaacaaagggaattgaattgaaatgacacataaagagaattctacacccactaggttcttctagtctgacaacttacataagtttaaattgttctttcttaataactcatctatccttcagttgttgttcaaagtactgagatgtaatgctagctccaactaccctctaacttgactagaatgaatgaacagttagtttaaatcaagatccttctgaaactcattaatcatttattccttaactgttatgtgtcaggacattgagccagaaacacaatgatgaagagcatattgtctttgagaagctgaaaaacaatattagccctgagcttttcaaatgaggaaacacacacaaaccttgtctattttgttatttttccttgaccaggtctgcaaggtttaaacccaagaggagagaggagtcatggacttctacacataaaagaatagcaaagattgaatcatgatatagttaggatgtatgtcctctccaaatctcatgctgacatgtgatccacaatgttggaggtggagtcttacgggaggtgtttgggtcatgaggtggatctgtcatgaacggcttggcattgtcccattggtgataactgagttctctgttaattcctaccagagctggttgcttaaagagcctagcacttccttccctctctcttgctccctctctcaccatgtgacacaccagccgcccttccgttctgccatgactaaaagcttcctgaggccttactagaagccaaacagatgctaaatccatgcttcttgtacagcctgcagaaccatgagtgaaataaacctcttttctttataaatgacccagtcttgggtattcctttatagcatcgcaaaacggattaacaaaaatatccagctaaattattctggggacctgttaccatttgccttggaatctctttcttccttcccaacacccccacctctcctaatcctgggcaagctgacctggccgtgtataggatgaaatcaaacaatggtcttgtcccaaaggttatttgggagaccagaattccaacctgttttccaggacaaatgattaaataatttcctctcaccctttgccttttcctagtttactcagtctctacaacctacgaagcgatgtttaaaagcttacttaagcgagtgctaccagtcagtatgataaaccacacacaaacacatgacctctgacacccctcaaatcacggagttaaaccagtttctaagagacctgaaatgaaaagtgaaaaaaggaaatactaacaacagatggtacaagcccgtgcacttaccctatacaaataactaggctgacagcaaagaaaaccctaaaaggtcctcaagttctcaggataagtgagttgaaactacattgctaagcagaacccatgtcacaccgttattcactaaacaaa

SEQ ID NO: 121090 - DNA, 4206 bp, Homo sapiens
gtatgcccagcaactcaggaggctgaggtgggaggatggcttgagcccaggatgttgaggctgcagtgagctgtgaccatgccacggcactccagcttgagtgacagagtgagaccctgtctccaaaaccaaaataaaaaataagtcatcaaactcaacctaccctaaaaattgtgcactggatttgcaactaaagacctgacaatttaagtttggctactttgaaaaagataaaatttataatggggcttaggagcagtctcaagttgataaccaatacaggattccttattcttctgctagctatgctaaaaagacttcaggtaaattcatgaaatggcatgaggttcagcccttcatcctgaagggtgactggagggtgtgccaggaatcagtagagactatgttataatccccatccagggtggggaggaaatgccttttgtctttcacattcttattctgcatgcccaagtccacagcacaggctttgttaatgtataaaatgatgatctcatgatactgttccaagaagtatttatcccattgggatccttggccatgtgaacataacggacatcaggtactggagcctgggtacacgtggcagggtactcagaacactactgggggaggtgggcaagttagtggcctgcccacgtattacagttagattaaaaagtaataatcccagtaaaatgttctatttattatgtcttttaatgctcttctttcaaatatctccctttttgtgtgataatatttattgtcatcatttttgtgttatgactttttgtttgtcatgaccggctaactgcatgaaaaatagcttactataagcttataaaaatacaaatatataggtacacaatatgatataatatatacacatgtatatagcaattgtatatgtatagagagagcaattgctacatgccaggtgctttgtatacagtatctcatttattcatagcatctttgtgaagcaggtgatattgtctcctttttatagttgagaaaatggaagctcccagaacttcattggtttgtcccaggccacacagcttgcacgtgatattgctggggccagaacccaggactgcctggctcttcagctcatgtcctcccttagccctgtgccacactgcgtgtttcacaagtccaaattgcttgataatgaaatgtaacaacagagaaggctcactggggaaaagttaagaaggtggtttggtttgttacagaacgtgaatgagaattacaggaatgcctttggaaggaagtattcttgctgcttgcacttctatttctgatgagtgtctgcatgataatagaaagtaaaacatacactgaaagacaagagctgggttcaaaagtctggggctcaggtggacaaaacattcttgttgctcgacacccagtaagtctagtgtgcatgattgtgctttgtcttcagaatctaagcttaccttccaccatcttgactttaccaattgtactattctgcctgagacacttacccttgctatatcatatctctgtaaggcagagacaagatccatgagagctttaggtttgtgccagtgataaggaatgctctagaatggcttgcccagagtgacactacttagtcagagatgccccttgccctcggggagctcgctttaactgcataggtaggattttggcagtgaggccctcagaagagaagggagccataattggtaaagatatgaggtctgaagttttagaaaactcttttgcaagcattatgaattccagatagagggctatttgctgttatagcctgtccagctgtgcgtttgcctagaaagtgccaagtaatagtgtttttctctgttactgaaactagacatgtagcttagtgctacctcctgaccatcatttatcaaagtacattacctcgtacattggcaattcactttggctgtttgggcaggtgtggagtggtctggtgggggctgaagttctgaatcatgtcaagacttggtggcaaattcgagcagaactttaaattagagctgatattatatccaaaagattttctctctcctatatatcttagctctacaatcctagaatgtgaaagctggaagggagcataaaaaatactgatttaacaccctgtattttttggttgagagaaaaaaaaatactctactggggaagtgactgctttttcatgtttacaaatgaaactgcatcgagcaccctttctaagtgaggcactattctgggcagtgggaacccagggatgaattgggatttggatcttgccatgaaggtacaattcgtatggtatataaaatgagcatggccatcaccagtgctggttgggttttactcgctcatgtggaatcactggatgaatgtagtatacttaccttaatacacaaaatatgattgatgttaaaatctttaaaatacctgaagtaactttggctcttagtctgagaataagagaaaaaaaagactttcaaatctgagaatgacatacgttagcctcagtagagaaagcaacttctaatcagaggaatggggagcgcagaacctgtgctggaatgcaggagtcctgaccgaccccatgagttatcattacagtcaaaatgtgtataatggaattgagctctgtcatctgaactgtttctgaaggcatatgtttgaatcttccccaagtccagtacaaaacaaacacacctctagtgtaaataaactacacaagtaaatcaaatcagcaataaaaaaaattcctcgtaaatgggatttaaggactaccttaagttgggaagggaaaaaagggaggcttgaaaaggcatatatccaccaaattcctgcatgacatattttagtgtggctaaatgtagacaaagtctatcaagcaggatatagtaagcacagttaatgctgtatattctggggcagtttgaagacagtccttttctccaggtatgctattattgggtcagaacaaataggtgggagcttctgggctggctctggcaggtggtctttgtcctttcttcattgtagaccagaatgtggagacatcacactttaactttgcaggcaactatatccacgaagatgagaggtgaagcctctttggaggctgcatagacagtttgcaaattaattttgtgttcagctggtccttcataaagcatgtaaactctaattgccttaaataaacatcttttttttttttttggtttttttttggtgacacgaaatgatccggtgcattatcagatcattactattcaggggctggtatgaattgagtgacttttccttgtgcttattttccagaaagcactaatattctgttggctttctttccccaagcaggcctggcaaattccggtgatgccaggtcaccagcaacttcttggcaaactcaggtgcttctcttctgtgacaagaagagcccaggttatctcagagctttgggcatgtgtccagtgatcacttggagctgactcagtgtggaccattaggcaaagatatgtctgtttgacagaatgacaatgggagccataataggaatcaatttggttcccaaagttggatcctcatttagcattagcagaaggctgggccttgtggctgtagcagcaacagctgctgagctttgattatttaggataggggcgagatcatgaataaatactggccttgccccagtgtttgtgtttgtcaaataccaaaaaataaaatgggaatcctaaattggcttgcatgctgccacccagctttcttaccaccttcatttctagcctgaatccaagaggagaggagcttgggtagaggttataacccaggaggaacctggcagatatcagtgagtacaggcaggactgagggctatacagaggtggggttcactgatacttaggctgttgactcaaagcaatagtaagcaatagtgatctcagtgagatcagtgagcagtagtgatctcactgttcttgagaggtgctaaaggccaccagaagattttcttgtcagtatcctggctttggagatgacagatgtgtgcagtggtgggaaagttgcgctcagagagacctcaggcaggtgtgggactgagcagggtgtgggtggggatcagaacattgccctgtggcttcatatttaaaaattatgcctaagactttgtgctacacaaaaataaaaacaagaaaacta

SEQ ID NO: 121091 - DNA, 1009 bp, Homo sapiens
gggtgctgtcgcgcggtgcattcccgagcagggcgcaagccgccccctcctcaatccctttaccctctctcttccctcttggctcgggtggggtctcaggttctgtatgccgaaatatcacccttagacccactctccggcgcctccaaagcgccggcttccagccagccagcgcgccggcactggaatggggggagggggaaggagatgtgtgtgaaggaagatgaattttctacagtctttccgatccctcgtttacctgtggctaggcaggtgaccctgcagggtggtgcagtctccctcatcgtctaagctgcatccacatctcgggtcaatcatcttgaccaaaaacttaccctcaacttcccccaaattccctccctttatttccaaatattggggtgaaggggcaagttaggtggaagaaaatttgagatcaaacccttgagcttcccttgcctatcttttatcactgcaggagggatggaaattcttagctaaaaaccgaacaaaaaaacccccaagaaacaagagcttgttttcacgacagggctgtgtaagggaaaagcaggcttgctgtctccttccccaaaagggcttaacgcctggccagccaagaactgcttagatctcaggacattgcagttgctatggcctgggaattcatcctacagacactctggttccttgtgtgtgtgttttaagaggaagagagagactaaataaaagtttgttactgttagcatttataatgaggcaagtcccagtctcccttcagaaactcttttctgcccacttattaatggcatggccaaggtttatatctttgaaacaagtgaaacaagtgtggtggatggtaagcagtagtcggggagtctcttgggacaatgaacctggattgacagtcttggtgtggagagaaacacatctaggtccatgggaacactgatcctagttcagtggagtgagaactatcatcatttcctttttcacagctttagatccacta

SEQ ID NO: 121092 - DNA, 1418 bp, Homo sapiens
gacctgaccttccttcccttcctcatccccttgcttccctccccctcctcgtgggatgggggagggcgatcgaaaaacttgataaagtagcactttcaacttctttattttctgcgaggctttgaatacgtttaaggagagagataaatttgttcaaaaactttttttttttcctgctgaaactcgcaaggggtgcctcaaggacaggaaagcttgagtatttgttttactcgggttctacctaggcaagtgtgttggcacctaagcattcagtgtgctcccgaggactgggtttggacttcagtgttggatcctttgaggagcagtttcctgtttggagttagacttccttgccggaggagagaaaaatacaaggccttatatgttatttactatgtgctttatagttttgtttgaagttagagaaggcagaatgtgtggcagtccgggttgaaaaggagttttgttaagtggtgtaacaatttcttttgataacaaagttcggtgtgggctaggcattaaactaactccctcaatcctttaaaaattaaaagcaacttaagaatagcttacaaaaaacaaaacaccctgtgtctctataaggcagaacgtgttctgtaagagtaaacccaagtttgatttttgtagagcaaatcaggaggaccctatcactttttgcagttgagagttggtactgcttcatatcaacaaacgatcaccgaaatgaataattcatgtaattaacaaatgatttagaagcaggacgaatacagactactgctgatgtggcaccctctgtccacactttgctttgtgggggatgttttgagcatattgtttatagacactcgcctagctatcctctgttttcttagacttttctaattttatgttcccttctccacctccctcctttcaggtaactttcatactcaaaagtgctcttgagctcaaaaacagtgaaataaaacatttgctatttggaattttcaaatgaattattttataattgattagttgagcttgcagggcaattgtgggcatattcttttaagtatgaaattataaaatcactttaactgctttggattaagataatactaaagttaattacacagttcttttctgtcttaaatgggatgcagaataaaattaaactactttggatgacctggggatgcagtcttgttttgcatatagggcttttgagctaaattctaaataatatttgttcgcattttgaaattatttaaatactttttttttttgctttgcttttggatgtgcttgtaactgattagtgtcccccatcatctttccttttctaatttttttttagaagtgtggaaatcatattcaggtttgtgattctgcataggggaaaaatcagtaggccgttacttagtgtgtgaggtcgt

SEQ ID NO: 121093 - DNA, 1023 bp, Homo sapiens
acaccaatattaagaaaaagggcctgtcacaaggtcacatcatcaagcaaagaagctgctggtgagagtttaatcaatcagtattttccttaatgtgaggaatgtgattaatgtcatgttaaatgcttgggggtttaggataaataaaagttttggtgccttgagtagtttacaagtgttaaggattgggcatattattagaatcacatttttgttttaaacttctcacaacccctgggttctgacataaatgcttctgcctctccctccctccagtttttgatgaatgtcatgaatgtgttgggatggcttatgtgataggaataagacaacataataacaatgaaagttagtatgtgaatccattagaaaaataaacgagagagagagtatagggtcagtgtcagaaatgttaaaatgtagtaggagaagcatatggaatattagaatatagattcctgcactgaaggaaatgggatttattcatctctcattagtttgaccagtgatgatatactgagtactggcagtagttaaggtattttttcctccacttctggcaaagagtctttagaatgaagtaagccttctcttgagctgatcctttcagatgtgtacttttacctgaaatattaaaactgtcttatccttcttactgtcctatcagtgttccaataatgaagagtctggaaatttacctaacatctagactgactttaaaaatgtcattcctggagcatttatcacgattattgtaataataaagggccacagtgttttggattgtaaatgtagaagctcatatactgtatttgtaaaattgagactacatagtcttggttagagtgtttttgggggacatttaaagttggtcttttaaatgtatatactattctctagggattttctcattctttgtgttagaaacaacttttggtttatttagaagtacgttctcctgagatccaagttttgcatttaactttaattaaaaattcctgttgtgctgtagcaggttgcagt

SEQ ID NO: 121094 - DNA, 1028 bp, Homo sapiens
tcttctgcctcagcctcctgagtagctgggactacaggcatatgccaccacgcccggctaatttttgtatttttagtagagactgggtttcaccatattggccaggctggtctcgaactcctgacctcaggtgatccacccacctcagcctcccaaagtgctgggattacaggcgtgagccactgcccctgcaggagttaagaattttattttggaattagcaagtcaggaactgcccattgctttggggacctctacatttctcagtattcattgctctgagaaaccagcattcatccataatagctgtactagttttcctaagctattttttatttttttgtagattaacccttcagttttttgccttggaaggaaaatgccatactatttagcattttatctcgttgaattactgtggttgatatagagattgagtaatttccctgttttagccctgcatgcatttcatgtgagcctacgttttctgaatttctggtctttttgaggtctacagagcagtttggtatttcatttatagctcccttaggttctctaggcttcctcttcttggctttatcagctgtgcatcccctttcagacatttgttaaaatttcttgccgggtcccttatcatgttgggatgttttcagctgtaaatagaaatcctgtctaaaatttacttaaacgttaagaaactacttcatgtaacgaatctgaaggtattatagttaaaggtggttaatctagcagtttgatgaatccagcaaagatccaggttattttcatcttttttctcctccacgttaattaagtatccgctgtttttctggtctcaagtggttatagcaattgtaggtatcaaattctcattaaagaacatccagagtctgcaggaggccattccttccttggtttttttttttttttgagacggagtcctgccctgtcacccaggctggtgtgcagtggcacaatcttggctcactgcaacctccgcctcccggattcacgccatttctcctgcc

SEQ ID NO: 121095 - DNA, 1042 bp, Homo sapiens
tttagtagagatggggtttcaccatgttagccaggatggtcttgatctcctgaccttgtgatccgcctgcctccgcctcccaaagtgctgggattatgggcgtgagccactgagcctggcctgtgttttgtttttaaagtcaaataaaaccttcccagaagaaagaattcattcatctcagctgggcatggtggctcacgcctgtgatcctagcactttgggagggtgaggtgggaggatcgcttgagcccaggagtttgagagcaggctgagtaatatagccagaccccatctctatttaaaaaataaaaataaaaagaattccttcatctcatgcttatttgaaaaccattcactgtgtatgtttaattgtatgtgattaaggttgctatacatagactatctgtagacctttgcctctttggcagttagatatcctggcacctgctcaactgtagttggcatttaaacaaggtttttcagctgacctgattgtacttagtgtctgagaagtacatacctagactagtgaatatgtaactccctggggctgagagaatcttcgcctgtaaagtacagggtctcaaaatactgaacagaattaaggttctatgagaaaggaaggaggggaatgggcaatgtgggaatggcacttggcttaacaaacaacagtgtctggtcatactcactttcctttttttttttggtggtggtggttgtgattgttgttgtggttgttggtgtgtgtgtgtgtgtgtattttctttttagtcagtcttgtaggaggaagaaaagatgaatggggatatggctagtctgctatcttgagcaggaaagctgttattgctttttaaaaattgaaccttgtaaaatattaaaaatatgcttatgtgatcctataatctaaaatcctgttattaaaagaggtaaaataaatacatattaatcttcattttagagtttgttttctgtttttacatacaatagtaacacaaacttagtagtttagaactatatatatttattagctaatagtttctgt

SEQ ID NO: 121096 - DNA, 1391 bp, Homo sapiens
cctggcctgaactcctgagtttaagtgatctgtctgcctcggcctcccaaagtgctgggattataggagtgagacattacgccctgccatcatattctgttggttagaagtcagtcacaggtcacattggcagtcaaagagagagaattacataaggacatgaatacgaggaagtggggatcatggagaccacctcagagtctgtctgctacaaaggatatgcatgtgattgttaagagtgtctgatggcatgaattatgcattatttttcttttgaggctcccacttaatagctgtattgtactctatattaagatattcaagaaatttgctgatgtagccaaatatttaaagtaattgaaatcagccttgctgatgtctttgtggtattaaatattgttgctaaacagattccttagttttaaatttattaatatagtttacagtattttgtgaattagattttagacatttcgttttttcccccttttttagttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggtaagtattttcagttaaatttctagctcttgcttcataggatttaatctttaaatgttaagaaatagatatacttttaaaattaaaatgttttagataaatgttttctttgtaacatttaagaaaatagagtccaggtacctctataatggatatcattgttgctctgtgtcctgctggatagtaatcctctatgtatgtgtttgtgtatatatgcttgtatatggttgtgtgtatctacctgattactgattgttttaaaataaataatagttttcatttgggtggcatttagtaatttataaagcaggcttgctgtatatattctcatttgagcctacagtatacttgtgaaatagttatgacagatagtagccccattttaaatatcttgatatttagattgagaggttaagtgattttgtccactgttggttagctaagacaagagactttgaactgaagtctgggacagttgcctcgctggtcttctcattatattttgttgcttttccaacaacaaaatgcatttggtcatactttttgtgtttcagcattatagcagttatctgccaaactgtcttcttcaactactaccaaacattccttttttagtaagtattctagtcgcttctgccagaaaacaatctttagggctcttatcaattacaaacttataaaattctcagtagtttagagaagaagaaaaaaagtaaagcatatctgtgtatttac

SEQ ID NO: 121097 - DNA, 1575 bp, Homo sapiens
tttcctttgtattttcgttaacaaaaactccctccgctttcttttccttgaagtattttcactgttcttagccttttgttctgtataaatttagaaacagcttattaaattgctactccaaattttttgtgtatttgaattgcattgatatattacatcaattttaagggagaactgatatatttttatgatactgagttttcagttactaaatatggcataactttgtttttgtcttcatgtcttccagtaaaattttatacttttccatgatggttcacatgtcttattttatagccatgacttagatcaggggctatcaaactaccagcccacaggacaagtctgaataccacctgtttttgtaagacccatgagctaagaatgctgagaattttataaatggttggaaaaaatcaaaaggataatatgacatataaaattatttgaaattagaattttagtgtctataaataaagttttattggaacatagttatattcattcatttaaatatctgactgcatttataccacacataggagtgttgatggttgcaacagaaagtgtatggtctgcaaattgtaaaatatttactatctggcactttatagaaagtttgtttacccctgactttgaattattgtttgtctttgtatctcagtgtttctttgtagttggggtgagtggtcggggtggggtttgagcctctctttcctttatcttcatctccagttctgataaaacttaaactcatgagtcactgttaccaaaatgtgttttattcttcagatatgtttgagcagagcaaaggttggaaactattgatattatgatttatatagtaattactgtagctattttttggtattttacatttgaggatttaatataaaaaatataacttaacttgcctctttatttattttcccttttgtaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagagtatgtaaataattcctttcctgcataattacatcaaaatagaaggatattttataactgtgtctaaattaagaaaaattagttcagtcttttgtagacaactacagtaacttcctgcaaagtctcatgttactagttattgccctgtgtagtcaatcttaatttttagtcatgtgcaatcaataacaaatcaatatcattataaattaaagcatgaggctctgttttcttatttatctttcagactctgctgaatgattaccattttaccttaactatattttaataccatttatttagtgggattctgaaatatctgctgattcttagcatagatacaagaattttgatagtgctttttcttcagttgttaaacatctgaacataaacatttccaaggtggttggccttgcaaattaccttgtaaggatttggtactgtgtaaatatgttaggggaacaacttggcaaagaaggagagc

SEQ ID NO: 121098 - DNA, 1025 bp, Homo sapiens
tgggagctaagctatgaggatgcaaaggcataagaatgacacaatggactttggggcctcgggggaagagggtgggaaggggatgagggataaaagactacaaattgggtgcagtgtatactcctcaggtgatgggtgcaccagaatctcacaaatcaccactaaagaacttacttatgtaacctaacaccaccggttccccaataacctatggaaataaaaaaaagaaaaaaaaatttaaaataattttttacatctctgcttttatcatttgaaggagtattaaagtttaatttcacagttgaaggtcatgttttcaacatgtatgttttgataccatgtattatagcacagattgattttgtgtcaaaacaccctgtaatgtaatttatcactagtgtttttatgtttatacaaacttagattgtgtttatacaaaggctgttctattttattttcacttggttgcagtaataatagttaacatttcttgagcttatgttatggttgaagcattgtgctgagagtttcacatttattatatccttgaaagttttaaaaaacctaagaagataggtatttttatccccattgtacataggaagagactaaatcaaggaagataagtggtggctgttttagttactgttgttgcataccaagccatcccaaacttggtggcaaagaataacggttgtattatgcctgtgagtcaagaattcagatggggtatagcccaaatggcttgtgtggggcccttagctggaaagattcaatggtggggtgtcctggaataataggaaggttttttcactcacatatctggtgcctagaaaccttgaagactgtaactgccaattggagagccattatgttagcctttccatttgggttgactctcttacagtgtaggcatctcaaggtcgtcggacttactatatggcagttcacggctcttaagtgcaagcatttcagcacatattagctttattgccctttacaaactagcatctgttggttacaag

SEQ ID NO: 121099 - DNA, 2293 bp, Homo sapiens
gtaaaatttgacagtgaatagtttactcttttttaaattttgtttttttttttttgagctggagtctcactatgttgcccaggatggagagcagtggcgccatctcagctcactgcaacctccgcttcccaggttcaactgattctcctgcctcagcttcccagctagatgggactacaggtgtgcaccaccacacctagtgaattttttttttttttttttttttttgtatttttagtagaggtgggatttcactatgttggccaggctggtctcaaactcctgacctcaggtgatctgcctgccttggccttccaaagcgctgggattataggcaagagccagtgaacctggcctaaaaaattgtttttaacctgtgagcactccttaatatccatatcagaaactatacatttttaaagttattaaatattaaaaatttcatagaaattgagtaatcttattggtaagtgtaaatgtttttctgaagtgtttgattcatgaggatatatctgtttggaggaaggtgtttagtggagcttgacatctgggtttttaaaagtaggaaattattatacttaagctaagaatcactgctcaagtaataggtttagcaattttctgtgccatttaggaagttatgtttattttcttttttctttttttgagacagggtctcctctgtcacctgggctggagtccagtgccacaattgggctcagcctccccagtagctgggactacaggcgcgaaccaccatgcccagctaactttcgtattttttttagagatgggatttcaccacgttgcccaggctgatctcaaactcctggtcaagcagtctgcctaccttgggctctcaaagtgctgggattacagacctgagccaccgtgcctggccaggaagttatattcttagaatcatcaaatttttttcaaataaaaaatttccaaatactttaaataatatacaaatcaagccttagtagtgtttacaagagtgacattccagaagctatgtacttcttgctgttaatacagtatatatggttatctgatactttcatgaaaagtacttcatagattgcgattgattacaaattgtcattgtaaatgtgcgaagtactgttgatgtatgattaatcccatatatgagtaatacactaaaatttaatccacttaaaatatattttcttcattgtgttttaaattttaaagggtttatttcatagtgctaattttgtgcctgtttgcttttgcagcttaattttcccatagggtgacgattttcacttaacagaagttgtttttgcttttgaattgtgaactttttcaggtagaagaaggctggtggagtggaaccctgaataacaagttgggactgtttccctcaaattttgtgaaagaattagaggtaacagatgatggtgaaactcatgaagcccaggacgattcaggtagactattttttaaaatttttaattgatttaaataaactttatatagcatctagtgttttattttgtattttttgaaactctgttctttcttttgaactttgagtcagcttcaattagtctactttaaaaaagcaaattatgatggggacctaactgaattaaatatctagtccaataatttaatatttttctttctctgatttctgctttaaccttaggtaaatctttagtaccctgagtttaaaatgattcatcttaggttatctgatttcttcctagtaaagatatatttatatgcatttttggtctgctgagtttgcaaatggcctgtttaatacttcagaaattttagaaataagaaacaaccttacttttgttattttctgtattcacataatagattttgtttattctgggcagccaaatgtcatttagttattttgtgatgttagttatttagagactcacccacaaattcttcttaatttgctcaccatttaagagtatgattgacaaaattttaccccaaagctagatttaaattttgttacttttaagaattgctgttggaattaggagagttttttttgttttccaaaagaggtcttgaatttacaagtggaaatgtagggataagaatatgtttttctcgatggaaatgtatatgtagtgagaattttcggggatttgcattagctaatattatttggcaattttatgattagttggatttataggtattaggagtagatcataaccttaaggttgccagtatcattggtttttgtttttagaaccggcttaatgcaaatatatgaaaactaaatattaaa

SEQ ID NO: 121100 - DNA, 2159 bp, Homo sapiens
tagatttctcttgtactcttctttttaacctcgcaccctaccatgattcattaacagattttgtcaaaaaatgtttagaatctattttctttttaccaccttcactgccgctatcctggtataagttatcttttgctgtataattaccatagcctatatgccattacctacttactgaatagtctggtagccagtagtgatcaccctccagtagctttgcatttcacttagactaaaagccaaaatcttttaaaatggctacaaatccctctatgatctggcatccccatatccctccctccacctttcttacctcatctcttatttaactttcccctttgttcacattggtcaccttaggtttcttaaggatgttaggaacattcctctctcacagcctttgtgcttgttgtatacctttgtctggaatcctcttcttcaagatgtcctgatggctacttgtctgattcaggattctctcagaaatcaccttatcagtgaggcccttactgacagctctgtgtaaaacagcagaaagtccccattatccactttttaattctcttctcttttttttttaacgtttcaaagaagaatttgttgctattgcttattaagcttattgtctgtctacctgctcattagaatatatatatatatatatatatacacatacacatatatatatatgtatgtatgtatttgtttactcattgtctagaatggtctctgatatgttgatgctcagtgaaacagtgaatagttttttgtggtatatgtagaacttttcaaacacttttgtcaagtgaaatcctcttgagtttttgttgttgttgttgttttggtttttgctttaagttctgggatacatatgcagaacatgcaggtttgttacataggtataagtgtgccatggtggttcctgcacctatcgacccatcctctcaattctcccttcccccgctcctcacccctcaacaggtcctggtgtgtgtttccctacctgtgtccatgtattctcattgttcaactcccactaatgagtgagaacatgcagtgtttggttttctgttcctgtgttagtttgctgaggatgatggcttccagcgtcatccatgtccctgcagaggatatgatctcattcctttttatggctgcatagtattccatagtgtatatgtaccacattttctttatccagtctatcattgatgggcatttaggttggttccatgactgcgatattgtaaatagtgctgtaaatattgtaaacatatgcatgcatgtgtctttatagtagaataaatcctcttagcttttaagaagattaatgtcactcccattttaagggtcaagaagtggaaactcctgagattatttaactactgagtggtaaaatcattagagttttgtttttctgatttcccagtttttttttttttaactttactatgctgtttaacatatggggtatggaaatttggtggtttttcactattgtagtccatttgtttgctgctatcttcatctaattttcttttaggtatgcttatagaactatcttttcatgtacgttcagctctttgagggttgtgagtagtaatatgtgcgtatactagcatttctcatgaaggcagggtattccaaaatctgaaatttaaaagtcaaagccggcaaagggaaattctagatataaatacaattgtttagttaattcagcattcatatatttattcattcaatatattgagtgccttttgttaatgtattgtacaaagtcctgggaatacagtgatcagcaacataggcatgatttaccccccttgtttgaagcttttttttccattgggaaagaaaagatgatttaaaaaagtgattgtaatttagcaggagaaatatttgttacaggaaagggtgcaataaatgtatataagtgggctaatccagacttggcaagctgtgaaggaatgtgccctagaagaagtcatagattgagatcccaaaatggctaggaaatttctaagcaagtttgtggcagagggtgaggaaaagcatagcactgcaagatcctgaaagagatttaattcagaggcattatagagtatataattagatgtgaatgttgagcctggagaaattattgggtcagacataagaaa

SEQ ID NO: 121101 - DNA, 1010 bp, Homo sapiens
aggctagtcaccaggagtcaaggtattatacagtttaccttggggtctgtaatcatatattagtattcaccttatactcctcctggtgagcagctttgcaaggaaactttttctggagttttgatgcccttactggtagtacgttgtggatctttctaagttattgctaacagccagaccttctttctatgtgtactttttaggaactatgcaatattgattgattttaagtccagttaaaacacccgcacccacacctgcatgatcgacttacaaaatccttgagaataatggtgaaagatgactttaatggtgaacttggattgattctattaaatgctttttattttcatcagatttcttttttttttttaagctttcagtgcagttcacatgtggtttcttgtttccgtttttctccaaacaagtaattgcattttgcagttcttttaagtcactttatatgaagatacaagccatcaagtagcttttgctatagagatttaatgaagaaggaggagggagggtttaggctcgatagacagatttgctgtttgttttatgactgatagcaacatacataaaatgcagatgtttttcttcaagcatagcaattcaaggacaatcagatgggtaaagtatatgggtattaaagtgttagaagtaccatatagataaggttactgttttgtctcattatggcacctcctgcatgccctttttcctcctcctttttcctttctccttgctccttatcctcttttcttctttccagtggctgttttcccttttatactttactgcttctttgtgatcagtgctctctctgtcacttaatggttctcagtgatacatcttttaaagttttaaaaaaataatagacactgagccaggcactgtttaaagcacttcacaggaataaattagtttacttctcatagcaatcctgtgaagttccccattttacaggcaaagagattgggcaaatataatggagggggcaagatatg

SEQ ID NO: 121102 - DNA, 1070 bp, Homo sapiens
gggtttcaccgtgttagccagaatggtctcgatctcctgacctcgtgatctgccagtctcagcctcccagagtgctgggattacagacgtgagccaccacaacatgctgtttttaaggacctcgtatgacatgatttcctaattaggatttcttaattttactaattaaatttacctaaaattattatcgttttgcacaataaaaaagtctgtgtaaattgcataaattgcatcttgctcttctggatatttcagtactgaatagtttaattttttttctactgtgttttattagaaggcatatagaatgtagacattatgacaggatgtcaagcgttttgtgattctaggtgtcattcttcaaaaacaaattattgtttcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaaggtggtaatgatggacttgttagattaactccactcattctctcattaagcattttttaaaatgtaaaagtcagtttgtaactctgttagatttctttttttcagatcactaataatttggttatgaatgaggaggctgtgagaaattttgtctccaaatttacaatgattaatattcatgtttgaatctaataaaattagaatgcttatttcttggtaaatttaacacacttagtagaagctttagggtttttagttagcacagtgtaaataaaaattagagggttttttgccttttaaagctaaaattatatataaatttagttatatatataattaatataataaatatatatttaatttgaattagacctaaaatggactgtttttaaaatggatttagaaaatattaaattacttgatattttggcactacttaaatttcctctagattgtcaacattcattaaatttactaaacttctttgaatgtgtggagta

SEQ ID NO: 121103 - DNA, 1582 bp, Homo sapiens
tagcccagggatttaagttctcaagtgctgttgtttttatttattgtatttgttttattgtagtttttagagatagggtctcaccatgtcatccaggctggaatgcagtggtacaatcatagctcacttataaccttgaactcctggtttcatgcagttctcctgccttggcctccctaagtgttgggattcagacatgaaccactggttcctagcctcttatttattttagagattctaaaattaaatctcattaatatactatggacgtcagagaatattatctttgagacaaggaatctttaaattggtagctctgagctatgatttaaggaactttggagacctttacctgtttcattgctaagttttcagtcacattactatcctagctataagtaccattagggaaagctgggtaactgtaaatggaaactttgtttaacagtattatctttattctatcttaaaatagtttatgccatttttttctattctagcccttaatcctacagtcactgggacccaaaactcagagtgtggagataacaaaaacagataccgaaggtaaaattaaaggtatgtttttgaataaagctttcatattgggaatagtagaaacatactcaaatgtattaagagacttgttggaagcatttgttacactgtcttattagaatagcaaattctattagatgtaagcaccatgaggtcaaggattttgatatactttgttggttgatggatgtatctccttgtagttgaatctgtgcctggaacatcacaaacagtaaatatttgaatgaatggattaatgaaattgttacttaacatacggtattgactataagtattttaaaatttaaagataattaagttcatctctaataacttttagtatactttacacaagatagaggctaaataagtatttgttgaatgaatccatttgtgtgagccacattatttacattctttatttcagctaaagaatattgtagaacattatttgcctatgaaggtactaatgaagatgaacttacttttaaagagggggagataatccatttgataagtaaggtaaggtgtttctgtttttcagtgaattgcttaatttatttatagaaatatttttcaaaagttatacattcaccctagagtgttcttatattcaccctggaatctagaagagctgggactttgtcttgtttctaagtcctgaaaacttggcacgtaataagtgctcagaacgttctctttttgagctaacttttattgactatatttgttgtaatttacatattgggaattattgttaaccatcatatttgttcttttttaagtactttttttttaaaattaacctcaacttcccaggtttttattcttacttctcttccacctcattctattttttctcctgtctgtcgtttggagtgttgtttgtaatgtaaacagaagaaaaatagggaaacaagctaaacatccatgagtatggaaatggttctgaaactctttttactctggaaaatgatgtcaccattttaaagaatgaagtgattttataacttggaataaatcc

SEQ ID NO: 121104 - DNA, 2185 bp, Homo sapiens
ggtctcaaacttctgacctcaggtgttccacccacctcagcctcctaaaatgctgggattacaggtgtgagccaccgtacccggcctcattttatctttctcttttttcctctgagaacattttaacgttataaatggaattttaaaattgatatagtttttaaaactaaacgcaattttgtaactgctgctaaaagtaatacgtgggaaatattttcttttaggacagtgtgatctgtttagttccagccaggcacagtggctcatgcctgtagttcctgcactttgggagaccaaatcaagaggatcatttgagcccagaagtttatgattgcattcctgtggtcccagccacttgggaggctgagttgggaggatcacttgagcccaggaggttgaggctgcagtgagtcatgatcgcatcactgcacttcagcctggccaacagagcaacactttatcttaaaaaaaaaaaaaaggtctattgtcttaattattctattttgctttttaggagactggagaagctggctggtggaggggcgaacttaatggtaaagaaggagtatttccagacaattttgctgtccagataaatgaacttgataaagactttccagtaagcttttgtttttcaatgatgataatacttgaaagaacattttgccactattcttttgcaaacaagtttttttgcattattattgaataatttttatgaaggagtttcagatgtagctattcaggtaggagttatttgagttatagtaaaacaaaataatgtttcagttccgtactttattcttcctttgtttctttctcgactgtactgaaaaataaccttagacttctttattttataatttaagaagggctgtctatcctaataacataaattagtactttcctggaagaaattgtatttttatttaatgttgttgaaaagctctagtttattttaaggtcttgtggatattgctgttatgctgttggtgcatttttttgggagggcaagagcactctgcctccttacagaatttgttatttttgtgtcacttctcagagaaaaagtgaggctgagtcattcatcagtggtcttttgccttcctacaacttggtcccttttccccatggatgaggaatataatagagtttttagaatagagggaaagagcatcaacacaagcacacaacaggatgggctaccatgttaggtttaagccaatgcataactctccaactctatggaagcttaggctgtctgaggcctttgttttgttagattgcattcagtattgattcagccttcatatgctttattttatagttttactaaagaatacgtttttctgcttttattatgtttgtacattacggcttatcaattattcttaatttgtaaaaaccaagtccaccaacttagaagtgtatatcaatattttaaggtattaagtcttaaaaatgagcgaatgtttataaattgagaaaaaacatgtctttgcctttaactgttcctttgagagttccaaagagttaagagtgaaaactaagtctatttgttgctactctgtttttaaaaaccaaaacaaaacaaacaaaaaaaaaaacggtctctcccttgttctgccagtcttcctctccccacaaccccagctgcaaaagaggggtaaaatggtacttaggaatcttaacctaggggaggcagagcagaacatttttgctcattaagatttttaaggtttattcaatccactgaaatatggattgagatatttgactgaattttgaccaatgaggctgttttttctaatgaaataatttgttgtcattgactttttgggtagtttttacgatcttagcattttatattttgtcaaggattgaatgaagaggagagacatttgtataatttagattattactaattagagtttattttaactatatttgatatgaaactggtcagccgtttccaccattattattttaacagaaaccaaagaaaccaccacctcctgctaaggctccaggtatgtaagaagcatattattcagtttgctattttccattttttaaaattctaaaatggtaaaattggatctaatgcaaactattgatttttatcaagtatgatgtctgtaaacatttttagaaatatatgaaaattgagtgttcacatgcatta

SEQ ID NO: 121105 - DNA, 1020 bp, Homo sapiens
tttatagaagttggtgttgaaagctttttatatagctttactcttcaatgtggtagccactaaccatgtgtggcttttaaacttaagattaaataaaatttaaaaattcagtttctcagtcataggagtgccatttcaagtgttcagtagtcacatgttggatactgaaaaaatagaatgttttcatcaccacagctcttccatactgcagtacggtagaggatatgatctctaacacctaaatttgacaaagaaggaactgagaccacagagtagggtaatagtggcaggtccaggattagaaattgagcctggtaattccggtacattgttctttctattaaaccatggtttcatctgatgttatttttcaactcatctttactttttagaagtgtaattgtctctgtgctttaaaactgtcttcttaaaaaagtattaatgttttttcccatagctccaaagcctgaactgatagctgcagagaagaaatatttttctttaaagcctgaagaaaagggtgaggctaattttcaactttcaaaaaagcaattatttcttttattgtcattttaaagagaattatttctccacactgagttatttacactgatttttaacaggtattcagtatgtatttaacaatgcttggagttttctgggagggagtagttcatttctcaaacagataacaatttacattcattaaaaaattaaactattcagtaggatgttgtctttattcagttatttcacagactgtataagaaaactaagcattaaataactatgcttttattatttttatagtgtttcagtttttaaaaaattccttagaatgttgaagacccagttcctacttaagcatgaaaataattaattacatattatttaatctcactgcatgtgtttgtcataatgtaaacctggaaagttattccagggtaccacatgtattttgctaaaaaccttattggtttgttgtgaatttggagaaaataagtccttctcattgcacat

SEQ ID NO: 121106 - DNA, 2065 bp, Homo sapiens
taaagtattgtatcctcttacttgatttctctcactttagctccttttctggctcatacttcatgttgttgccaggatcatgttttttttgtttttttttgttttgtttttttttttttgtctcgctctctggcccaggctggagtgcagtggcgcaatatcggctcactgcaagctccgcctcctgggttcatgccattctcctgcctcagcctcctgagtagctgggactacaggcacccgccaccacgcccggctaattttttgtattttttagtagaggcggggtttcaccatgttagccaggatggtctcgatttgctgacctcgtgatccacccacttctgccttccaaagtgctgggattacaggtgtgagcctccgtgcctgggccagtatcatttttttaaggagactgttttttagagcagttttaggttcacagcaaaattgagccaaaagtacagagttcctgtatacttcctttcttcacacaggcacaatttttcccactgttaacattctgtaccagagtggcatatttgttaaaatcagtgagccttcctacattgacacttctttatcactcaaagtccatagtttcctttagtgttcactcctagtgttgtaactattatggattttgacaaatgtataatgtcctgtatccaccattgtagtatcatacagaatagcattactactctaaaaaccttctttattctacctattcatctgtccttcccttcaacccttgtcaaccattaatttttttaatgactccatagttttgccttttccagagtgtcatatagttagaatcatacagcacgtagccttttcaaattggcgtctttcacttaattatatgcctttaaaatttctccgtatgttttcatggcttgggaggcatatgttgttagcatcaaataatatttcaatgtctttatattccacagtttattaatccactcactcactgagggacatcgtgattgcttctaagttttggcacttataaggggagctgctataaatgtgtgtaggtctttgtgtggacatattttctattcatttgggtaaataccaaggagagggattacctgataatatggcaagagtatattgagttttgtaggcgcaactgccaaacttcttccaatgtggctgaaccattttgtactccccctagtaatcagtgagaatttctgttctacgttctagccagcatttggtattttaagtgttttggattttggcctttctaataggtgtgtagtggtattttacttttgttttcagttgcaattccgtaatgatatatgatgttgaatatcttctcatatgcttaattgtcatttgtatatctttggtaaagtgttctggtcttttgttcattttttattcaggttttttttccttcagtttctttctttgtatattttgtatagcaatcctttagtagatgtcttttgcaaatattttctcccagtctgacttgttttcttcacagagcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttttttttttttggcatgtgaatgtctagttgatccaacaccgtttgttgaaaagactttcagttttcagataaaaatcaaaagttcaaattcaaggccctccagtaactaactgaccccccgattacatttttgatatcatcttccaccctttttgtttactaaatgtagcactcactctctagtccctaaatatgtcatgtactttcctagctttatctttcgttttactttcaaaatggaagtttttttatattctttttttatacttaagaattttaaaaatatgctgcacaaacaatttatgcttaataaaaatattagtctcagat

SEQ ID NO: 121107 - DNA, 1871 bp, Homo sapiens
atatcctttgaccatttttcttggtatgttatataaaacatctcttaatttctagaaatttaagtttggctggttgttataactacaaatagctttatttcgttattgatttcaattggagagtttggttttttacaaattcctggtggtataattatatatagtacattgttacatcttgaggccatataaaaatagatttttgtaccaaatgatgaccagaattttatagactaagctatattttcatatgattcaaagtattaaataagtggtaaaagtgagaaaatagtattttgtattcattgtgaaataagacttgtaatttttaaaaggaagaggtttagctatgtgctacgatgttcaggttttataatcaccagtttctggttgatatgaaatcttacagaattatttgtggtcttgtgatagacatttttttcaaagaccaaataaattttgaaaattattcagtatggtgcttaggagcttcttatttttgtatatacgtcttaagacacattttagctgactgctgtattatgactatctcatgtatgcatgtgtcaattttaatacctatttatgagcacctgaaagatcaggaagcaggtatgtcatgtgtaataaaagagtacttgttgcctttttggtgataaaattgtctttattgacatagtataaaattgtcaaaattgtttttttccagcttattttcttctacttcaaatggaaatacccatttcattgcattattaaatgaaatggtattaataaaattcttagtgcagtactaagaattacaaatataagcctataattctctcgtctgtggctaagcagtcttgccctagtttctcttaacatttgatttttttttccttcaccatcatgctttttaaatttgaatgttatataggacttgagtttctacttgtttttagttctctatatttcagtttcagaaaatagtctggatttaagtctagataattttctggttagagtaaaatcatgtgtggttgtatttgagatagactactacacttaaaagcaaagcttcctgggaacataataaaaagcaggcattatctactaatcggaagcttattagtggttttcctctctaccataataaacattttttaaagttatttaggattattaaattaaaatataactttaaaataagtaaaacagtgcacatgtatacaaatacagagaatgaaagttcatgtctgcctctgtcacacttttccagcctgatacaaacttttggaaatagaaaaacctaaataattttgattgttaataacttgtgaaatattttaaatcttagatgaaaaatcaacactggaacagaaaccttctaaaccagcagctccacaagtcccacccaagaaacctactccacctaccaaagccagtaatttactgagatcttctggaacagtgtacccaaagcgacctgaaaaaccagttcctccaccacctcctatagccaagtaagttttacctaattttaaattagcttactgatttactcacctttgaccttaatggctctattgcctttctaaatctccaggtatgttttttcttatttttcagttatatttatttttaaaattgacatatacaattgtgtgtatttattgtatacaacatgatgttttaaagcgtatatataattcattgtggaatggcttcggtaactgtgataacctcacatagttaacatttttatgatgagaacacttaacattcactcttagcatttttaaagaatgcggtacatcacattaactgcagtcactaaaatgtacaatggatttcttaaaacttattccctctatctaaccgtatgtatt

SEQ ID NO: 121108 - DNA, 1050 bp, Homo sapiens
gagcttattcatgtaaccaaatgccacctgtttctcaaaaacctgttgaaataaaaaataatctaaaataataaaaaaaatttaaaaaaaaatacaggagcattctgtacattttgatttagctctcactgttgcttaccttccagagttgtccttctattgttgcaatttaatttttaagtattatttttaatattttctgtatactaatatctgttgaatgttaattttatgttataataattttctacacttaactaaactgttctcacattttttattttattgtgatcagccttaggagagagttttgcgtttatggaaatggttttacagaacagaaagtaatcggtattaggccatacaatctttaatgtcattaaatcacaatttaaaaaaaagtcgtgtttcatactagtgatttttgcgtgtttttttcttatttcaggattaatggggaagtttctagcatttcatcaaaatttgaaactgagccagtatcaaaactaaagctagattctgaacagctgccccttagaccaaaatcagtagactttgattcacttacagtaaggacctccaaagaaacaggtaagtcagcatggacagcggtggtgcatttaaaaaaaaaaattgtcaaagaaactctttaagagatatatttatgcaatttgtgtgtggataaagttggataaagttgaaattacacagttgaaatttgtttaaaatttagcagccaaagtagaaataataaaagaagataagtaaaatttttatggtccttactgatcagactttatggtttcttactgatcagaggactgaaatagatgttaaaagatgacccatctattactccctctttatagtggaatgactgtactacccaacggagatatgaatacactttagttttaaaagtttaaaaatgagatgacatagactttcagtgccagcattagattatatttcataggactttaaatttctcctcttaatctagagatacttttatttccagtggaggaaaatatgctttttctaaccctt

SEQ ID NO: 121109 - DNA, 2024 bp, Homo sapiens
taaagactaaaacttgactaaaagttgatttagttataactacattatgagatgtcaacatgctgatttattactctggcctcttaaagcaccaagccatccttttggaaactgtcttggtgttcagtgagtaataaaacaggactttctggcttaatgcatattgaaattaatactaatattaatttttccctttgaaagacaaaggaataaacctaaaacctaatatacatcttgtgtaagttagataacctgcaaatagttatatgccaaacattgaaatggttttattcattctacagctgttcttttttcctgttttgtaaaataattattttggtttagtcttttttctagacattcctatccttgacttttctttccagattttgtttcctagcctgtttgccatgtttcccttcttacgtgtcaggaaattattctacccttctccattttggtaagatgaaagtttataaagcaatcaaaatagtattttcaatataaataggtggtgcacattgatttttctttgtaattttactgaaagtgtacatgtctgtctgtctatttattctaacccttttggttttccatttttagatacaatgaaattcattttggaaaagtttcctgattcgtttaaaatattcttttgataatattttttaagaaaattggcaaccataaaaatcagtttattttctctccaaattggatatttcattttgctttttaaaaattttatgtgttcctagcaacgtgcagattgtaagtggctggcagagtgacaatgtgattgcaaaagctaaatgattgtcgtgcctgttatgccacgtgtacagtgtaaatccattgttatccctcttaggtaaatttaaaagcatttagatatgtcatgagtccaaaatgtgcactgttccattttactaacctaatggcttaaatggagaacctgagagagttttagaatagtaaagttacttgtcttggtgtcatagttcaaaactggacatacagaagacattttacatgagcatggtgtataattttgtaaatctatgttttatttaccctttcagtttcatttttctttgtcttttcctgtgtttttctgtttctttttctttctgcaagttgcttaaatatgcatttgaaaataatctctacaggctaaaatgattggattgtacttgttaaggttttttctttgtgggttgttaatgcacacatcagtgtaaaagcaattttcacccttcaaattacgacatattttaacatcttttaaaaatactgattgctttctttgtgatatttacaaataacatgacatttaaacatatatttaaattcaaccgccttcagattatataatgcatttttcattgtcatttattattatggtttgttatatttcatgattatttacaattatcaaaagactcaaaacaaaaatcaagcatattagagtatctgttttaatgaatcagcttagttgatacaagtgagaacacacaaagaaattgctagaaaaaattatcagcaaattattctagttgttataaaatgcatattaccgaacagtgatgcctttttttctgccttacctttgtgtcctccatcccttaaaagcattttctaaataagttgatgaataagttttgtgggcagtgatgatgagtatctttagatctttttaaagaaacaaataactgagttagaacatataaatatctgacagaaagtattataaacatctaggcagatggtaatgtgaagaattaatacagatctggacgattagaccaaaggaatctgctattagttagaacattttggctgtggttaatattctgagtttggaatctggggtaaaggaaggttatattaaaaatggaagtatctgtagcagtttaccttttgggttcttgattcatatatagatatctgggctttagagttaaagaaatttcctttagcaagactttctgaatcatctaggaaaaggcaaagtattatatatc

SEQ ID NO: 121110 - DNA, 2402 bp, Homo sapiens
tatcttttggataaaaaccattttaattggggtgaggtaataactcgtagttttgatttgtatttctctgatgattgttgtgaaatattcattgtttttgtagtacttgtcctcatgtctaaatgtattaacttctttgtatgctttttctacattgcctggagtactggtggtactgtaatgttaatgtattagctcttaaacactatagtacttttaaaattacctaaatggagaaaatccttactgctaagaggcaagctgtttttgccctcaagatatgcaaatgtgttattcagcttgaaagtatatagcatcctattaataataatgggatatcagcaacagtagcagctgaaaatccataaaagttatttgctttattatccaaagacttactaccttttcttttctttggtctattatgtctcttgacttctaaaaaatcatttagccaactcacagccccgaaaaaatcttgaagttaccaaaagaagaagacagtgccaacctgaagccatctgaattaaaaaaagatacatgctactctccaaaggtgaggtgcattgtggtctaaggtttgttgactttctgggattctttgtggacatcaaacatagggaatttaaggtgttctttaggacgaattattttttctgccaagaaatgaaataattgctgctaaaaaattgagttgtttagcttcatcagactattttctgcaaatgtttttgaaagagcttacattttaattgaataaaataaatattacatatttcatattttttaaggcatagatctctgcatctatttcgtttctccattaaacatacattcttaaggtcaggaatgaacacttgtatagtacttacctagcttggtgcttagtacaataattaagcattcagtatatactggaattaatggcagaatactgtatgtccatggatcctttcatctgttacatgtgttaggtgtcttgtcaaaatttttaccatttttatttaacatagtttcactacaactgagacatagatttaagaaggtcatttaggtttcctcccaaattatttcttgatttcatttcagggcatttttgtcagcgtttccaatttattaaatacacttaatctgattctctcagctgtcagcagtctattgaaattttattaaagtgactttctatttttttagtgaaatagttaaggggtgtcaggctatggactcattttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatggatttttctttcttccttttttcttctgttaataaaattgtcattttctacaaaaaccactaatgattacaaatgtattctttagttgtctggtgatttttccagttgtgaacatcaaattgcttttgaatttccaaatttgccacttatcttgaagtacttaattgtttttcttcttgctgttaaaatctttcgaacgtaaatataatattaaataaaatcagaaattttttttttacgttttcagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggtaagtagcccttcttttctcctgtgagtactacttaacccatgcataaagaatttttttcaaaccatattaagtaaaaatctaatctgtggctgggtgtggtagttcgcgcctgtaatcccagcactttgggagaccaagtttggaggattgcttgagtccaggagttcgagaccagcctggacgacatgacaaaaccccatctttgcaaaaaaaaaaaaaaaaaagaaaagaaaagaaaagaaaaagccaggcttggtgacacatccctgtggtcccagctactcaagaggctgaggtgggaggatgtcttgagcctgggaagtcaaggctgcagtgagccgtgaacatgccagtgcgctccagcctgggcaacaaaaccaagaccctgtctcaaaaaaaagtctctggtatgagcaagtatattttcaaagaaattttcattaacagtccttttctctttttggcaaaaaagttaaattggtgaagttattctagtagctggattgtggaaaacgtgcatacataaccataattttaggctagaaatcttctggtcggatatgatta

SEQ ID NO: 121111 - DNA, 1069 bp, Homo sapiens
acttgttcacattttaagcacaattctacaaaagcccagtaggtaaaatatattttaaaaaaagcagttaatctaattgaaatgagagtgagggtgctcatcccttgtcttcaaattcccttctaaaaagatttcttggaatatggtacaaaagttatggccaaataaaaagtataaaagaacaaaaaataaaaataaaacataaatgttatggccagaggccatgttccctctgagcctgattttatcatttcttttccaattttaagttggcctaagaatcttattaaaaataatattgagattaacagtataaggtatttggagtttgcagaacactttcacaggtattccttagaaataaaaaatgtatcttgaatgactacttaaaaatatgttttatatattatgtatatagaggagtttataatttaatacatgatggtatttcttggaatccttcagtttatctgttttgaaagattcttttagtagattctgcaacatgcacattataagctgtaagtttacttgtccagtaaatatttattaatcaccacccatgtaccagttagagaattctcctgattcgattttgttgttttacattttttataccatgtcctgattttcatatgcatattgcctgtaggtgctcttaaattagctctagaacggataaaatatttctgatttatatatatatatatatatgtatttttttttttttttgaatataaaacattttggaagtctttccaaagggtattttcaatatcttgagtttctctggcaaagtgaaactgaatggcaggtttttttttttttaatatctaaaaaacttgcatcagcaggagaagggataaatactattgatatattaatagagaaatactacacagcatacaacaataaaagtaagtttcaacatcaatatgaattaatctaaacattgagaggagggagcaggtcagaagcatacacgcaatcagtgtatttcatttgtataaagttgaaaagcataccaaaccagaaaatatattattttaagaatgtatttgcgtgtggc

SEQ ID NO: 121112 - DNA, 1076 bp, Homo sapiens
agaaagattagaagggaacacgggaaggtgaaaagatgagttgaggagagactattggctagagtttttaatttgtttggtttttggattttaatgtgttatttaatttttaaaaatagagaaagaaattcaaagtctaggttatgttaccagataaactgttaacttgccttgtattgtgatgtgttgatattcattttaccaaattgcttgggctttcagttttccaacctggaaaatgtatgatagccgaatatagaaaatttcttctaaaggttagatattatttctgtcttcgtgagctgctctgaatttgcttgatttcttgatctcagatttgtcttggttttgctgaatttttaactgttatattgaaccattctaactagagaatcttacatttttcttaattaacattgctattgcccttaaaaagtttttcccatgaactggtaggttaggtaacaaaaagcctgtaaacattagtcaaataaattatttaatcgaaagacttaacagtaataagtactttgtttttaggaaagaactggaaaaactgcgaaaagatttggaagaagagaagacaatgagaagtaatctagaggtaattaatttcttccagcattgagagtttagtgagcataaactggacatgtttttcccaacccaactgggtaatcggttcctgtacaaattatgctatactacttcagttggacatacacacaatggactactattcagtcacaaaaaaagaatgagatcctgtcatttgcaacaacatggatggaactggaggtcattatgttaagccaggcacagaaagagaaactgcatgttcccacttatttgtgggagctaaaaaaaattgaaacgattgaactcatagagatagagaacagaaggatggataccagagggtgggacggatattagtggaattaattagtggcaagggtattcttttgaaattggagtcagtcctcttaaaccctgcctctgctttatcaactaagtttatattttgtaaatcctttgttatttccacaatattcacaggatcttcaccaacagta

SEQ ID NO: 121113 - DNA, 2346 bp, Homo sapiens
tttgtttaattatagatacatgtacatttcttaatttggtttcaaggattcttttgttctttgtaggactgactgatttttttacagctttaattttaaatgctcacatgacttaacatttgttctggctgaaagggctataattgcttttttcttattgtaactgccatttaggaacttgcattgtactgttgaaactttattcaaccaaattatagcatgggaaactggattttaggtctggaaaaaaagtctgaaggcttgaaagtatgatcacatcttaatgacatagagtaaaataaactactaaactaaggatattttatgtttgctcaatttatgttttttgttttagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtaca

SEQ ID NO: 121114 - DNA, 2145 bp, Homo sapiens
atgcttatgagcatggaaatgtatttaaagtttttgcttgtgtcctcctcagtcagaatagaaaagtaactgaaatacttttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaattttttttctacgtgtgagtataaaagacaaaagttgaacagcatggaatctcattgccaaattattagtgaatgtatagttcaggtattctttgagacacacagtatcattaatttctgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgccagtcgtgtcagtctttattggttattttttgttaactttagcatttgtgtatttcagagtatgatgaaaattatattacttcaatttccaaatacaagaataaatagtaaaccaaaaacattaaaaattctagacccgtatgacttttactgaacttttctgagtctggtttttcatctgaaactgagacagtaatttctactttacaggattatggggagaatttgaaatagtttatctaaatggctttgtagagtgcttggcatagagtaggttttttttaaaaaaaaaatggaggctgctgttttacctttttaaaaagcattttacagtgatggatatgataaaaattagatggataaggttaagaaaaaggaggcattgtgtatcctttccccctgaatacggtatagtatccttttctttggggagatgctcctttcatttgtattatattgttcaaaggggagctgctaccatcttacagattctacctccttgatcaccccacccaggaaatcccttgagagagtacttggctcaaactgagttactgagttaatcaaagaatgaaatttttaaaattggaaacaaaaagagctaatctcagcatgggagctctccacagttctgtttttctgtcatctggaaaaagctgatttgaaaaacaaaatttagtagagcatagatagatggaaacagaatctggaaggactttgaaactgattgtagctgttgctgagtctcagctgtctattgcttggttctataagcacagacttgctcataagcttgttgggtttctgaactcacaaccgaaaaagtcctgataaataacagaaaacaagatgaaatcaggagaacattaaggtccacatacttttgctgaacatagatcacatatagctttagagattctagtagtgtgctggaagatttgaaacagaaggaataggacaccactataaagcaatgtggaaaattagtgtgtcataagatttttaaaatcttatttaaaaaatttctagttcttactggcttttagaagcactagacaaaaaactttggaggcatataatggtaaaagttttggactatagaatttgtgtttgaagagtgcagatggttttgtctgaaaatacaatttgcaaatttagcccagttctaggaaataaaagcaggtagcagtttaact

SEQ ID NO: 121115 - DNA, 1045 bp, Homo sapiens
ttatgccagtgatggtgtcattgtctaggatgtatttgcaactccccagttgggatccctttggattctctgcaatgctattttgaacatctttgaaagtagcagtgtttcatcctttgagagtgtgtttgattttgtataagcagccctaaatcattcagagttaaagcacatgaacaaggtgaatggccaaattgcataatatagacagaaatactgaggcttgggagcttcctgcactgggaaaaagaatattccaaattgtgcaattgctgattttccaatgtgactgctagattcacattcaacacaacttcagaaatgtccacattctagtaatgcttgaagcattggaatcagtacctagtttgacactgattttcttaaaaagagaccacttttaaggaaatatcaaaatgtgtatttcttttaattaatttttaaattttctttagaaaaaaatcttagtagtaaacatatatcagcctctattctatgcattttacaaacattagttcactaaaccacataaccaccctgtaaggtaggtactatcattaacttcattttacaaatgagcaaactgaaatcaagtaacttcctcaaagtcaaacagcgaattagtattgagtttgacttaacccctactcagttcaactccagagtattttgcatctttctagatggcatcaattttgctactttatggctctgcctcctaatagtctggtctataccacgtggattcatgtgggtaacttctgtctcccaactcatattctcccacataatttaactatgtcaagttctgtcagggagaatggtatttcactctagatagatataatataggcaactgggagcttcaaaaccattagaagggatagaggataaaggactgagaaggtctccccaggctttcagaaagtcaggagttgccgacctgcagggcatgccagcagcttccatagcttcctccacactccaagattcacttctgctgtggtacatgtcttttgctttttctggaagaacacaagtatgt

SEQ ID NO: 121116 - DNA, 1040 bp, Homo sapiens
tagaagggcatatgatttgactttctgcattctatttgttattgttgttgttggagacagagtctcactctgtcacccaggctggagtgcagtgttgcgatatcagctcattgcaagctctgcctcccgggctcaagcaattctcctgccttagcctcccaagtagctgggattacaggtgcacatcaccacacctggctaatttttgtattttagtagagacagagtttcaccatgttggccaggctggttttgaactcctgacctcaggtgatctgccagcctcagcctcccaaagtgctgggattacaggcatgagccactgtgcctggatgactttctgcattcttatatgttcaaaatataatctgattgtcagtatgcatgaagaaactaggatgatgtgacggctagaaagaagtgtcaatagctttgagtggtaccaactgtctacatagcagtgcagtttctaatcctggacaaagtttattcttacctaaacatgaacctaactttttctttaatataataatttgttctcagaataatagctcttgataactgcctgcctgttttctactatcaaggctaaggcctgtatgaagctacccataagtgaatgagtcaagtgcaattcaatttatctcttttcacaggtcaccaagtgctcttacaaacaatgaaagaagaataaaagttcatatatgtatgtatttttatttttagcattgaatataattatacaagaaacatttaaaaaatgatggattctaattacagatattttcattacttgaaggagaaataatgtaatagttacagacaagtgtcctagtccagaaatccatggaatcatagacaattagagctgtatgggaccacagggattatcttctgtcaacccctaatttcatggataagtcagtgagagacaggggaagtaaaagaacatgggtagggtaaaaaattttacaggaaggattaaaatgataatctcttggctacaaagcagtgctgctttcattatactacctttttta

SEQ ID NO: 121117 - DNA, 1043 bp, Homo sapiens
ttctaccagaaatatttttattttaactgaagaaaaaacttgccaaagtgattaatatctaaatatacttattgctgcttggtagacactcagtaaaaatgataatgaagatgatgataatgataatgacaatgatgacaactaatgttatttctaccaataagtaaatcctaactcactttcaaagaactgtgggtcgtcttttaggccattagacaaagtttgattgtagaagtagcctaaagttgagagataaaattgaaaaaccatatatttgctgttaagatatccttgtatatgttgtgcttatcattatgaaaaatgctctaagcattcaaaaatgttttcaaggaagaactattttggttttcctaattaaacacaatgctattgttttctggttctcagatcctcgttttattattttttttcctactgtacctgtaggtgtctccctaagttcaggattattctattttcctgacactgtatttgaaatgatgcccatccaagaaacccttaggtgctataaacactctgagaaaaatcatgtctgtttaataatttacttagatgctcctaaggtcaccctttgtaattctgatctgtggtcaataaaattaaatgttgataattgtttatgaactgtgctacatgtcatactagaataatatgagattaatactgaattatattctgtgaatccatccctaactcacacagactcctttttaagttactagttctccatgaactgtttcctccatttacattcaaacctcttattgttatactgacctcttcttactatttaccataattcccctgaagtcctgaaaaacagggaaaggcagaatttaataacttctggcaggattattccaataccctttgattctgaaaccataggcaaaatattaattcagacaaatgctatgaattcatgataccatatacttttattggttgactatcatttgccaaattttaatatgctattacttttagaaaataaaaacaaagattttcctgtgattttgcag

SEQ ID NO: 121118 - DNA, 1032 bp, Homo sapiens
gccaattgtttaggggctttaattatatctacaaaatttctttccagcattattcagagattagtgtttgatcaactgggggaatgtgtttgtgtgtgtgctacagaaggattgtctcctttccatcctccaatccacaaaagagagggaatatcttatccgttgtatctcatcctaactggagatataatagaaagggaattttggagactgtagttcattctagctaaattgacacattacacattacaaaatcgtcatatcccctcactttatgtataggcaactgatgcagagaaaggaagatttaaccaacatgacatgatatttatagcatgtctagagcctggtttgctggctccagactcagcagttttcatattcatatctgaggaaaaccacattatcaagatttataactacccatatttgctattcattattctgcagaaaggtccaaaatttagagtcagtacatatatagttggtgacaaaaaatttgaagaagaatcacttttgtattgaatcaaacatttgcatcaaaggtatctgaggatgtactttctcaaatccagtcttaaaaaaattattctcagagcttcttctgttattaatgaatatgtcaactgggattaataaatatgtaagacttttccaagactgtaacaactaacagtaattgttatacaaagcaggcactacttttcctttactgtaaagactgctctgattatagacaccattgactcttcttcccaaatgagtcaggagtaaatagactcaagtggaacttctggctataatagatggagttccataactacagggaaggcaaacaaagtatttctagcaatattataagtaggctagtggcatcacatcatatctatgtgcagtgttctatcaaaaagctaatctggagaagggaagttcatttgttgagccttggactctttcaaagtcttgcacaaagtgttgttgaaaaacatatagaaaatatatataaaatatagaaaaaaagaactccagact

SEQ ID NO: 121119 - DNA, 1822 bp, Homo sapiens
tattttcatttatagaaaatctatcagttgtccaaattcaaagtgccatcattcactaactgcagacaaaatacctaggagaaaatagttttttaggctcaaacttatcacatcatactaaatttaacacacataatgacaactagtgaaaatttaggtgagagaaaattatggcttaaggctcagaagttctcagtcaggatatccagcttcctaccacaagcaacacatagaggcatttagaaaatgggcggagtgttttgttttttaaataacttgggctgggaggctggtgctgatgactattagtagcactcccaatcaaggaagaattttttagccccaaatgccagtagtataccagttgagaaggttttgggtaattgagtgacaaagaagaaaggatagggttttatttccgtgaaaatggaaatagtggctcttattaattaaacacattctttcaacaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttc

SEQ ID NO: 121120 - DNA, 1030 bp, Homo sapiens
taaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttggcatcttcatcatgaagtctttgcccattagtatgttctgaatggtattgcctagattgtcttccagggtttttatagtcattatctagtaataaacaatgatttatctttactttctgactgtttagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggtattttttatctctatttttctagtactgtgatgggaatcttgagtaatgatagcttatttgtggttctaaagataaacttgtagatttaggaacatattatttcctggtgatttcactaaataaattctacaaggtctaaaagtggacagtgttgttttgcattcaagttatattgcaatttattatgtataatttaacttaacactttacaaagcttcaatgagagaactacctccttgcaaaccagtaacctatgctagatgtttaccttcattctcaataaacagttatggagaaggaacaggataaaagtaataaaactcataagtggagtagagaacagtggtagtaaatacacagtgaatatatcaaaacctagccagagatatagtgagtactccttgtcctggggggtggaatgagtcctttagtttgcttgcttctatttagaaggagctacc

SEQ ID NO: 121121 - DNA, 1131 bp, Homo sapiens
cgctctcgagattatttttaaataaaagtatagcaatatgcatattattatcaatacattgttatttatctaaaggaaacttaaaatataactaaaatattctctaagttttgattttttttcttgtcactattaatctttagtgttccttcaaaatacttcatatgaaagacccacttgtttacaatgtcttggtactttagaaaagcctaagtaacatgtgctacttgggaaggtcagcactattattgcccttcatgtttctgatttgttaggattataccaaatgtaatattattttaggaaatcctgagtgaatgaatgaattgaatgaataaaattcctaggttatatattattcttttcaattttttcctcttaaatttggagttaggattatggaaaaaaatgccatatgctatgcatcagggtctaatctcttgatctctgttttattctctcttcatgtaaattgtccctttccttgactttttccatagatcaaatccagcagggatcaagctttggctgaacgttgtcttgctgcactaaccgaatgtgctgctagcggagatggaaatatcctggctcttgcagtggatgcatctcgggcaaggtgaagatatataagtttggaggtttccaaagactaaaagttgaccagtttagcttttcagagtatacttaaataaaaggttgatcctgtaaaccatgtgagcccaaaagaaaataatggcatccatcgtaaatttaattcttatcattttaaaatttctgtatttaaaacattcatgttttgagtgaactgtattaataattgtgtattttactgtggctgaggaattttgaaactattgaaatgaatccatttcactgattcgcaggttgaaatgtgttggactctcaagtatatcaccaggtttatgcctattaccttggtattttaccagttaaaatggctgtggggtggggaggggaacattaatctgagaatttataggaaaaacttgtcatcccattgcttttgaattagttttaaccatgaagcaaccggaagagcaaccaacttccccacacccccctcccagtccttcccttgttattggagccatgtgttcctttaggagtaga

SEQ ID NO: 121122 - DNA, 1026 bp, Homo sapiens
actaatagattatagaagggttctttttttgtttaaaagtgactggctgaattcaaaaaaatattagaaaagctactgggtattcattctctaccttataaatcttagatggcagctgctctgattgttatttcgaagtgttaaaagatttattagaaaccgtgggaaagtgtatattaatagtttggtagaataatgaaagtccttccttacagagactctgacatatacctctactttcctctcacacccccttctcagattgggatttgctgatctatattgaagttgcattaagaattaagaatactacttaaagatattaaatttataaggaaaatacatcataaccagagcattacaattaggtaattatttgtgaataaaatttttctttgggaaattaccaggttctgaagtaattgttggagtaaataagtaccagttggaaaaagaagacgctgtagaagttctggcaattgataatacttcagtgcgaaacaggcagattgaaaaacttaagaaggtattaatagcttgcttttttttttttttttaagtattttctgtgttctgggctctggctaagcttttaaactgtcctgcttaaattaatccttacaacagcatgaggtgtgtattaatttccatcatttcaaatgtaagggaactaaagataaggcattgagaaacttgctcaggataaatagacaaccaggactcagtcttagtctgttgacaccaaaaacttgttttaaaccatgatatctacctctgtgaaacttataagttgttattaaaaaccacactacaataataataccttccataatttatagattaaaaccaaggcttagatgattatgtaacttactaaaaattaaaaacagaataaagtttagagttattatttgaacccagggcttcttattgtaatttctttcaccagaatgatggcatctgatactactttgaaataattacttgctttttgatttttaaaattcaactatatttggtagtgct

SEQ ID NO: 121123 - DNA, 1101 bp, Homo sapiens
gtcaagatttatagattttaaatttataaatcaaatcacttacagatttatataataatttaaacgatgtttgcaaaaaaaattcagatttgattttatagttttcaaaacaatccatttaaaaatacatttctattaaagtattttattaaaagaattaaaaagacagctagtattaaaaagctcatacaaagaacagcagtttttgatcatccacttgttttttcctgcttcctggagtaagatacatacttctttgcttatttttgtttttatctgcatagtttaaaatcacatgtatactatttcttgtaattttatcaactgtagacattacacatgagaccttagacactatctattgctttcctagtagggtagtttagattttggctgattcatacccctacttttcctcctcccttactaccaatataattatatctcaatgtaatcttttctgaattcttctaatgttctcatttgacttaaattgttttttctctatttctgctcactattgctgttctttgactcctctttgccattatagtaggaatatattttcatttctcctctgtttaattctgaatcttgaatcccatgtctatctcttggttatttggaagtacatctcatagaaacctgctaaaaatggtgcatgggagataaattatttgaaacttttcctgtttgggaatgtctttattctatttttataattgattaatagcctgactaagcttgacattatttccattcaggaaattcataagcaagtttataagcattgatctgttttttattctagatttttattctggctttcaatatttctgatcagaaatttgatgccattctcattcaggatctttctttctgaaagtattgggacctcttctttattttttgtattgatgtataacttggtgtattttttcctacatggtactgaacctttattgggtctttttcatctcacctttttttaaaaaatatttttatagctctaggaaattttcttgtattatttctttgacagtatttttcttgtcattttcatatgggttctctttctagaactcctagtcataagctacg

SEQ ID NO: 121124 - DNA, 1050 bp, Homo sapiens
atataagataaaagggagaggtgaagggcacaaattggagaagtatatgcctagaccaatgcacaatcattcttttacaaaacacttttctggctaaacaaagcaaatttgctgttttatttcattcataggtgactcctgtcttacatattgagtattcctaaaatatacattttttaaataaattgaatctttatttaatgaagggcataggaagagattctttcattaagaaaaccaattacaaagtgaataattcttacctgaagcaaaatttcttccatatgcataaaactgtaattttatgttaggtttaaagttacataaatgtacgtgcactgatcttaattcaaattaagttcttcgaaattaaaatatagaccttgattttctagtgtgtgatacaattagttttattttctgctctatattgttaactttaattaaattctggacctaacgttactattttaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggtatgtatataatttaaaatgtagaattttaataaagttatatatatatattttttctgagcaatgtggcacaagcaggaaatagaattaagaagctatctgttaatatttgaaatgataaatattctgaagcataatgtatacttaggtttgtaattatacataatataataaataaataaataaaaattgtctccctctggtggttaacaatataaaatcacttacatcctagcttccctgtagtgctgaaacacttgtaaaagtaaacaaggctgggcgagttggctcacaccagtaattccaacattttgggaggccgaggcacccagcctggccaacctggcaaaaacctacctctactaaaaatacaaaattagttgggcgtggtggtgcatgcctat

SEQ ID NO: 121125 - DNA, 1048 bp, Homo sapiens
tttaaaaattttgtacgatggtcataattctgttttccagaatatttgaatagccaggaatcctttgtgaccatattagataaaagaacaaaatagtaagcaagcatacaaatgctaagttatttttgccatatatgaacagccagatcttttcatgaattttagaaatatttcaatcaagtaccatatcttcagatagatacgagatgattgagatttgttgtttctcccattctttcctttagtgaggtctggaactaaatttgtgcattttggcacaagggaaacaactgactctcttaagaagtgaagtatctttatttaagttggttttgacatgtatgagcataaaaatagttgttataaaagtgtactgttatgagatgaatcaacatttttagtagtgttaaaagtaaatcattttaccttgattccagactcttgaatcttacattatttttctttatatatttagctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaaggtatactttgtggttattataggtttttctatagttccttgaatgtaggaatttttacaacatgctataactgaatttaaaaatttagtctgagtaatataaatttagaatgttttgttattgttactttttgtttttaatgtactaattttatgttctgtcgttacttgcaggaatctgggcaacagatctttactgtgttttc

SEQ ID NO: 121126 - DNA, 1347 bp, Homo sapiens
tgtcttattcatcacttttttctctattacccaacataatgtcggtcataaactgatatttaataaaagcactttgaatgaaaaaattaattaggaggctgtagtatatcttccacatgatacagagtctttgaaaaattccatgaggagtgtgacatagtcatatttacattgatgtcattgtatggaagggattcgtatagaatggagtagaaaaggagtaagactggtcagtaagaccagctaagaggctactgaggaaaaagactgaaactacaggactgatagtaattgtgaagaagaggggccaaagttataaaatatcaggtgcaggaagcagaaaaggggaagaaatgaaatcagactaatacatcctctttcttttctgttcctttcttatgagtagctcctatttcccaccccctcttctaaatgtttttactctatgtttctttttctaggtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaagggtgagattttaatgtaagacataatatttatgataagtcatatgcctcctagttttttattttttgggggttaatctctgtaaagatgatattcactctataattttgtagttaaagactatactctgaaaaaagtggatttttttaacttctgtggtcaaaaagataagtgaattagaataaggtgctaaatttttgaaagaaaacaacacatgcacgttgtttaaaaggaattaggtgaggtaaagttgcatgaagaaaagaagacattagctttgccttcgaaaaatgttcaattaacattgttgggatagcgattggagaggaagatagtttagatgatgcccaaagaaagtgtaaatgtgataacgtggtacaaacatattcagtgcaacctggcattcattcactgaaaattatcttaactattatttcttctttctgagctgtaataaaattgta

SEQ ID NO: 121127 - DNA, 1079 bp, Homo sapiens
gaagaaacaatctgcttctggttcacaagaaaacctctgaaatttaggaaaaaccaaggagaaaaaaaaaaaaaaaaaaaaacagagagtgagggataagtgatgtctgaagtgccaaatttggcatcaggagaatggttggaatagatcgtgaactcttagcaaaagagaccattctgggcttgctgagctccggcgcccgcggagctcgcaccaggctccccggaaaggacggggcgtgttaccggggagcagctgctctattgcgcctcgaggctccgatcgggctaggccggcggcctcgctccctcccttcacctttcctctcctggcgggcccggcggcgggcaagtgactgcccgccatgcctgaaaggcgactcttcgattcaagatgaccagagaagaacctcttcccaagaaagttcgactgagtgaaacagacttcaaagttatggcaacagatgagttaattctaagatggaaacaatatgaagcatacgtacaagctttggagggcaagtatacagatcttaaactctaatgatgtaactggcctaagagagtctgaagaaaaactaaagcaacaacagcaagagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatcctccccagttaagacttccctgacagtcccactacgagaaagctgtggtgggacaaccaagtactcgtttccacaccaagactcagactttttgagccaaaaaaaaaaaaaaaaaaagccacattcttacactgtccagcttgtaatgtttaatgtaaaacttaccagatgaaccttgtgtttcagcttttttcttttccccttccccttgcttcagac

SEQ ID NO: 121128 - DNA, 1038 bp, Homo sapiens
ctcctactcctcttcatttttcttcttcttctctggcaaagcaatatttatgtttcaggaataacagtattaagtgctatggagaagggttagagggttgagattgaggttacattataaagacaagttgaaagcttcaatttatacttgagaataacaagatatgaaaggattttgagaaaatcctttgttcattagataatgtttatttaacaagatgagtgttttcaatgagattatactgtggattttattgaaaagactttaagaagtaaggtctctgttctttaaatcctgctgatttaaagaaatattattaaatacttttaagtccatttttattcagctttgtctacttgccattggttataatagacttaaaaccttaaatcttattcctttattcttcaatttttgttttaaaattttggcaacattgttttctttgtgcttgttgttattcatagatcccagcagaatttccaattttttttatagtcagtgccattggaagaaaccataatatcattgtcagtgggaaatctgttagcaaggaaatctctgcagtgacaatgtggcagtacagctgtgttgtcttctgtgggtcagaagtgatgtgactgtaccactcagtttactcagcacagtctgtttatacacacagtcccaacataattgtaatagcaccaactcttgatttgaacagtaaaattttgtggttactcacgacttacaaatctatatggaaggttgggtgcagtggctcatgcctgtaattctagcactttgggaggctgaggcaggtggatcacttgaggtcaggagttcaaaaccagcctggccgacatggtgaaacctggtctcaaccaaaaaaaaaaaaaaaaaaaaaaaaaaggctggttgtggtggcgggcacctgtaatctgagctacttgggaggctgaggcaggagaattgcttgaaccagggagggagaggttgcagtgagccgagatcacgccactgcattccagcctaggcaacagagaaagactctat

SEQ ID NO: 121129 - DNA, 1001 bp, Homo sapiens
aagagtttgctgttacacgtcatccaagagcatgcagaatgaactgaggccttcaggtcattggtttaagaatttatctgtaatatgaaagcctaaaatgcagacagttctatgtatctttttacttgttttcacctttctttcacctgaactactgctacagtacagcatttgacatttggagctgtttctacatatgattcttttaattaccataaaatttcatgcttgaatatttatactttttaacatttattttatgtttttccatatgttgaaggcttatctctggaatagagtgaaaagctgtaaggactacagtattggttttaaagtcagtgccaagcgcatggaaatgctgaataaatgttcgttttaatgtgttggttgcatttgttgaatagaaccagcaaatatattttttgcacagaagaatgaaattcagggacacatttatactgagaaaatatgtgggtagcactaaaaagaaagtagcaaaagaagaaaagataaggggttaccctcctatttacccctagatctactcaaatggtgttctatagtaagttttctattggttttaagaattattccaccattacaggtatttatgctatggggaaaacattctgatatgttaaaataagcacatgcctaattgtgggacttttctggacttgagcttttggtgaggatcccatttctttggaatccataagggatgtatgttccagagtatttgatgaaaattatattttatcctaacagaagggaataaagactgaagatagtgtcttagtttgggttgtcccagaagcagaccctgatacaaggcttagaatccaagtagtttaatggggggcgatcctataaaacaccagtaggaaaatgaggaagtatcctaggaaaagaaataaggccaataagggaagtgttatcaaactggttaccactgtggaagctggcgctcaagtctgatagggaactgcgggagaccatgg

SEQ ID NO: 121130 - DNA, 1032 bp, Homo sapiens
ctgaggtcaggaagatgagtagcatggagggctgatatgagcactaggggtgggctgtgtctgttttacgtcaagattaacatgaggttgaagtaatcaggaaccctactgtgactgcagagtcacagaggccaaaggtttttccttatcttcttactgtgcatgtttctcaggataccagtgtgtcaggaccatccacttcttttgatttcctggagtttatttcatattccttttctataccatgtcagcattggtctctctgagcaccatggtacctgcttgttccaatcgcagctcactgtgaggccacttcttacagtaaaaaggagaatctggctaaataggtctcaagagtgacaattttgttataaattgctcttagtagatcctggtcaaatccaggggatcttattagcataacaagttctagcccctgccacaagcccaaggtggccatggatttagagggcgaggcaatggtcctgagtccaccctttgcctctttcacttgtgcctaaccataagtccagtgagtcggacctacaggctagccccagaactgttaaattttaatagcatcagagagagagtctggtgctcccttggtctttttttatgtctttgccaaaaggattgtcgtatattttatttgcactgaattataccattcaaattttatttctgatttgatccattcataaatgtaacctaaaactataaaaacttgagacggacagagattcctgagattgttttaccacttcagccgaatacagccataaataagagtaaatagttaccattaactttatggctattcacttgatatgtattctggaacaaaattttaatctgaattgctctctttccattacttagcctgcttctgaagaggctgtcttgtccataggtcatattctgttcatgaactgcaaaataatctgaatactcaaataaactaaacgtaataaaaaccatttatggtacaaagaaaaaaaattaaatcatgcagctatagattttcttccc

SEQ ID NO: 121131 - DNA, 1049 bp, Homo sapiens
ctagattatttgaagtatttagctctaaagaagtgaaatgggaataattttgacagctgctgaatcatgagtgtatggtagttttaagctgactcaaatggcagctaactagcaatatctttggaccagatctcatagcttgtgacctctcattgacattttgggctaataacttcttcttagaaagacttacagccaacagagagtttgaaatatatttaaattaaaagtattattaaaaaattctaaaaatgtccattctcatttatatacatgtactcttcccaagctctttttaagtgttcaatatgctccagggaagcaattgctgatgcctcctattacttgcaaggttgcttcactccagttcattttccttgttaatttcatgaactattggattcctacaatacatttcctattaatattggagcaaggactccttggttatgctactcaaactaccattaagtcagcagcggggctgtttataatgcataataggattgctcctgccctctttaatttccaggtaatgattgctgaatgtctagggttctgtcttttacttattccaaatgcattgtatatatttagccacacttattttcttcctttgtcttaagtgtcctaactccatgagtattaagtcaagtaattcagtcagacctcattggcctcttacttgaacaagtaaacttcagggagtgagaatcattgtggttaggattgcactaactctgtattttgaatgcatgtggaatcagtgctttggcattctgttttagaagccttagcgatgcactggtagcactgaatagtctggaaatttttcatttttgctttctagacattcattattctacctgacgttaatgagcccaattccagtgagtaaaataataatatgtagggatatatttttatttctaatcattttgattgtgcagagcatgactttttcttcattctcagggatgcagcctgatttttattattttagtgtttttaccaaggatgttttaaatgagtgttttgagagttataaa

SEQ ID NO: 121132 - DNA, 1058 bp, Homo sapiens
ctgattgaaccattttagggactgttcttagaggagatcacatctgagctgggccttaatggaagggtaggattttgacagacagagtattctaggcagtgtattctaggtagaggggtggctccgaagaaggattttgtgggagattcatgggatatcaagttggaaataaaaacaagagctatcgtttattaagcctctatttttcttatacagatttataggtgttttatatagaacattctatttaatctcattagtagtctcataaagtgagcattattatccagttggaaggaagagaaactagaggctcagcaaggaagccaggataggattttaactcaatctcagacccttgcatctttctgtctcactgtttgggagcttttagactatggagggcttcagttactagctaggctactgagtttagttctcagtttggcaccttgatacctttaggtgtgagtgttcccatttccaggtgaggaactgaggtgcaaagagaagccctgatcccataaaaggacaggaatgctgagttccgccagaccatgcatctcttgctagtaggtgaggcgagtctctaactgattgcagcgtcttctattttccaggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacacgtaagtgcaaatgagactgattttcacattctttggaaaaatatgttaattcattctaatcataaagtagaaaatgtagaatacatagaaaaaataaaagggaaaatcctcttaacaatgaaaatttcactttacctgggagctcatatctttcttgttttggactaggttcacctttgtggttgatggtcctaatattttgcttccacgttctcat

SEQ ID NO: 121133 - DNA, 1076 bp, Homo sapiens
aatgtgttccgtgaacctcactgcaattttatgggaagttcagcaccttccctaatgttccctaatgaggtgcatcccaggctttcatgtgatatgaatcatttaggcatcttgtgaaaatgcagcctgattgagtaggtttgggatgggggctggagagtctccagttttaacaagcccccaggtgcgaacaagctagatgctgctgttcccaggaccaaactttgagcagtaagattctcctagattgcaggattgaggggtaagaaagagccaactttctcattctaaatcttgctctatccatacgtgctgcctcccctcctgaggctgttgtcctctctctctctctctctctccatatatatatatatatgctccatgtagacatcataaacctgttttgtatataaagaggtttaccttagacatggaaataatggaagagaattaaagaattaattaaagaattaaagcacaacatacacattgaaacaatttgaatataaagctcatgactcttagttccctggtcatctcagatactaggagtttctggatggcagctctcatttctcttctctctagggttaactgaaattcctattattataattattttgaagacaagatcttgctctgtcacccaggctggagagcagtggcaggatcatggctcactgaagccctgactgcctaggctcaagcgattctcccacctcagcccctcaagtagctgggactacaggtgcacaccaccatgcccagcatttttttttttattttgtgtagagatggaggcctctttgtgttgcccaggctggtcttgaactcctggcctcaattgatcctcccgcctcagcctcccaaagtgctgggattataggcatgagccactgtgcctgaccatattattttttatgtgtagcaatttccctgtctttaccctggaataggctctgtctttgcacttccaaaaaggtaagttctcttcaagacagaagtgccatctggtctgatataaaatttgcagctctcttggaaggagaaaactgttatggcaattttttttttgg

SEQ ID NO: 121134 - DNA, 1323 bp, Homo sapiens
ggtgacccagattcaccagagaaaactgctaaattatctgcgtgcctcattccaaaagagaagtctgtttacatttaggtttgtggtctgaaatactgtagttaaaataatttggggagcttagagaagtaagtttttgtatcttgaaaaatggcaccttattccttaactcccctggataaatgaagtggcaaaatgaaagggtggttttcaaaaaggacaatttggtaaggattgttgaaattgaatctcttctccgccatttaccgaataacttcaggtaagttttatgctactctttatttcagctgtaaaatggggatgattcctgccttgtaggatgcttgtgaaacataattgggaaagcagatggcaggttcccacctggtgtattactacttcatggcagtggttttgattactgcaagttcgagggcccattaaaacaaagtgattcattttgacaaatgtttatgaaacatgatcctttaatcaaaaccatttacaatgatttcaccctggctgcattcctgaactctcatctcttccctgcctttccactctctgatggttcccacattccggtcagtgtggctctgaggcaagcacttcccccagagaggaccctctcggcgctagctcggcaatgcatttttcagctttctcctgaggacagtgttacctcacaacagggccgggtggtaggaaaacatcaagggggataaagaggagaaaggttcacagaaacgagtgaatctgccagccctctctttctcatgtctcctgaggagatttcagactacaccagttgtcctaatgattctgagcttgtgaagtgagctctgcctggagggtttggtcagtagaatatggcaagcacaagagtcacctgtgtgctggctgcctcaggtgctcagccctaacaagctctgtgcaagctctttcccttccttgccatcctttcctttccccacttctcaagagccaggtaacgccatgtctgctgtacatgtagggaagtggggagggtggagcgttaaactctggttgcataggaactctcacctgagagccaaaaggttggcagggtgacatgagccctgcactggtaagcaaaggcatgtgcatctgagttccttttctgacactaggtaccagagttaacatgccaagctaggctggccacttagaggaaagtgcatggtttctacatctggaaaaggaggtggttgaactacgtgatttctgaggtcccttctggtaatgaatgtgattttctttctttctttttgaaattgagatagagtcttgctctgtagccca

SEQ ID NO: 121135 - DNA, 1813 bp, Homo sapiens
gccactgtgcttgtttgatctcattctttttaatgactgcagggtttccatggtatggatgggtaaaaatttaatgaaattctctgatgatagacatttgggttgttccctgtttacagtaaaacagtattaaatttatcagtgtgcactcatgcaagtatagctataaggtgagttcctagaaatgggctccctgggccaaaggatatacgcttttaagggtttagtaagtgctgttaaattgtcccgcattgacgctgaccgggttactattttacagtgaatgggaatgccaatttcccacacgctagtacaatagtttagctttaaagggggctcctcaagggtagcactgccatcagaggcagatgtgtgtgtgagaaagaatattgaggggacgcctctactgtattaatactatggattttcctagtatagctgtttcctgagagcatttgggtttgtttactcctcttccccctttcttctgtctggggcaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaatagtcatagtgtgttttttatacataacattgaattgttttccttgagagcaatcgtgcagggtttgctgctcccgcatttgcagcaaactaccacaaggtggcagcagcctgctgtgatctctgggggtcatgtcttctctagaggcagttttcttcttcagcagcaccagcgtttatcagtcaaaattgatagtatagaccaaaccctgccaatttaaaatagctaaatggccacgggaggctagtgagtaaaagttcaggagaagaattgcccctctgcctggcgctttttgcctgaatctaaacttatccttcataaagatagaatacccgatacgtcagacacctcaaaatcctgggagttcttgcccataatgagatcttgttacagtatctttttttttttttttttttttttttttgagacagggtctcgctttgtgcccagactagagtgcagtggtacaatcacagctgatgacagccttgacctcctgggctcaagtgatcctcctgcctcagcctccctagta

SEQ ID NO: 121136 - DNA, 2440 bp, Homo sapiens
gcatcagtgacccctctagcccagccacacttgccttggtcttaggttctggagaaggagaagaaacgtaagaagcgaagtgaggatgaatcagagacagaagatgaagaggagaaaagccaagaggaccaggagcagaagaggaagaggtaaggtggggcaagcaaatgagattaaaaagttagtggccaagaagttgggggtgcacgcctgtaatcttagcaatttgggaggccgaggcgggtgggtcacttgagtccaggagtttgagaccagcctgggaaatatggcaaaactgtctctacaaaaaatagaaaaattagctgggcgtggtggcggacacttgtggtcccagctgctcggtaggctggggtcggaggattgcttgagcctgggaggcagaggttgcagtgaaccaggatcgtgccactgcactccagcctgggcgacagagagagatcccatctcaaaaaaaaaaaaaaaaagtagtaagttccagtgggactggggagagaagtagagggtagaaggtggaaccagcgctgcttattgatgtcaggttgttcatggagagtgttcctagacctgcggggtttgaggatgaagataacctgggtaggctgggcgcggtggctcacgcctgtaatcccagcactttgggaggccgaggcaggcggatcacgaggtcaggagatcaagaccatcctggctaacagtgaaaccctgtctctactaaaaatacaaaaaattaggctggcgtggtggcaggcacctgtagtcccagctacttgggaggctgaggcaggagaatggcgtgaacccaggaggcagagcttgcagtgagtggagatcacaccactgcactccagcctgggtgacagagtgagactccgtccgtctcaaaaaaaaaaaaaaaagaagataccctgggtaaaagagaaggagagcgagtccttcttgtgtgcttttgacccctctactgaagaaatgctaaatagtaggaacagcaacccaaccactgagggttttgaatatatacttcaaaattctaagggaaaaaccttcatgcttatagttgaatttataagggtgagtgatgtggaaaagagcgttgggaagcagcgcctgtttgtgttctagtctggggacttggtctcgtttggaacaagcagcagtttgcaaaggcctaagcctagtgcttcactttgacttagtggttctgtttccttttctccgtagttagaggcacgtgatggggcttccttgcctttctgtctccaaactctttctctctcttaactgctgtgggtattttagaaggaagactcgccagccagatgccaaagatggggattcatacgacccctatgacttcagtgacacagaggaggaaatgcctcaaggtgagtgagcccacttactgatgaaagaggttgttcctgtgactcttggacttttccagttgctctgtgcactttattttcttgtggactcctgtttgtttggctccctgcttggggcctatgtccaagaggtttgtcccaagagagcttcaggggaaactttggaaaaagctttgctatattatatacacctccttgatgaactgtgctgtgctgtttcacctggtataagcatttcagataatatatacattgagggtctcctgcctgactaaattccttcatcatccaatgaagatttccctatatcctaattgttctgcctggccccataagaaccctaggaaataggagtgttcagcaggctgagtgagagattgggagtggagatgatttctctagtgtttgtggaaatggcttcaccttgcttatcttccccatctctacaaccatcaaccctctgaagtacacactccaaagacggcagactcacaggagaccaaggaatcccagaaagtggagttgagtgaatccaggtgagtacggatgttgctcctgccccttcaagaattctgtgtatcgctgaggaagggactttgttcccttggagagggtgggaaacaaactgctggtcatcaatagaactcaaaactagaggcctgcagcttttaacattttatattctcatttaatttcaaacttactgaaaagttatgagaaaagcatgaagaacttctggatgtcctttacccagaatcttcagttgtttaaattaataattctctctttctgagagagaagagttttacaataaggataaaacttaatgtcttactgtaacctcagattcttcttggtgggatagatacattttggccatttgtttttgaaatgaagaatttttaccaccagggttttaggaaacatttttatctatgaattttgtttactggacaccaagaaactccatagccaagttttacgttttttctttttatactttaaacacataatacagtgtatttactgaaaaaaat

SEQ ID NO: 121137 - DNA, 1086 bp, Homo sapiens
ctccggactgagtttactgaagttacgtttttgtcctcagattacttctttcctatccctcctttagtgtgactttggaaaatctccttgaaggtctttgagtcccatttccttcatgtataaaacttctccaagttattaagagggtgaaatgacagaatgtatataaaggcaaacttcctgctgcattgcaggcctgcaatcactgatgatttttctcccttctcttttctacgctgtagctttttatctttccagttgttagatgcctaatcttccctgttcacttgctcctccttcctgcaacactcttgtgtatatttccttgatcattgctatcatctttctcatttttatatggtatctgtagagaacacagaactctgaattctttgcttgggcctcctggggcttttctggtagtgtcatttccctttctgtgcagtaggattgatgggcatgcctaaaagacttgggataagcaatcctcccttttcttccctagacatctccagttacagcccgaacactggaaactctgattcgactggccacagcccatgcgaaggcccgcatgagcaagactgtggacctgcaggatgcagaggaagctgtggagttggtccagtatgcttactttaagaaggtgaggattcagatgcctgggcatgagaggatctcctggatatattacagatgcatgggcttcccagccttccgtggctgacggctacatttggattgtcaacagaaagcagtatttgtcttccagtcatcagtctgcctcactctttcctctgaaacactcagtgattctcaaccctgactgcaccagagaatcagatggaaagctttaaaatgctgattccagggctcctagagattctggtttagttgatgtgctgtactttcagttagctgcttctctgtctacccctacttcctttgcatcttaaaaaaaaaagtaggtgttttcaaaagagctaccttggtaatcttccttgtcccactctacctttcctcttggtagtctcttcaaatgtcccattggcacctcagaagctcatgtttaaagttgaactctca

SEQ ID NO: 121138 - DNA, 2947 bp, Homo sapiens
gcccaggctggtctcgaactcctgggctcaagcagtccacctgcctcagactcccaaagtgctgggattacaggtgtgagtggatgtgcctggccagtttctaagatgttatgatatatagatcattgaccattttagttgaggttttacttgtatcttctgagtaagggactccaaaaagttctaagtgcttgtagcctaaccaacttgccctgtctttatgacaggtaggggaaagggatcatctttcagagtcaggtcctgccttgggaatgagaagagcagaataaggtttgggaagcaggggcctggttttcagacctacactcagcctgttagaggttcctgtagtagaaagtggggcttcctaggaagctcagttaaagaagggttgcaggtagaagagatgatttacattgtttaatggctttaaaacacttccctttttcactgctttttgtctgttttgctctttgaggtcaagcctttcattcccactcccagaactgcagcagccttgttgttctttcttcctattgatgtcatgtccacttctgttgtcctcgcattccccagtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatggtgaggccataagaatagtaagagtaactaatggaaaggcgctaaacagatggtagtttctcaggcccaacccaggtggtggtaggtgtttcagtgtccgggttgatgttgaagagccctcaactgtttagccacctccccttcttgcttagtggagggtatcctaaggtgtgtcttttgtccatttctgggtctgggaataactgagcatcttgtgtgagccaggcagttccactatctttatttgtgggttccatgtgtctgattctttttgggccctttctttatgaatcttggtgtctccccttcttgtgctatagaagaagcaatttcccctgggttaaactctttattactctcctttctcctaacttgggtataccagctatgcccttgggtagtgctgtggatatcctggccacagatgatcccaactttagccaggaagatcagcaggacacccagatttatgagaagcatgacaaccttctacatgggaccaagaagaaaaagtgagcattctcataactcttcctcaagggaacctgaaatatgtgttatattagagcatgtgtatatctaagcttagctaaggccttatatgcccaggtcaaagccatgcctggagtcataaccacgtggattaattttcttcttttctgggtccacaatatatcctttatcctggccagttgccttgtaaatgtttaggtgattcagcgcaggttcaggtcttttcttaaaatagagttttgatgatacgcctgatggtgggtgtgccttatatatgaaagatggcaagtgtcatgtagccatttgtgatgaagggtcagcagatagcaaacatttgagactttgtaggtagacttggtgaaggagacgtgtgatcaggtgctcaaagcatgaaatgtgggatcttacacctatttttggccatgatgcagtaagaagcatagcataatcttcaaagctgttggtttaagaatgtagaatttggagtcagaaaacttttagtcaacttgagcttctctgagctgtagttttcccacctacaaaatagagcaaataatacctaaactttctgcctaaactacctaacttacaaataatacctgtaataattaaataaaaatatgtgaaagagtcttgtctatgttccatataaatgggagttatgataatgggttctaggctttgttttgaccctggcttttctgagaggcaaagccactaatccaggcaggtggtaaggtgtggcagggagatggaattcactgtgtgtggctccagggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccagggtgagtgcctgggggagcctaggcttggggtcccttaggtatatggctgggcaggagtccctgctatctgggagctttgaaagcattttaacttagtgacttttttcctggtctgaagggcttcctgttatacaattttaatcatttccttttataaaggaaaatgaaataaggaccccagagataacatgtctcttattagttaaaatgacattggcctccagaagctgtgattcattcagcaaacataggagtgacttctgggaagtgacctagtctttcctcttacaagcaatgtaaaattaataaacactcttttcaaagagctcagatccggagcgggggaagcacaaaggtagatagaaagacttccgtacatatttataaatatttaccccagtgtggtacttacaaaggaatgaacgtgaaaggctatttgagcatagacgaataaactgttaatttcttttagacttccctgaaggggtatgaatgtcaaggaaggattcccagagagtatgatatttggactggactttgaaaaaatgactaacaggcaaccatgatggttattcaaagcaatttctggtaacctaatataggtgtccatgaatttgtctaaatcttttttttgttttgtttttgtttttgttttggtgagacagagtttcactcttgttggctaggctggagtgcaatggcgcgatctcaactcactgcaatctccacctccctggttcaagcgattgttctgc

SEQ ID NO: 121139 - DNA, 2969 bp, Homo sapiens
gtgtttatgagatttatccatgttgtgtataggtgtgtttcatacatttttattgctgtatagtattcatttatgtgaatataccgtgtttaaccattacactattgatggcatttttacactttaaaatttttgactactaggcataatgttgctatgagcattacaatgcatggctttgggtgaatgtttctgttgggtattacctaggagtggaaaaactgcttcagaatgtaagcatatattcagctttagaggggaagtaagaatcttaatttagatgttaatataaccatagtccattcagactatgggttgccccttccattcgatggttgttactaaaacagacaggaacacaaaaagctagagaaggtacttggctttttttgttactgaataataaaattttatgaagtcatcttatttgccatgacaggtgagtgtggcatttttaagacaggacggagatcactctgtccctctgtgtgcctttttctaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggtaaagggtctgccttaaagtatatggaatgctgttgacagcttccatttctggtaatatcctttctccagtttgccatattccagagagttatatctgataggtggagcactctacctgcctgggagacaggataccttcaatacctcttttctatcagataaagctggtgatacttaaccatcatatgccaaaaatgagagttattggtgacaatgattacagcctcatggctttcctgggagtttctcatttaattacacttcgtccccatacacagttctgtctgaagttctgtgggtcaattccagaggtggggcatgatcagcatatttggatcacagacagaaccagttgtttaattcacaatagctacctgccccctccccaccaactctaattggctggtctagtttggcagcctaaaaaggcttactcctgctaggggtactagctactgatgttaggaattgaatataacgggtttcctctttattctgtttgtcccaggactgtcctgattgcctgtaatgttaagcagatgagcaaggatgctcagccctctttctctgctgaggatatagccaagatcaagaagttcagtaaaacccgatccaaggtctgggcatcctttagaaatttgagggtgggaatggatttctaagagttgtgttttggtgcatggctatttttgtactagatcagaaggaagggttgaggtttggtgttagctttttctatttttgtctcaatcaacaaatgaagggtgtttttgctgtttgttctttagtaattctgttgttattaaacaattttaatacctgctacctgctgggctgctaaatgagcctagtacaaatattaggataggtgttaacttgcccgtgtaccagtaagtctatttattactgaaggcgttagtgatgcattactacttaaacattttttctttgttttagttctccaacttgtttttatctttttaagataggatgtatatccacatttagaattgaactacatatatgaatgtgtgatgataaaggttactgttcaagcacagtacatgttcttattaaacctaaaatgttttgaacctggggatacttttttcccttaaagattaaacctctaaacaagttttggaatccaggctgctctgtgcctactctgataatggcctgatagtgtaatttgtcttagaaaataattttttgcagttaggaacaatgtacctgtttgtgtgtttcttcaagtattttctttttttttttttttttttttttttttggtgagacggaatcttgctctgtgaccgaggctggagtgcaatggtgcgatctctgctcactgcaacctccgcctcttgggtttaagtgattctcctgcctcagcctcccaagtagctgggattacaggcgcacaccaccacgcctggctaattttttgtatttttagtagagatggggtttcaccatgttggccaggctggtctcgaactcctgacctcgtgatctgcctgcctcggcctcccaaagtgctaggattacagacctgagccactgcgcctggccctcttcaagtattttctataggccaaagtatataaagtggagctccacaaagtcccattgaatctcactaggcttgccattggttatttctcctgtaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggtacgatgttggggatttgctttagactgttgttctgatggagtggttgtggagacctataatatgtaagattgtatattctgtacttagcagtatttcagtcctatcaaaggacaaaaggctaaaatgaatcttttttttttttgtcatctctggaattcctgatttatagtatataaatattcttccgtgagtggtgaagggaaaagcgaaggaaaaatattaaaatccacttactgtgtgactctgttgtgtcaagagctgtgctagaaaggcagaatttgctgggggtgctggggagtttcctagagagtcatcactgcccccaccctacaggagacccatccgttgccaagtctcagcttctgcggtatgtgctttgcactgcaccccgagctatcc

SEQ ID NO: 121140 - DNA, 2474 bp, Homo sapiens
acccaagacttaaagccatagaatgttgaaaaaaccatcttgaagggttgatgatgtgaccaaatagctgagattctctattcctttaggtcggggtatgagaaccctttccgtattatagagatgattggaaaaaatattactttttacataattcttaaatgaaaagccattttaatgtgactattaagagtctgttttatttacatttttattgtatatatttgaagtgcacatgttttgatatacatggtgaaatgattactacagtgaaacaacatatccatctattcacgttgttacctttaacattcacattgctaggtttaacttaacattttaacaaagtttgcacttactgtccatttagacttctcatgagctcattttaattctccactaaagacagaaattacagcatgcagaaaagttgtccatgatgatgggaataacagcatggaccttgaggaagtcattataattcttatagtcccctcttagggtgttatttcgaatctaaaaacagtgaatgaaagggagaaattgatgagcacatacttactggggattcagctctgctgcagagattgacttagctatctggctatgagaactacttctgtttagaaacattgtttttaaatttgtggctatggtgatatgtggtggctgttttgcaggaagaccagggaatttatcagagcaaagttcgggagctgatcagtgacaaccaataccggctgattgtcaatgtgaatgacctgcgcaggaaaaacgagaagagggctaaccggtgagaggcaaggggatatactggctgtcagtgagaatggctcccttccctcttggccagattggaacagcctctcaggagaggacttgtatgaaacaggattgatctacaagccctcgtagctcacctgcacctatttttttttttttttttttcaaaaagtgggtggttggcattttcctcccaaatgcccctccttccaatgtttagctgaatatcatttttatatctttgataagttgaggtgaagttggtccttagttctggtattttactgagtcttataggatggtgttttactgagacttataggagaaagcagaagctggattttctcattgtttttaatgatctaagaatgtctgctgttttgaggatccatttttttgagttctgcccagtctaatttttctttctcttgcttatgtacaggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgtaagtgggttaaagggggccgcttaggaaatgaatagacagggagatggggaaagcaggagaggcaaagtagatctgggtagcttgtggcttcaaagaggtggagcattggaattacgtggtaaaacttggagggctcagtgtgtacaatgattgggggaccttgagtaatcacatgtattagtagaatgatgaattctgctgagagctggaggagtcttggttcctggcaatctctaattccaacctctaactccacctatttattagttgggattggtggtacttaaaattttacatggatatggtggtggtctatatataaataaaaaagtgaataaaaggtaatattgaaatatcgtaacctagtcaaaaaaacacagtatttggagtcattataggcttgcatatgtttgggttccacctgtatcatcgtctagttgggtgagtttatatatgcacattttccatccctaggttctctagttcgtcccaaagtcgtccgcagtgtccactactgtcctgctactaagaagaccatagagcgacgttattctgatctcaccaccctggtggcctttccctccagctctgtctatcctaccaaggtaagggggataaatcagttgagctgtcttggaggttggaatcaaagatacctgttttaaggcaaggaattgtgtaatatctgaagtcttttttctgtaaagggtgaaaaataaggattaatccaaaggaaagattgattgcaggccagagtttaatatgaaaagcccacaattcttatttatttatttatttatttttaaagatgaggttctcctatgttgcctaagttggagtgcagtgggtatttgcaggtgcagtcatggtgcactaaatttgcaaactccggggctcaagtgatcctcccaagtagttgggattgcaggcatgtgctacgccacctggcttcacaattcttatttttttttttagagacgggatctgtctctctcaggctggagtgcagtggtgccattatagaacactgcagcctg

SEQ ID NO: 121141 - DNA, 1020 bp, Homo sapiens
accatcctctgaatttggtcgttgcatcgggtcaaaagttctgcagcttgaaaaaccctgcaaaaacatccggaaaggagggagaacactacaactcccagaacgcaatgctttccctctcgccagcctgtcccctccagctgctcaatgaccagcctctgtgagcctcctctcagccctattggtcagtttgctcgtcagtgagtgaggcggagggaggggaggaacagagaatcccggatggtacgtttcccgccaccgcggggcgcgcagcggaaaacccgaagaagaagaagcttttgattggacagtcgctagtccgacctcagagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggtgagggaggcgccggcgcgcgggctctagcgctcggagcccctgcggacgcggcccggccgggaagccagaggcccgccagacctccagaccgtgtgccgcagcggagcctgccgggcccgagcctccagccccaatcttgtaacttctcaacgccggactcgctagtttgtgttcgataagtgaactcttaggaagccagctttctcttaagtacaagcgatggtccgggcgcgcaaaaggcgacaggttcccattaagtgcaagcagattggcaaagcccacctcggccttttgcatttcactgctctctcttgatttgaggagactgtgggggaggggctgccctagggctatagtgaccagccgcgttgcagagtgctcagattttagggactgacgttttacctggaggaaaagactccataattcggctgcattctttttcaata

SEQ ID NO: 121142 - DNA, 1058 bp, Homo sapiens
aaatgctatgaggaaaaataaatcaggataaggggaaagagagtgccagttttaggtaagggtaaggtaagggtaaaattttagattagctcgcttttagcttccctagagaagccaaagaccactgaagtctttgctaatggagttccagctttattatatgctcatcttgtccagtgaccctctcaacaatatatgtacagtggacattcagcaagtatttcataatagtaataacaatggtcttgctagacttgaattggagcactttttttctcctttttactgtctataaaagaagcatgaatagaagaattcttctattacagaagaagcatgaattgcataggagaggacacacaggtactgttgacaataacacagtgatccatacatccatctctgtggaaaagaagattgaacacagctgcatcaaaatgtaaaagaaaatattaaactctttataattatgtggctgtgatacatctcatggcctagagaaccattgggtctaaatattaaccaaattccaaaggaggtaataatatatccatgcatatgtaaaagcatacaaagacataaaatagctaccatgtattgagcaatcactgtgtgccaggcattgtgcaatgtactttacttgcattacctttggtccctgcaacaaccttaggagggagatatcccagtacaaatgaaacagagatgaagtggctagtgcaagggctcttaaagttagtgtcagagcaaagatggcagatgccttgtttgtgtgggggcatgaaatcgtgtttggaaatgctggtttaattaagggattccttggagtgcatatctagcttggcattactccagggtggagttccctgtctgtccagctcagcactctatctaagaaatcctagaagctgggaatttctggggctggctctgaattgatgtaagtggtttcctgaacccactggaggcatggagtgcattgaacattttttcactattttgtatgcctgtgaaaccacatacatgtctgtcaggcagctgcacgagccattaaaact

SEQ ID NO: 121143 - DNA, 1382 bp, Homo sapiens
cagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaa

SEQ ID NO: 121144 - DNA, 1012 bp, Homo sapiens
ctgcactattttaatcatgtttgtttctttctgtggactttccgtgtcctttaagtggttttgtatgtggaacaagggcacaggccaatggagaagccagggtcccaggctcagggtgcggcggtcactggcctaactcccttgctcctggaccagctcctcacaggcagagtctcagcccatgcttttccctcctgtgcttggccagcacctgcagggacacttttctctatcctgcccgtgtgacttgcccccttgtctccagcttccaggtgaagtttttctacctatgccagctggcctactggctgcacgcacttcctgagctatacttccagaaggtacggaaggtgagtgctcacttctctcccttcttggaggccattcattgaccactcccctcctgctattcccaggggtacctcccttccttttctccagaagcatggagtgttgggtggtgataggaatatgttggggattgagcaacatgctgagtcatctcttggagaagtgtcatgtagttgaccaccagtgtcagtctcttgcctgcctcttccaccagacctgtggctttggaggaaacctaactctcatcttatagatgtcaaaggagaggtctttgccatttccatagtctttttttatttttactttttatagtttccttctgaattatttccaagagccctcttctccagtccctgtctcttatttctcaatccaaacctcaccctctgacactagacccaaggctgctggaatttgggaatggacctgaatgcccttgaatttcagcagcctggtgcagtgggactgtgggactcgtgggacatgggactgtgtgttaaagcagcccagaggagcctggccctctctcatccccctgcacttttcccccttccctgaatcttcagttagggaattagcaaatttaccatctgcttctcttgtttccaggaggaaattccccgccagctccagtatatttgcctgtacctggtgcatatag

SEQ ID NO: 121145 - DNA, 1036 bp, Homo sapiens
tctaggaagagacattctcacctttctgatgtccctggaatgaggtagcctggggcaggagagctgatgaaggcaggcgtatgcccgacagagtgggtgggtagaggtgatagaagcagtgtatttgagagagctcacaactgtcaccgccaccacacacgccaccacccgagagcctcatccacttttattcctcaatcggcacgtgacccagggaggagagagtggtagtgagaagagattagaaatgaggccatgtaagttcgaagtgagatcatttccttctaatccaggtgactgtgactacagtggtatagatgtatccgataaaaggacttatcagtcaggttattgtgctcatggaggcccaagtttgtgggattagggccgtggactatacccgaaaggcatgctgataggtcacagggcgtttagtgactcaaaggtgggtggatcagccctcacttggaaatacaactaaagatcctaatagacaataacctagaatgcttcttactaaaccctgttggcctcattctgagcactgtaaaacctctgcctttaatcccagtgtgaacatctgaggttctcagccttctcatcaaagccaccagctcagctgattttctgatttactgaagcaacctagcctgaagttattggaccagaaggcttgtggcccaactcggatttcagctgtgctactgaaaaactatcttggctgggcgcaatggtgcacgcctgtaatcacagcactttgggaggtcgaggcaagtgaggtcaggagtttgagaccagcctggtcaacatagtgaaaccccgtctctgctaaaagtacaaaaaatagccgggtgtggtgttgcgtgcttgtaatcccagctactcaggaggactgaggcgggagaatcgcttgaacctgcaaggcagaggttgcagtgagctgagatcgtgccattgcactccagcctgggcaacaagagcaaaactccatatcaaaaaaacaaaacaaaactatcttatttcaggagatccttcc

SEQ ID NO: 121146 - DNA, 1031 bp, Homo sapiens
ggcctgctggcttcctttctgatctagaacaggtgagcccaaatgggctaagcatttagccacaaggttgtcttgggttgtgctactaatttgctgaattgtcttgggtgaaacacttaacgctgaatggtcttgggtgaaacacttaacacctggatctccatcttgcatctgcaaaatccagagtgatgaccactccctcagccccagtggttcttgtagacaggaagccctgggagtcctctgaagggcttgctactcagattttccgtagaccaacaccatcggcaccacctgggaacctgtgagaaaaacacactctcaggccccaccgcagacctgctgcatcaaaacctacattttaacaagagctccggagattcctgtgccccgtaaagcccgagaagcacggctttaaatgaggtgggcgaaaatctctaggctttcaaataatcctacacttctaacctcaaaggtaggatagggaaacccctaaacccagtaactcatttgcatctttctgtccttttctagtttttgtttttctataaatatttggtctgggaaagctggggggaggtggggagtatcactggtggagttggtttccagctggtgctatacagcttcctaagaagtcatgtacacatttgtggctgggcacggtggctcacacctgtaatcccagcacttcgggaggccgaggcgggcggatcaagaggtcaggagatcgagaccatcctggctaacacggtgaaaccccatctctactaaaaatacaaaaaaattagccgggcgtggtggtgggcacttgtagtcccagctgctcgggaggcttaggcaggagaatcacttgaacccaggaggcggaggttgcagtgagctgagaccacgccactgcactccagcctgggtgacagagcgagactcggtctcaaaaaaaaaaaaaaaaaaaaaagtcatgtacacgtttgtaaggcagtgtgagcagaagttctggtagctttgatgttgctcagcctgcctgctgc

SEQ ID NO: 121147 - DNA, 1019 bp, Homo sapiens
aataatgtttcctataaacagccttagagggatgagaaataattggaatgacatttttaataggctcctggttctcagccctgtgtgctacaggaactcagctggtgcttgcggagagggacttgttagtggtttcatccctagtctgaggtcgggagagggtcatggagtgaagacttggggtgctaaaggaccttttaaggcacagaagaaggctgaagaagtaagtctgctcttgactagtgctttttgcttttttaatggatggatgtggtcaatctagaagctgatcactccttcaggtggctgcagaaaagcttggagccaaatttctggccacctttagccaatgagtaggacttcctggaatgcatttttgtggatcagcctcattccttgcttcttttctttgcctaaaatgcatattttttgtgttctttcctgcttccattttacattaccattctattctatgtgcagtattgtgtgcctcctaagtttgtttttgggacaaggtttttaaaaaatcaagttgaatgttgccttttctgcttgtatagttgtgaggtctcgggaggctactttatctctctgtgccccaaatttggctttttcatctataaaccagggaaactgacaccatcttgttgagatatggtaatgtgggagcaagcatggctgtttacagagaaagttgcactttttagaatggtttctgctgctactaccaggggggctagggatggaaaaatactgggatctagtatttttgtcatgattatggccgtagatcctgttctctcagaatcatgttcagaaaacatgttaagcattcatctgtagtcactaaatattatagctgcttacagtatgagtttgtcaaataggaatttatgagaaacctactattcacccagctctgggacagaccgagagagagaagacatacagagaagaataatcgtggacagatgacaggatgagggtcagatagctgagcacagcaccgactctctcct

SEQ ID NO: 121148 - DNA, 1006 bp, Homo sapiens
tccctaggccaccctctgtttttcagtacccgattaatttcccaaattggggatgtatattatggcaagttcaagctttattctcttttttaaaaagcccaacttcaaagattttttaaaccctttattgtgactctttctacattcctctgtatcccaatataaagtttagacttttaaatcaatgactgtaacaaaccaagtaatataattttattgtggctattcaaatttcgagtttttttcataaatacacaatgtcacttttaatctaaaactgctatcaaaactgttaatagtgagtctattcaacatcgtgatcacaggcttgtagagaatctgttgtgtgcgtgtttgtttagctttgcctgatttttgtatcaaggcagtttttcaggtgaaaaaccagaatctctaggcgttgctaaaagccacacagaaaggtactgtcataactctgccccctgtgattcaggcgctcagccctcacagacagcctctggcccttcaaaacggagattttcagaaagcacaagtgaaaagcatctttgtttcagctgtatctgccttttatcgagcagtggaggggctgcaaacccacgtccatcacaccccgaccacatacctggcgcatgcaggtgatcagtgggcttgggacataaacactccaggaaaaaaggctaaaagactattttttttaaaaaaaaaaaaaacccaaaaatctcttccccaccaattgggcgtaactttccaaggttttcttgtctgcctgaaattttcctattcacttcctccgcagaaagatgcaaaatcaatctggggaaagccttagtgaagaccctttggcttccaaaaacaggccgagctgggagaagaagggaagttttaggtacctaatttcccagcctcagcaggacctgtcacttggctttaccctgtgtttctcaggaagaaaaaatgagggtcctcactgtcagtcgtgggacatatgtgtctctgtgttttg

SEQ ID NO: 121149 - DNA, 1055 bp, Homo sapiens
ggatgtgtgtggaggataattttgctggtttaaagtgtcctattcggttgggcatggtggcacactcctgtaatcccagcactttgggaggccaaggcaggtgggaggccaaggcaggtggatctcttgaggccaggagttcaagaacagcctggccaacatgatgaaaccccatctctactaaaagtacaaaaattagccgggtgtggtggtgcattcctgtaatcctagctattcgggaggctgaggcaggagaatcacgtgagcctgggaggcagaggctgcagtgaactaagatcttgccactgcactccagtctggatgacgggagtgaaaccctgtcgcaaaaaaaataaaaataaaaaataaaaatagtgtcccattgccagcagttacgttgatgaggttaattattatcatatggtgttagtattcttttatttgagtagcatatctccatcagtcagagtcccaacaggaaacaggtggggtaattgaggaatggttatgtaggcactattaacaagggcgtggactggctcaggggaaacagataaggaacagtaaagcattctaaggcttgcgaacgtggggagctatccctaagcttgaaggggctgaggatagcatggatctagaactaagaaggaagggagagaggaaataccattgagagctgtggttgaaggggaggggctggagttttggtggagggttgcagtgactgccagaactgtccagcaggaaaggagccaggtgatgaatacccctttcatgctctctcatgttctgcagattccatcggaagcccactgaagtactccataaaggtgaagctgtctgttctgggacacagggtaggatggagcattgtgcagcccagtagaacttacagatgctattctgccttctgtttgactcctacctcatatatgacaacaggcaatcaaagggtggcaaagctaaactgatgtccctgaaatactaccatctctgagaataggacttttggacagacgtttcctgattgtaataagccaaatagtgcaacacat

SEQ ID NO: 121150 - DNA, 1068 bp, Homo sapiens
ctttgtctcaaaaaaaaaaaaagccaaacaaaacaaaaagtacagattgagtgggtttgcggagggcttctcggtgacctctgagccccacttctccctgcgtgcctgagcccccagcccccggctctgcccatgaatgccctcccccaagagccacaagctccagaattacccctcaccttgtcccttctcaaagatcatatggcttcagcactgcttagtgctgtctccctctcccactgggaagaaaactatgaggttaaattaaatggagatcagctgcttgaaatattttatactgaggcgtgacctaaccatcataacatgtttaaaaataacagagattttgcgttttacatgttgtttttgttgaaggactttcttttctgtgtaaataccacttttataagcagatctcctatagctcttccactttaaaaaattgacttaatttttactctgtttttgtgcctggacactatgattttttatggttgtaataagaatgcacaggctgaattctgatttttttcccactcaatagtatatccaaatattttgagatgttagcattttttaaagatgaggttgtcctaaatgcctaccagtaagggattggttagatcaatttaaaatggtgacataaatctgtatgcagtgtcatagaatgatgtccaaaacatatggttatggtttttttaaaagcagcttacagaataccatattggtgtgggcctttttctgtaaacgtttggatgtgttttatttttatagaaaaatacctgtaaggatgatcatcaaaatagcaccagtgtttttctctgtcgtaggatttcaagtaattttactttttttctccacgcttatatctgtctattcatatatatatatttgttttaatgaaatgcatattattttgatgatcagaaaaaggcaatgttaaagtggttttgttttgggaatggaaaaatagaaagtttggattagtgataagcctgctgctgggggagaggtggtgggttgggggtagaagccagggcacaggtggagggtgggggtggaagtggg

SEQ ID NO: 121151 - DNA, 1021 bp, Homo sapiens
ctaaaaaatggccatggtgacgtggccgaagtcccagattaggggtatgtgtaaaactaaacagattgcagagaactggctccaggtcacatttgattttgttcatttccatggagacctcttgaaagtgaaagatagggcattcttatatagtatatagagctccttttggaaaaggtttattatgatgattaactcacaggctcttcttccctggaaaaataggctgcagatttgaggctcagttgccttatcaggacatacaccctgattctccatttctcattgccatgtcacatggggcttataaatacggtgttatgcatgcgtggtgagtgcaggctttgatttagattgtctgattctttaccgactcctgtacttaactagataacatgatgaagttacttaactgtggccgtttccttgtcagtaaaatggggttgaaaattcttgtacctacttcagtgagtttttgaaaggaccaaataagtgaataatgcatgcatggcatccttatagaacctgatatacagtaaggactcaatgtatttgttcagagtacctgaatattaattaattaattccatgagtattgtctctgtcattaagcagccattttatgtgcctctaattttcatattataggttatgtacagtctgtacatcctggtgcatccgttcctcaccagacatatcttttttttttgagacagagttttgctttgtctcccaggctggagtgcaacggtgtgatcttggctcactgcagcctccgcctcccaggcccatgcgattctcctgcctcagcctcctaagtagttgggattacaggtgcccgccaccacactggctaacttttgtatttttagtagagacagggttttgccatgttggccagggtggtctcgaactcctgacctcaggtgatctgcccacctcggcctcccaaaatgatttttttttttttttttgagatggagtctcactctgtcatccaggctgaagtgcagtggcacga

SEQ ID NO: 121152 - DNA, 1078 bp, Homo sapiens
acttgtttgtatggattttgtgactggaggaggaatgttgaagtagaaaggaacaggtggtagttgattttttaaaagaatagcagggttctggtttggttatgatggctggaacgtgtgcccttctttcagggttcttgaggaatgaattatggctggtgccaatggagggcctgcagcagggaagcgtgcagtgaaaggggcgaggacaggggcctggattcttccattaaatagccttgtggcccatgcaaggcccttcacctctctggggctcacctgcttcatggatgtgtcaaatgtccggcggcctggttgtgccttcttaacatggacatgtagaacaggactggaaaatgtgtataaaactcaaattgcgagtcagaaattgggaggagaaggagagaggcacctttccccaatcctatagatttaggagtagtagctaggcaaacattgtgctccattaggttagtgggctcacttctaatcttggtttcatttattatttgagttgaaaccagattctagcacaaatttggggttggcatgaaatatgtcttagcagaacccatggtggagaaggagaaaatctgtatattggaaaggaatctgggtttggctttgagactttaagattgccatccataatgaacaatgttgaagtttcaaaactaaatctgtggcaatatggagaatttggctatccagactgattcatccgcagaaatttctggaaagctacagttttatagcgctgaagtaaaaagcaaagttggtctgctgcatagtacattttattacccaagaaatgtaaaagaaacatttctgtcattctttgcccagcctgggaaatatctacattcaacactattcaaccatttggccattgagttttattttatttataatcattcagcacatacacctactctgtacaaaacgctgaaattgaaattcaagccagctaacatatttgttgatacaactctctctactgtgctcatttttggagcttcagaaagaagagaatgtgacacttctcagctactcttccctgcatttcctgggtccagat

SEQ ID NO: 121153 - DNA, 1069 bp, Homo sapiens
gggttctgacttggccctggctaggattccttcattcggaagctgagccaggaaaactcaattataattcttcccacaaagagcgactctcttggccattcctccttctggggacctctgtcgtgcctctgccaatgggctgggtccctctcccccatcagcccacgcgccaggcagccacagcccttgtgtctgcattgcatccctgcgttgctctttcccccactcactggtcacctcttctgcattcagggggcttctgtttccccgttagggaccccagggctttagttctctgtccccagggagatgatgactctaaattctttcccttgggataatttccttttgggaacacatatgaaaggctgtctctcccctcaccactcacccctattgctaccccaattttggtttagtgttgagccatcctgtttcgaaggcagggggcagcttttcccccctgaacccaggttttctcccagtcctacaggctgcttggaatagagaagctgctctgtgcagccacagcacttggctaaaaaatgtcaggaatgtggaactttattttccccctccttcctttccaccgttaagtctgcttttgggagaggtggcacagggggagttttctactcaactctttggtccttcagtcctgtcttaggtggagtctggcctgaccatcaaccagggtgtggacagctggttggggggtatgtgtatcagatttgaaagtagcctcctccccctccaccttcccttctccttccagtgtcctgttctgtgccacgtttcaaattgaaacaggcaggggaagaggaaaagtctttgattagcgaatggagaatgaggaaaaagggggtgcaccgaagagagaggaagcaatttatatactacctttaaaatgtcagttcaggactgaaactttttttttaagctcatttacaggctctaaagctgcaaagaaatgtttccacaattctgagcctatcatttgtaggtttggtttctttttggtctgtgatgacttaaaggttgagggacccagaggagttcttggtgatgg

SEQ ID NO: 121154 - DNA, 1021 bp, Homo sapiens
gaaggccaatttttggatatcctttaccactccgtgaactgtccctttagatccatctgcggcgacccagagcttcaccccctttacagagacaagaagagagacagggataccctccactttttggggaaagttgattctcttatagtgtaggagtggggggcagaggatggggatcccacccccaacagcaatgtcctggtgtcggcctcccaggcagggagttgtagaaagccagcaaggggtcagaattcacaagactgatgggaaggattccctactcttgcagagcaagaaaaatgtgatattcaaaagtgggaagaactggaggaagcttggcatgggtttgttgcggtatatcttgtctcagaagtgagatatgtgagcgacattcccctcactctcaccgtggtctcctctggttcctgagactccttgtcctcccttctgcgtcagcttgcttattgcattctcacggttgggttaggaagctgtgatcatttacaaacttccttggagatggaggatggcttgcctggctaaatttccttccctgtccctctgtctcgggttccctgtatctctacgaatgacaagggccctaattggctggcgaagctgccctcaagctgggaacgttcttgtggtggccaagtcagggttggatgaatgaatgtgtccgtggctgagctttagggtctgtaggaaataaacggtggtgctaggactggggtctccactccactttttgatagtgctcctttagttcagtccctctctccttcctctccctctcacagctctctctagtggtatattgggtcgggcttgctccaccttgttctgggttctcccctggaagtgtgtggtgtcacacagagtcatatccgtgtgtctcagtccctgttctgtgactagtctgactgaaaactgactgcagcctcagtttccccatcattaaagacgttcataaaactggtcttcgtcacagggtggttgtaaggtttaactgagatcatat

SEQ ID NO: 121155 - DNA, 1023 bp, Homo sapiens
tttctttggtaagaagtttgtagactgaatgcaatttgccaaaattttacatctatactgtctgacgaatacacagatagatgagctaagtctagtttgtatttagacaaaatatcaacaatattttatgatttcagcagtttcattaaaatcctcacagaaatgaagaagatgatttgaaactcctgttttcaagtcaaagtacctaacagctagagggaacatatttttgctgccatgatttggcatattacttaaaattgatgtactgtagaaaccaggattgttggtgagatatgacagaaattggctttatactgtaaggagccaacacatctgttatcaaaaaatttcccttcttctttgtccagaggatattttagctgcaattcttgaatcaggaaatgaaactttactcagtttcatagagcaatcaagggaacgctatgacaatgcaggcttatttgcctggtatgcccatgctaattcagcagctgctatttttgactgagcattggtgtcttttggggaaacaaaggtatttttgattggtttagaagcattcacctgtcccatcttacttgtgagatttgccctccatatgtgcttgcacatccccttctccaccatgtccaatctcaaatttttttctgtatattatgtagtatgctctgttttggttatttaccttcctagttcagtagtatgtgtccttccatccatcatcaaaattacatagtcgtttagccttcttcttcagtgatggggtcatggttgcattggtattataaccattctcattatctgacctcttagaaaacatggtcacaatattcacaatgttaaaaaattaaactagcactatcttgttacaaagcacaccaattaatccacaggcaaagtcgaagatgaactattaataatcattatatacacttaagccacatcactttgaatgatgcaacgatggatggatgaccattctgaactacaaattatggttgccagtatcagtggtcaaat

SEQ ID NO: 121156 - DNA, 1048 bp, Homo sapiens
cgaaacttaaactgaccttattttttttttaaatacaggatctcagtcggtcgcccaggctggagtgcagtggcaccatcccgtctcactgcaacctctgcctcctgcctcctgggttcaagcgattctccagcctcaacctcccaagtagctgggattacaggtgtgtgccacctcacccgactattttttttttgtagagacggggtttcactgtgttgcccaggatggtcttgaattcctgagctcaaagcaatcctcccgcctctgcctcccaaagtgctgggattacagtttaaattgactttaaattatgcctccctgtagcaacttatcatctcaatcttctgccttcttgattgaatacagaactccgaccctcttccttatgtaacagccctttggagatttgaagaaggttgtcatagtgaagtagctctagaggttctgtgtcactgagaattacagcggaattcctcagaataaaaaaggaaactcaaaaattaaatcttgtgaagtttgtttgctacatctattctttgtgcataaaagtgcttcagggaagtaatataactacatctaacttatgaaagtctaagttggtcctggggaattaataaaattcctgaagattcacagaagagttgatggcaaggcactggaatgtggcgtggagaaagtgatagcctgaaatttggttctgagttctctcagccctcctttccatccccttctatgcccatccttaccccagcctcctcaccttctctcctcacactctcagaacacttaccctatttggaataaaactaaaatcctcttggaatacttcattatcttcatctgatgtgacctgggtaaataactcccctctggacctcagtgcctggatttaagatatggacaagactagatgctctgagatcccttacaccctatcaccaacatactcgaagctggaaacagcctcatgatattcctactcaaggcgtatcacctaaaactaaagaaaaactctttgaatattatgggaattccatacccttga

SEQ ID NO: 121157 - DNA, 1026 bp, Homo sapiens
tggattcagtgggtctttgatattgatgtacccatgaacattcttattggatacgcatagtgttgctgtagtatctggtcacataggcatacttgcctttttcagaagaaagagctaactaaactcagcctcatttttcctcaagattcacccatctgcaacactaaatgtgttcatttaaatctaatactcagtcccttttagagagtttgacagagtgacagtgtgatacagttatttcaagtttttaagggacagaaatttaatatttttaagagtttttaagagagaagttttaatattttttaaaagataaacagagggcctcaagtttctcttaatttgatccagtaattctatccatgagattaagcatattaccaaataaaaatttagagataacattttaaaaatttctccagaaagctggctttatatgttgaaagccataaacatgtttatttcctttgatagacattttcactttttggaatttattccaaagcagtgagatatgcacaaagactgatgttcattgcaactttatttctagtgaaaacacaatagactgaaaaattaggaacaacctaacagttcaccagtaaggagatgtttgaaaaaatgttttgtccatttaatggaatattgaatgagcattacatttttatgttttcaaaaatgatttggtggcattggaaaatcttagtgacataataaggtataaaaacaggatgaaaacaaccacatatagtgtgattaaaaaaagtttgtgtataaaaaaacaggaaggaaatatttcaagctgttagtgtttttctgtgggtgatagtgtgatgaataattgtaatgttcctctttctacttttgtgtagaattttctagtgtgactatgtattatgtttcagggaggggaggaggagtgtgattacaaaagacagctttccagttatagccctgttctaaaagtgatacttggtggtgggaagaatcagaagtagggtttatgggctgggtgcggtggctcat

SEQ ID NO: 121158 - DNA, 1071 bp, Homo sapiens
ggtttctctaagcctgagtgaatgaatgaatgaatgaatgaataattgaaacgatagaatcaaaaatgtactttaggatgtatggttgaaaaccacaaacaatgctgaagaagaacctgccttcttcatgacggtgttggaggagttcccggaatgttttcttggctcaaattattacccagcagtggccaccctcagattccagcaaaccagtctcaagttttcactgtttaactctgaattttcttggcagcctaagaggtgagagtatgtggtaataatacatgtataggagttaatgggaagaggaagaattcaagaactaatatttactgaaaacttcctagtgatccttcctcaatgctagtccctttcaatattttatatctttaaccctccttatagtcccatgaaatgattatctccattttttcgttaatgaaatggaacatcagagaaatacaatgttcacagtcacactccggttggtgatggacatgaatatctacaccaaggactaaaatgaaatcatgcctggaagccagctgggtgaaggccctgggaacccatgaactggccatgaaaccagaggatgtcactgacagggaggaccggctgggagctaaatcactcttcagctctttggctgtgagactgcatttgatcaaaaccagaaattaggcctcagacttgtttaactgtagctagaagatccaaattctttcaagagacagagattgtttatcccttgcttcttttggaattctgtattctaactctatggggtgcattttgttttataagctggaagaagagatgttgctgcattaattttgcaatatggaaggagctagcatttgttcaacatcagtcacacactgatcattcttctaaacttctctttgttttatcctacaaaaattacctaaggttaatgtggttgttattctcattttacatttgaggatactgaggtttttaaagtaacttgctcagagtaaatgatagatctgggatccagggtcactgctattaaaaaccaaatactgagtcttattttctatgttagtg

SEQ ID NO: 121159 - DNA, 1069 bp, Homo sapiens
gtgagctgagattgtgccactgcatgctagcctgggcaacagagtgagactccatctcaaaaaaaaaaaaaagaatatgaatattttaggggtatgcactgcctgattgtgactttttaatagataatataactcatgctaaacttgtcagcagttgtattattatccatcccagaaatacccagcaaacacttgttgagggattaagcagattcagtacactgtactccataaactgaggtctaagcacccttcattcatgacaaagttgagatttttcttaaaggttgtgactgctattgaggccctgattttactctttcttatttcaggcatttaaaataagaatcagcaacatccctacaattaagaagttcctgcagcctgggagtcagaggaagccacccccgatacccactatgttgaacttgccaggaagatagtgctgctctaatggcagcaggttgcgtgatgacaaacatgatgatccagtcacagcaccagcatgtgctgtctgcagaggataatagaagcaaactgtagatcccaggagcaaagtgtctgaaaagaacaaaaccatgctgccattaacagcaacgctgattaaatgtagtataaaatcattcagatgtgtgtggctttttaaagtctgtcagttgtggatgatagtctacaacttttatgaaataaatgttctgtataaataaataggagccagatatatgtagggcaggggcccacatataaccctgttcttctgtctgcatcaagattgggaccattgagggaacagggaccagcaatttgcagggaaggatctctccaacacccaccataattgctgagtacttggggtaagaaaaaaagtggcaaatgacaaattaagagttagacattggctgatgctagtaaatcttacagggatgtgtggggaacagagaatgttcattctgaaaccctgaaaaaaagttggatatttagacaacacttttccacctaacagagccacccaagactgaattttgctatgatgaaacaattccaagtagcactgagattaagatataat

SEQ ID NO: 121160 - DNA, 1042 bp, Homo sapiens
tatgtggctctggtttggacttgtgggatcacattggtcacttgtttctactggtggtatagccagcaggtttaagctagttgtaacttttgtgtctctctacactggtggatacaattttgcttagccacctccaggtttataataggagcccagtactagcatttcaccacccaaaaggactcgataatcactggcaaaaacttccccaaaaaaattgtgccagtttacagcatgtgttagagtgttggtttcatcctattcttaccagcactggagatttgttgttgttgttgttgttaagattctttattaaatctaatcagtacaaaggcttcatgctcttgttaagtatttagccatgcaaaatggtttttactctcatttgatattctttattatttttctttctgtagattttgaaagaccatggagaggattttcttgttggcaacaaattcagctgggcagacatacagctgttagaagctattttaatggtggaagaactcaaagcttctgttctttctgacttccctctgctaaaggtagtgtattaacatccacacaaagcccagaaaaaaatgaacaaagactgaagcaaaatgtgcctttaggccaatctcaaaagaaacttaagaacattggggtgtgtgtgtgtgtatgtgtgtgtgtgtgtgtgtgtgtgtatgtgtgtgtgtgtgtgtgtgtgtgtgtggtggggttttgttgttgttgtttggtttttttgagacaaggtttcactctgttgcctaggttcgagtgcagtggcatgatcatggctcactgcagacttgacctcttggcctcaagcgatcctcccacctcatcctccagagtagctgggaccacaggtgagtgccaccacacctggctatttttttaatcagggaacctgccccgatagtcacttaggttcttttctattttccttaagcattggccagcttgagaaataaagggacagagtacaaaagagagaaattttaaagctgggcatccgggggagacatcacatgtc

SEQ ID NO: 121161 - DNA, 1006 bp, Homo sapiens
gcctcattgtgcaaataaggaaactgaagctcagagagattaagaaacctgttcatgtgagagagagagagctgagatttgaacctgggtctttttttcagtacccagagcctaactcagattaatgtgtttgggtaaatgtgttcttctacattttctaaaagatcttggctcaccacaacctctgcctcctgggttcaagcggttctcctccttcagcctcccaagtagctggggttatagtcatgtgccaccaagcccggctaattttgtgtttttagtagagacggggtttctccattgttggtcaggctggtctcaaactcccgacttcaggtgatccaccctccttggcctcctaaagtgttgggattacaggcgtgagccactgcgcccagctgcgggctttttttttttttttttttttttttttttttttaaatcaaaggctattctccaactagccaaaggtcatcatgctgtcttcactcctttctgctcagcccaccttagatatgtactcggggctgtgggtgggggaatgcatccccacggctggctcatctcaggtgaagctgcacacaggtgaagttttcaagccctgagagataggacttaatttccaatgttataagacccatgtgaggacacacctgttggccaatatcagcatcagaaaaaccagagctgaggagatgggcttgagtgcctgctcatcttagcttctaaggttctggaccttccagcagcggagttctcagagtgtttgcattttgggtgaaatccagaaagcactgctccttcgttccctgcttcttcatttcccacagatggggtatatatttccattgcacctgttcttttaagctttgacagtatacttttaaacaatcagaataactgggtttactttttgaagtataaacaaacttggtcttctatattactaagctgtgatttagcctaatctttgttgaaactccttagaggtcaaggaaaaaggatt

SEQ ID NO: 121162 - DNA, 1040 bp, Homo sapiens
tatgtgtggcccagtgaagccaaaagattggacacccctgctaaacaaatgctaaatttcatttctgcttggaactcttcaacaagtatttattgaacaaattttggtgggccattttgcataaccatatcttcgtagtatctaataccttttttgttagccttaaagttttggttttcctttttcaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtcattgctcattgtcttgttgtgagaattttttaattagtttttttcaaatatagaatacatttgcacggttcaaaaatcaaaaaagtataaaagggtctacagtcttggaagtcttttcaaccctgcttccccgcaaccgaatcctgcttctcacaggcaaatgcagttactatttgtgtacccttccagttacatctgacacatgtataagaaaa

SEQ ID NO: 121163 - DNA, 1081 bp, Homo sapiens
cagctgaatttggaaaatctgagattctcgaggtcaaaatatataatattctgaatttgtgaaatcccgtactgctagcacatatgtttttacaacaaatggccccagcttcccaagatccaggataagaagtcataaatagaaatcatataaaagccaaggtttttttctccatgttttaaaatggtggtttttttttcttgagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaccttatatgctgtttcttcacggatttgtcatacagcttttgagacctttgaaagaaaaatacgttttgaagcaccgttcagttctagttctcgtccaccaaaatcacaggcacgcttcactgagtcagataccatccctgaagggatttttctttataattagaacgtagttgatggaattctattttccttttgacttttacttaattattggcttctgatctagcaccagtgaatatttattaataagaagaaaggaaatttacctgaaaattgtcagttactctgagctcttattaattatgcattctcagggtaaatttcttgttttcttcagtggcttcaaactggcagccttggtatcttgcttacatatgtgtgtgtgtctgtttttgttttcgttctgttcttttagcttcttagtatggaaattttcaaataccaataaatgtagagagaacattgccatgaattctatgtactcatcacccgacttcagcaatcatcagctctatgctaatcttgtttcatctatcacctcccttcccttgttttgtgggagtattttaaagcaaaatccaaacatcataacatttcatctgggagttcctcaacattttcctctaa

SEQ ID NO: 121164 - DNA, 1920 bp, Homo sapiens
aaattatatgtggtatatgaaaaaaagaggggtcaagaatgatgccattatttttggcctgacaactttaaaacgatgtctttaactgcagtagagaagattataagtaggagacaagatgctcctcttgaactccttattttctcatgtttttgtcaccaaaatgcatttatttgtactttgcttacattggccccatatcagtcatgccggcctttttctttcattgcaggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactac

SEQ ID NO: 121165 - DNA, 1092 bp, Homo sapiens
tttaacatcatcaatggatggcagctgatacaatctgtgaaggatgagtgagacagaaagattgggaatgtgttttctacagttgccccttcagataagcaatgttatgccccaggagcctcctttgcatagcagagaaagttcagatggagattactcatggatgagttctgttaatgccaagtattgctttcccccaccccgtttgtttacacagaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggcaagtgtgctgctcacatttgtaaacagactgaatctggaattcatgagattatgggtacatatccgagaatacatactgtctctcgtgctgacccaagccatgctctcttcattcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctggtaatataaatgacttggctttactttgattattaataagaaaccctgtccttggaatcacatattcacaaaggttctgttttagaaggcagatactagggggcttcccttcagaactgaggggaacatcatagaaatatttgctgaagcccaagcctcactttttttttgagttggagtctctctctgccacccaggctggagtgcaatggcgccatcttggctcactgtagcctccacctcctgggttcaagcgattctcctgactcagccttctgagtagctgggactacaggtgcccaccaccatgcctggctaatttttgtattttttagtagagacagggtttcaccatattggccaggctggtcttgaactcctgatctcaaatgatccaccagcctcggcctcccaaa

SEQ ID NO: 121166 - DNA, 1048 bp, Homo sapiens
ctgcttattttgtactcaattcttcagagtcttccaggatcattatgtttggctctttcagttttgtattatttttttcttcttctgtggaatgaggaaataggcttggaaggatgaaatactctatttaagacacatagcaaataagttacaaaaccaggatctgtgttgatccagaatgctttttagaagtagccagggtaacagcagtgtaactggctactatatataaataactttgtgttgcaatcattacatatattttatggtatcttagataagaaaaatcacaaggggtgttaaaaattcaaggtactgttttctaattgggctaagaaacagtagtaaactggtcacaatgaaatatagcccagtaatcaagacagtggtaactttcctggctagacttttctcctaaagccttatttgtcattccaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcggtgagcagcccagattcaccagtgagcttcgtgtctgtttattcctcttctgaccccattattgtgtgaaatattttctttttcagtatacagggtccagttatggtagatttatgtttgcaacagcatggaattgtaaagacccttggctttggagtgaaagatctaaattcaagttctggctgtgcctgttaaaaccgttgtcactaatggaggcagctatagggtagtggctgggagctggcctctgcagccagactgccaggggctcaaatctcagctctgctgt

SEQ ID NO: 121167 - DNA, 1076 bp, Homo sapiens
taaagataattaagttggcaaatccagtgtcttttccactattcccccagatttcatggtcttggtggtctctctattaatctaaatctatgtctcattccatacagtgccacagtagtgaatgtgggtggttaatgaatgtgggtgggtaatgacatggttgcctttccatttggggcacacatgccagaatacaaacttatatcacagcaattggctgagcaagattttctatcttttccttctttcagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggttttcttccattttcttgttataacgttcatatctaactctgaataatttctatgaattgcacaggaaatatttagtatttagtattatgggtgagaaatagtacagaataccactaatggtgtactatataaggtatgagaacttaaaatagtttgaaacttactgggtataaagtagttacaatgtaaacaatatagttgctttgaaaattggcatgtaattcacatgatatatcaccatttatatggaaatggaaataaacatatatttatctgtctttggagaatgttttcaaatctattctctatgagttacaattatatagtagtttgtttataagccggtactggttgttgaaaggcaacttcatattatgtaaaagtccaactgactcataacctgaagagattgacagatgagatagacctaggatagtaactgcacttagtatttcatagcactttacagtgtgcaaatgcttgaatatattttatatgatttttaatccaataaagactccatgagacaggcattattgttttcaattctgtgagtgagaaaactcaatcttggaaagtttaagcaatttgctctaatcactcatccattaattagttcaaatagtgcaactaactacaattcaaccaactgacc

SEQ ID NO: 121168 - DNA, 1099 bp, Homo sapiens
tctcaattcccatcagacagttatctgggccgggcatggtggctcacacttataatcccaatactttgggaggctgaggcaggaggatagcttgaagccaagagttcaagacaagcctgggcaacagagcaagaccctatctttacaaaaacaaaaaaaaaaaaaacaaaaaaactagccaggcaccatggtttgtgccagtagtcccagctacttggaaggctgagacaggaggatcacttgagcccagactgcagcgaactatgattgtgccactgcactccaacctaggcaatagaatgagatgccgtcagtgatatttttcccttgagtgacagtttatttttgcaaagttatctcagcctataatccagtttgatattttaaaagaaattttctctctagttaaaaaaaattatgaagaacacctttgaatgatttgcaaagggaaatgaatgtagtaatcctatgagaagttcgaaggactctacattatctgtgggatgaatgcataaagcctttggtgccatgccagactactttttaaattataactattttgcagagagcaatacaattgcaaagaataatacgaagcaaacttgcatttggatttcttctcctctactgtctctataggcttctttcatcgagacttaaagcctgagaacctcctctgcatgggaccagaacttgtgaaaattgcagactttggtttggcccgagaaatacgatcaaaacctccatatacagattatgtatctaccagatggtgaataccatttttctcaaaattatttaattgcacttctttaaaaagatatcattatgctaaggataatattaaagtcacaaatgttaacttttcactaagagaaacagtgcagtctgaaacatatatttatagatatgttggtaatgtacaaggttaaaaatcttgtgttctaaatcatgttaaaagaaaacctattatgcttttctataatgtaaataaaattttatatataggccttcctgaggacagcttaacaaaagaattatgtaaaatattctgcaaagacctgtctgagaaccatctaattgctattgtgaaaacttt

SEQ ID NO: 121169 - DNA, 1825 bp, Homo sapiens
tattacttttttaacttttttgctaaaaactaagacacaaatacacacattagcctaggcctacacagggttaggatcatgagtatcattgccttccacctccacatcttgtcccactggaaggttttgaggtgcaataatacgcagggagctgtcatctcccatgataacaaagccttctaggtacctcctgaaggacctgcctcaggctgttttacagttaactttttttttttttttagtaagtagaaggagtacaattctaaaataatgattaaaagtatagtatagtgaatactagataaggatttttcagcttcattataataagaccaccatcatatatgcagtccatcattaattgaaacttcgttatgcagtgcatgactgtacagtgaacttacaaagaatgaggagttgcacctgattggagcacactttacatgtattgataagtgttggaaaataagtttctctctttaggtagagtgaaaggagttcagccctgtttaatataaaaaggagtcatggatggtttttgtgggtgaatgagagagtgacaagggaaagatagtgtttaagtggtcaggattataggagagaagctggagcaaggaaggtctgcaagaaagtggcaatgcaggcataggcagtgagaaagtagaaagagacagatatgagatttacccccccaacccccccgcgccgctccaaaacgaagtcttgctttgttgcctgggctggagtgcagtggtgtgatctcagctcactgcaacctccacctcgcaggttcaagcaattctcccacctcagcctcccgagtagctggaattacaggcatgtgccaccacgcccggctaatttttaaaatatttttagtagagatggtgtttcaccatattggccaggctggtctcgaactcctgaccttcaagtgatccgcccgcctcggcctcccaaagtgttgggattacaggcgtgagccaccgcgcctagctgatatgagatgttttgatagaaaatacgacacaatctcataactgggtaaggatggatccaacataactgcaaggtacctagaaatcttatccaaaggttaggaaggggagatgatttgggagaggacaaaagtggttttggataagttaacatagggatgatagtgacatccagttgctgtccaaatagagatttatgtcttcagaagggtagagaaggcacattagaaatgtagacttgagcgttgtcaacatacaggttgtcaaggaatcgtgtagatcttcagtgatggctattaatttctcccataatgtgctagttagaatccagctttcacaacattgatacagattgagtatctcttacttgaaatgcttgggtccagcagtgtttctgaatttggattttttcagattttggaatatttacattatattttaccagttgaacatccctaacccaaaaatccgaaatccaaaatgctgcagtaagcaatttctttatgtgtcaggttggtgctcaaaaagtttcaggttttggagcatctcagattttgaattttcagagtagggaatactcagcctgtaatgatagcaatgataatgtgtaacaaataatagcatcagcagcagctgagttgtatttccagtattggtgtcccattgagatttggagccacattaaatgatgtctaggttggtgatactctcaggaagtgggaggtttggggttttcagagacatatattgcaattcactgggcgtttgagtgagcttggaagattgccatgttgactatctcctgcctgtacctccagagctctgct

SEQ ID NO: 121170 - DNA, 1061 bp, Homo sapiens
gaccttacagatatccaggtcacacttatccgtgccagaaatagaaatgcattgggcagtctgaaggacaatgttttgcaccaagagatggttctctgcctctgtgtttcctcactgtcttgctgtgcatgaccttgagatagtccattgcctttctatgcattgctgtcgttctagccttcttgataaaaacattgtaggtttgaatttaataatatctgggaaattaaagtttccacagcaggaaagtgtcctgtataaattcatagtgtttgaagattctctggttatttccatatattcatatctgattcatcaataacaaaatgtggtagaggggagaaagccttctttgtggcttgatgttttccttgcccaagggttattaatgaaaaagtaagcacacacattttctgccaggatgaaagaaaatccctctgttattcagctggcatataggggtgaaattaaattgaaggtctgttcctgtcttctggaagtcaaacagttttgaacaggaaggttcttatcataatagaactttgctgttgcgtgatctctgaatgaccacaactaaaagggtttccattgtgaatcagaagcccaaaggaagaagtaggcttattgttataggtcacattgcacacaccagcagaactggaaccctgctacgaatcagagttttattaccacctcctcaccgatggagcatgtcagatgtaattcttattagcaaaaaatggagccatgtctgcctccctacttcaacaggtatgtgggagagtcaaatgagagaatgtgttaatagtagtactgttaatgaccagctcttgcaaggtattaatgtgcaagcactgctcaaaaagctttataggctgggcgcagtggctcatgcctgtaatcccagcactttgggaagccgaggtggacggatcatctaaggtcaggagttcgagaccagcctgaccaacatggcgaaaccccgtctctactaaaaatacaaaaattagctggtcataatcccagctacttgggaggctaaggcaggagaatagcttgaa

SEQ ID NO: 121171 - DNA, 1088 bp, Homo sapiens
tatcaaatgtttaatctttttgtttttgtaacatgtgactatatttggtgtttataaggtagctcccctgtatggacaaatggtattctttagtatttattatcaaaggatctggcctttgatttataactttgttttcctctgcctcatacagaaataagttgtttcctgagtctgctataaggaatatcatgtatcagatattacaaggactcgcatttattcacaaacacggtaggtgattcggagtgttgtgcttttgaagagcagtgaaatgttgttatcaagtagaagttgtaggaaacattaatattttttgtagctgactcccagaaaaggttgaagagttgagaggctgacaatggattttaaaatatattaacttttataacttgatctctgaatttccctcattacttattgtgtctgcatgtttttattctgtaggctttaacattaagcttgttggttatagatctaaatattgtttctgaccattgagtagtatgttaaatgagaaacctacaattagaattctgagcagtttcatgtattatgtttggtccactaacagtgcttcactgttacttctcatttttctaatgtatttatatttcaacttgtttcaagcgagtttaaaagtagtctaacaaaatgtatgcgacacaggaaaatagaataaattaaaaattagcaaactaaaaaaagagacaaaggcaaaacaagatgtggatatagccagaggtgaggttagtcctcaaaatgcatgccagcaagttttatttcaatagaagaagcaggctaagatttgattgtgagctcgttgtcagaccatgcaaaatgtgaaatattaccagttacaacacacataggtaaaaagagaccagttacccaagaaaagcagaactattcttgataccaagaccagagagaagcttttttcatggaccctttagagaggacggtatgtaacatgactttatcataaacacagtgatgggttttagagggcagttttttgtcatatccctcaatggaggccaattacatcacctaatcagagaaaacatttctacgggggccagtct

SEQ ID NO: 121172 - DNA, 1011 bp, Homo sapiens
caaggaataatttatggatgattaaaatagctttgtacatgcttagatttatagttgatatagtcatttcatttgaattttttcactaatgctggaaagggaggcaaatgataacattacagctgaagcagaagattatggtataattgtatatactgttattagaaagctttcatctttaatggatcacttatatcaatatatttcaatataaagaagttgaatgtgttgatttagtgaattattattgcctattttcttaattattaacgtaaaggaaaatcacttgttgagtgtttttcctagacataatagcagtacttacttcagtttcttgctctaataatttgcactccactttctgtgaggaaattcattgacccccacacccttgcgcttgttgagcctcacacagacttaccagcactgggccacagcctaaccctgaacacagaggggagggaaggcagaagcgggtagaaaggaggcaccttacaagattcctcatccgttcctccttgctgaggtccttcttttgtgccatgtcaagcattgtggagcaccgatctttacttttattcagccttctgactggattcattattctcctcctttccccctgcccctgggattcattattctcctcctttccccctgccccttcttctattgattttgttccaatttttctctctgtcagagtagattgatcacattgagttttacatgcataattctcttccttgtgcagtggagtggtgcttcatctaattttagtcctctcacccagccctgtttgaaacacctaatagaatactgaaaaacaccctttctttttctccaaaggggtcctgtacatggaagtgaggttacaagtctaaagcagggatcagcaaacgttttctgtaaagggccagatagtcagtcttttatgcttctaggactaaaaggtcatattgaagatgttatatagatacatgtgtaacaagagcaaaaacaaatttccataaa

SEQ ID NO: 121173 - DNA, 1022 bp, Homo sapiens
gagaatgtgcaaactccacatggacagcagccccagccgggaatcaagtttttgtccctcatcaacattataatgaaacaacattattccaaaacctgctgtactttgggctttgcaggctctacagcgtcacacaactattcagctctgctgttgtagtcatgaatggtatgcaagtatgtgggtatgactgtgttccaataaaacacagatttagacttacaaaaacacgtatactcaaaatgtatattaacatttatccttgtctctcatttttctctgcaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaagtaagtttgatccttcactgccatgataattttaactctaccctcaccattacccgtctttgtaacagttctaaaggggagtgggtaggatgcctagagaagaaccttagataatgattgctgtgggttagatgattattgactctgtaacactcatgttagaggtctgaaaacatttccactttagatttactactttgcacatagtaaaagtacttgttatcaaagtgtgttttctcttattgtgaggtagtaacaagcaggttaataaacatcattttacatgagaggaaactgaaactctaagaaataagatgacttcatttgggccatctacatgcgtatggtggtctggtgactgctgtcttgttccctctgcacccccttgcccttcacaacctgagtccagacacattgtattagttatctgttattgtgtaacaatttactccaagacttagttg

SEQ ID NO: 121174 - DNA, 1793 bp, Homo sapiens
ttatattttatctttaaataagctcatcatggctgctataaaagataatgcctctgaaccaaaagataaagtattataagtgtgatgtccaactatatttgacaatatcatgaaagtaactatctgcgtgaacttgtagttcctagcagatgattgtcatcctaactcactttttttgaaatgaaagggccacaatagtgccttgcttttcatttggtgcttttcccaccatgtcaagaacccttagtagccacttaataaatgtataacgatggcccagagcttatgagaaccacacgtttttttaggagagatcagtgtgagttattttttacctttctataggtgaagcatgacctgtgataaagtattgataacatgtgactgctcttttgactaccataaaagataatgcctgagaaccggaaaggaaagtactattgtataatgcccaaatacgtatttggcaatatcatgaaagttactatctgcatgaacttgtggttcccaaaagatagttattaatggttttgccctcttggacattgcctttgctttgaaagagaatttactagagaatgatttaactaagacaaaggggagtaagaaaaatgtaagatatacatgccttcatgtgatcttagctgttgaaaagcaagttttttcctaaattagtgtaaaagtttttagaaggagtcataattttggtaccctagtcccagtacagttgtccagtttgcaaagaagtggggcgtgacgggatgacagtgagggtggacgtggtagtataggaaaatcatctatggtcaggattgccttttaaagctccataagttgttcattcattagttaattcattgaacatgtctttattgtgagtccgtacttgtgccaactatgccagttctctgggaactgagtactgggaatacagttgtgaatattgcaacgtttctgacctcacagagcttatattctaaggttaaacacagcttgtatgtagccctgtaacctaggggtaagtgagggctctatggagagtactaaagtgcttctgcttatttgggggatttcctcatcttcagggcttgacaaactatggcttgtgtgccagtccttcctgctgcctgtttttgtaaataaatttgtactggaacacagccatgcccatgtatttacatattgtctttgactgctttcatgctacaatggcagagtggagttgtgacggagatggagagcctgcaaagcctatcctgtttactgacccttcacagaaaaaacgtgcttatccctgccctattttatttttacattaagcctttacttcctttaattcattttgattttttgtatacatgctagcaaagcatcttacactgagatcagctccttagtcaaatgtgttgtaatagcatataaatactgataacatgtggctgtccttgtaactaccgtaaaagataatgcgttagaaccagaaaggtaaagtattattgtgtaacgtccagctacttatttgccagtatcatgaaagttactatctacatgaacttgtgatatgctcttagtcactcccctatcttcactatcccttatcttgcccacccctgaaacacaggcaagcaggactattgccaccctcggcagttttcattaagctggggactctcgttctagctcatctacagtttcacacatggcagggtaaaggtttgtttttctggctgtttttttattttttattttttttaacatttcgcctttacttcagttctttacagtccaccaaa

SEQ ID NO: 121175 - DNA, 1025 bp, Homo sapiens
acagcctcccaagcctgactcttagtaagctctcattaaatggttgctgaatgaatgaatgaatgagaagcatccctctggtcttttcagtgttctattgcctgtctaatctttaaaatgatcacttcatcatatctattctggacgtgcaaccttcagtttctctccattatgtactatctcaagtctaaaataatatgcctgacttctcaaggcctatcataatcagcctttcccttcctatctaaaatcctcttttcatttcagcatgcatctctgcactctaagcagtctggtcttcttgctgtcctgctaatggtgccaggcttcttgccactgcagtgtcactgctcatagtgctttccctagaaactacctcccttctctttactctcctgtgcgactcctacctgtcctcagaggagcctaagtctacttctcttataatatttcctctttctatttctcaagatacttgcttgttagcccttcattatactggctgtattgatctccaattggtttaggttagtttaagcctctttagggccggagccatatgttatgcatggtaatgtggtattgtgggctttgaagtacagcagaattggggcaagggcctgactccacttattagttgtgtggccttctgtaattctcctactattaatctcatgtgcaaaatagggaaaatgctcccccccagtttcacccccgagttgtggtgtgaagatggtctatagtgcctacccataactggcatatacatgataaaggtctgcttatcccttgacagtaacttaacagagtccaattcctgaacactcagcctggaggcctagagaaccagggtaaccatgcagtgaatccttagtaagtattatcctgcccttacttaaaatggcttgagcttaggttattcctggctgcagctctgcttctgggatctgttgctgtttttccatctgaaccttgccaggaacactactgcttaattttttttttttatactgctcctcttgcag

SEQ ID NO: 121176 - DNA, 1036 bp, Homo sapiens
caaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacag

SEQ ID NO: 121177 - DNA, 1014 bp, Homo sapiens
ttttttctataacttatttggtatagaacatcacttttcttaatacattcttccttcagtactcattggaaattggttccaggaccctttgtagataccaaaatgctcaagtcctttatatgaatggtgtaatatttacatataacttacttattatgtaaatagttattatactgtattttttttttaaatttgtatttattttaaatatttttgatctgtagttggttgaatcagagaatgtgaaacccatgaatacagagggccagctatatttgaaattgttttttaaaaaataaaaaatagaaattgtttttctatataacctgtctttttgcaaaaaaatattgctgggaaacatcatcatgttggtaggatgagcaaaataacttttttttacatttagctttagttattcttcattaataaagtatttaaaaattattcattttaaaatatgctctttttataggtgaaaattgcttcagaggatgggaatataaaggataaattgaggaaaaaatacatgtttttctttctaagttccaatttacatattaccaacagaaatatgtggtaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatatgtggtaatatatgtgtcagctttgtgtcttttattaacccaatagaaatgtgtaaataaagtgataggactatttgccatattaggtttgtaattatgctttccttttgtgatagtaa

SEQ ID NO: 121178 - DNA, 1035 bp, Homo sapiens
tttctgattatttatactgttatataaaatgtatattaacttctagcaatcactgaagaaagctggagagttttctaaaatgttgttattttttattggatcagcttttttgttttttaccagatagtttgttttttatatatgaaaatgtaaagctgaaatctcttgtgaaataactagtaaaattatacctgaatatgtttttggctctgctcatgtcgaatcacaggggattttttttcctaaattagctcatatagataattctttccataaggatattgttagaacttcagtttctactggaaataacctaacttcagataattttcttcttcctgttcttaaaaaaggaaaaaaatgccaagcaaatatgattactgacattattacattctagagtgctttaaattgtcctaacagattggtagcctaattttttcacctttctccatatgcacgttttcaatcctggttaaaaattgttatatgtacccaagaagccagttgtatggtatttggaataaatattaatatttacttgttgcctttataattaatacagcttttgaaggatatttctcttgtatgaaattcccccttctctaacatcatatgtccagacagggcagagtttcatctgcgagtcctatcaccttgtggccacctgttgctggcgtctccacttccctctgatgggctcctggagcctgggcagcagcagcctgagagacagagagagttgctttgactgtgactgcaggtttcctgaggtcaaaattgggaatttggaaggccttagttgctcaggttttatctaattaaaagagtttaggaactcccatgtagaatgtcaattttctcttcagaatatgatgaaatattcatagtgtttacatttttttgtttttagcagcagtatttgcagaagtgtaattctaatgaaccttgtcacagctgtttgctcatttattttactgttattgcaaaagataagttatactctgtgctttttcagcatccttcaccaattta

SEQ ID NO: 121179 - DNA, 1051 bp, Homo sapiens
cctcccgggtttgagtgattctcctgcgtcagcctcccgagtagctgggattacaggcacctgccactgcgcctggctaatttttctatttttagtagagacagggttttgccatgttggtcaggctgctctcaaactcctgatctcaagtgatctgcccacctcaccatcccaaagtgctgggattacaggcgtgagccattgtgcccggctgacaaggcttttttcttcacatgagtaatttttttggcttcttctcctccactctagtatttccaccctcagtaaggaatggaaacctgtcccgtctggggtgtgaagtgccctctgctttttcccccacattgtttggggttcccagcacctcagccacattgcatgctgggttttcattgtcattgttgcaaatgaaatggagtagacatgtgaaatgctaacctatctaggacctgatctatgccttcttgggaactgagaatgaagaaacagaaatagatggtggaagaactgcctaaggtgtgaaaagctgaagattctaccactgaagtactgaatatgttgtctagttgtgagactagtgtgtaaaatatatgttttctagatgatttctgagacttgtgatgacaaggaacctgacctaaccccatttttcataaagacaaagaacagcaatgttaaattgccatatgaagagaaacactagtgatgtgcgtggtctccttgcctcttgtttccttccctcttcctcactgacttccccttgcacaggggcttctgttttatcccatttattatttgtggcacctatatcaatgtggggtttgtaataggtgagaaatatttgcttggagaagctcttgtgcaattagcctggcaatgattggccggccatgtttgaatgccagtttctcttctttgctgaagtactttatgataaaagtaagcctagacataaaatctggagagaaccatgcaataaacaagtatttttgaaataaattattccttctcctttattagaatagtaacagatgcacatgatacaaaattc

SEQ ID NO: 121180 - DNA, 2690 bp, Homo sapiens
agcagcatagcactttgttcatgaaggctgagatagtcgccgaggcagtgaggaacttttgaagacgaacaagggatgtgggtgtcaagagagctgctgccaggtgggaaagaccaatttggccacataacccctgtcatctgccatccagatactaaaaggcaaagcaaagtgtaaattgaattttctatgtgacattttaaatagtatttctgttgcagcctgtgattcagttaacttacctcaggctaagcctcaaaaaaaaaaaggaagaatgattgaaaccagtgacaaaagatttagtcaatgaggacttgacctcaggagtttctccttgataagatttgatcttgaaactaggcctagtgttagggatgcaattctcagtaaagttccctataaagaaaactgtggtcatttggttctcatctgcccttacacattttagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtgcctgcattttacattttttgtgctggcaattctgaagaactggagaaaaatccacttaattcactgtctaggaacttacacaaatggatataaataattcagttaggaaggccatattattgcttagttctcaatgaggaaggaccctgcataataaggcatagtggtggttccaccctaatgctgtcccctctgcctcctccaggtaatcccactaaaggttccagctctaaatatgctcctttgtccttcctccccattggccccaatctctccccttaccctgagaatgttagaattactttcctaggtctagaccataggtcttctgcaaaatttttttctggaaagaaccagttggaaaatatt

SEQ ID NO: 121181 - DNA, 1051 bp, Homo sapiens
cttagtgttgtttgccagtaaaggtttaaatctactcatcagccttcaccaaaccagaagcgtccatggataaggagttggaaggatgtccagccaggtggcacatcctgcagtgatgttatcagtgccctttcaacatacacacttgctcttccttctcaaaaaataaaaacaaaaagtcttggatgtctctatagtgtatccttgaaatttggagaaggtagtttaaatagcttggagggcagaggaagaatatatataagacaaacacacctagagtttaggataagtatagtgtatgtgttgtgttcatgaagtgactgctgtacctgcagcaagggtagtaagtgttaattcagaaatttaggtgatgctggttaaaaagtctgcctggtgtggggcctcgtccatgcactgtccctgttcagctgcatcccctctgttcccctagcttcagtttgtgctgacaatcatccagaccagctgcggggtcatctggccgtgcacattccctcttggttggttgtatttccagattggatacatgatttccctgattgctctcttcacaaacttctacattcaggtaaatctcacccttctctgggacttggaatctggggcctttaccaacaaaggccctcatctatttacttaatgggcatgtggagcccttgctgggtgacaggctctggcctctaatggagtcactatgacaagagcagcccctgcctctggggggctcacagctcactggaagacactagaatcctgttctagagcctgggtgaggaagtcttgggattcccctgggaaatggaaaactgtgcagcaggaccctatgttgcttccctctgacctgcagcagagacgtgagaggtgatttcaatcagaaatctctcagttcactaccctgaacgtcatggccaaatgaaatttcagaagagatttttatcacagtcctcagatatggagatctgcttttttgtcccagctttcttatacattcagtcttcaggtgtgaggattcggttcattcctaagcatatga

SEQ ID NO: 121182 - DNA, 4067 bp, Homo sapiens
tatccctgagcctacagcagtggttctcaaagtatggtttccacatcagcagcatcagtatcacctggaccttgttagacatacaaattctaggcccccagacctactggaacagaaacacccccagggacccatgttttactaactcacccctcaggtaattctggtgctgcacactcaagtttgaggagcactggcttagggaaagcagccagaggcttctgtggggcagagcagggagcctgtgattggcttggtctgggcacttgtgctaggaccaagggggtgacgggctgagggttctgcagagaagcagcgtggtaaaggaaggtctctgagggcagcagcctgggagtgacttttaagcccaccccttaggaaattgagactcaagtcattaaagctttccttttgtttacacttgcctacaattgttttttctcagagcaaacttggctcagcacagcccaaggtaaattatcacagattctgcaactaataaagttcaatgaggactttacatggctcagatgctgttggtgactggctctttcttcttttttagttagtaacaggagtatgggaaggcaaatacaacttcttctgtcagggcacacgcaccgcaggagaatcagatatgaaggtactgtctctttttcagaaactttattattataagtgttgagtttttaaaaataaattgtataaaatacaaaatggcccataacctcactgcccaggcaatccctgttgatatttttaaaagaataaaaaaggcaatatatacacatcaaattaaaatttgaatgtgaaaggtataaaataaaacctaaagcatccccctctgtaaaaataactccggttaacaattggcaggaaaaatcacatgcagtcagtatgttatatttacacaatcaggatcataagagcaatgtcttaaatttttaaaatcattcatccaagtacttttttccgagtagtggtgttaaaaataaaatctgacttccactcatgaggtttgttttaaatcacaggccaacagtcgcagctcagcatgggcagtcatctccttagagcacttgtttgacatgtttaattgggcagagacctgacactgcaggttctgattccttttcttctgtgtcacttatcaggtcggctgctccatgttagtccctgaaatcaatagcgtttttcagatggttttcctttgctaatggctgtgcaggctgcttccagagggaataggcagacttcaaggttttgaaccttgagcctcatgtttttgttagtctcaaagagtgtcagggaccctttcaaaaatattccctgtagtcatttcaaacccctccagctgtcccaacccaatcatgttctttggttaaaggtacttggagagtgaccatagctcccagccactgatggacattaagagctcttggggcactcgggcttctccgagttgacatcagatttttggatattagtgaaacatgtcagaggtgatattccagagaagccgtgaggataagccttaaatctttgaccctttcctcttagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactgtaagtattagagacggggacttggggaacaggtgtgagcagggaggagagttgaaactaaggctttcagaaaaggtgctgtttctgtaaatgtctaggtcaggctttcagctttgtgttcaagttgcttttaatgatagtttatgtacctatgcacacaaaacccttttttagttaagtgaactttctgtgctgattgggtgagatgagggagataccactggggacatattaaggaataggtacaatattctctgacttagagggcaactttccaggttctttctggtccttctgtatggtgtggaaggtttgagacgggcaggtgaggaaaataggatcacactgttgcatgagtaccagggagcaaggctcattttgaaatacagctttagctgtcatgcattaggaagtctccacatgttctaacaaccctcatattccctgaagcatggtgatcaaggtgtcttctataacgagcaccaaaacttgatataaattttctaaggttgtacttggtttttggaaagcttgtagtccaaagtttcttataattttcagagattgccaccttcagattcagcctgggagttttagcaaatgtctcagtcaaaagtcccgtcatccaaacactgaagaatttaactgagaacctatgggtctatttatggatatttttttctctgggatagcactgcccttgattacctgagcctgctaagattcacagtgtcatggaattccagagctaggaaaaaaaaaaagctttccaaatacagatcctttgggtttgggaggaaactaagaccacagaaaggtgggtagagttggggctttctgctcttcctcccactgtcagagctcatgatggtggattaactgacctaactttctaatagaaacagcccctccctacatttgaagagtgctttaaattttcagagaactttcaggaggacagatttaatcagctccacttgggccatgagaaactgaaccagggaatggatgtgatgtgtccaaagtcaaaagccagttcctatcatagccaggagtagaaacttccctaacaccaggctgtgcacctgcaactgcacagggaaaagccagatggcttggtttggttgctgactgttggggaggaggacagagtctggaaaaagaactagtggtcctactgaacattgaaaatgatgtgataagatggctcttttatctctaaggagctagactcttgactctattattaataaaaatgtatgacctcagcactgcagtcctgggaaataattagaagatggcttcagagacctctccacaccccagcaaatgtatagaaacaaccatttttgagcatattgcccatcagctgtcttccacagccttcagagagcatatttgggcagttgtgcatgtaaagaaaaacagctgtctctgagagtgggtgggcatctgcagcaaagcctgtaggtgctgggatggcgtcgtggcttcagtgtcagatgcccctctagcagctacagctgacccctgggctcggagcctcctggtggctgcctgcccaagtggaaattgaattctcattacacatccatgcattgcttgctgttgcagtgtttgtcagctccgttggaagtcatctctctttctgattcaaaaagaatcttgtattttttttttttttaccacctgttctgtttaaaacactaatacattctccttcccaaatccctctgttcctgcagcttattttggtgccacacttaatagcttcatccacgtcctcatgtactcttactatggtttgtcgtcagtcccttccatgcgtccatacctctggtggaagaagtacatcactcaggggcagctggtgagtgacttggcctctttccccaggacttacttcctggtggatacagacctcttcctggctttagtgttatgtaatagcatctaagatgccccttctccaccctttttcatttgatgtaattaaattccttgaagtgggtagattagggaattttcttgttttgaactgatagtgaactgtgaccatgggcatacagctagttgaattgtacaaagaggtctagaatctaatttgccaacttcaagttcagctcttctgagtttttgcacataagcacatatgcatgtatgtgtgtatatgtgtgtgtgttttctaattatagtccaaaatccaaaatgaaaattgtatgtttccaggggttttagaaggagctggagagtagtatggagtccagggtatgtgtagcccattactaggcagcaaggatatttgtttggcaggtatggatgacccctcagcccc

SEQ ID NO: 121183 - DNA, 1052 bp, Homo sapiens
taaagtttgctttactccaaggaaggaggaagtgtataaagctttgcagtggtactgtttgtatctcagttcctcagaaaaaagcctgcaaataatgcccctgggtggttcttggagttggcagtggtatggaaaatttcgttaggtagtggttagctgtttgtgatggcctgctttttcattatagtatagtcctgtcctctttcgatctgattctcagaagcccaaggtagacagacacctgcccctattttcagtacttcaccttctccagcctactgggtcctctcaccctgtggtgtctacttaacacgcaacttgaagaatttctgggaaattgaccaaaacagctctttggaaagaagctaggcctcagtcccaaagggaaaggtggctgatgtgactttgacttgaggattgtctcctgtgatgtgctcctagtggggctacaggggtcagtcctttgctttgagcacctctgtagtccactacccatggacacattgctatcctctgagggggatggagggagtagagccctctactgctagcccattttatggaggtttgatgagggtcttaggtgaataagcttcaactcaggtccttggtcttggtttgttaaattattctatcctttctgaagccagggagatttgagaatttccatgaccccattatgaaattgatgatgaagagttttcatcttgtgaacagagttcagatgaatatgatcacaaagtcaagcctcgtttaaaatactatgaagctctctttattgctgcacatgaaacattaggcctagatttaggggaaagaattggcagtcttgaactctttgtcatttgtttagcaaatatttgtttgacatctctggtacgctaatccctgtgctggaatatgttgatgcagatgcaggagccacagtcaccacccttcgaaatcttacagaagagcacacaacaggcccattaacaaagggagcatgtgagcaaacagctacaggtcactgcaaggtgagggtagaggaaggagaatagacctcaggctct

SEQ ID NO: 121184 - DNA, 1038 bp, Homo sapiens
gcctaagatcatagcaaagacagatagtgcctaccttatgtcaggtattgggctaactaatctaatgcttattgcactcttaccatctgctttctacagagggaaagttctgggaggcctgaacagggagaactgctagcataagagggcagggcttgaggattcagggaaaatgccagacatacctgtttcagtttggattgaggacaggctgtttctttgtgttttgttttaaagacttctcaagtgtacagaacctgtcttttttaacttagccaagagtgttacgttcagctataacccaggggtattcctgttcacaaggagaaggaaaaaaaaaaaacacctgtggaggtcatgggtgtgaaattatcttaatgggcatccttatgctctggacatgaaagatttgaaatgtaaaaaccacatgctttgacctggcactccctaatagcactgcgaaaattggccaactaaaccctagaggaaataggtactttcaattttgagtagttcatggttaattttaaaccaaacatctgcggaagaaaaagatgcagttaaaggtctgcttttccacagaattcttcatggacagagtatccctaccatgttcttactaagaattcaaaaacagatgaagaagggcaaagatgcttggaactgctgtttgaggtgcatttggactgagagtcaggattcctttgtgctaatcccagtggtaccaagacctgggccatccttatcacttctcattccctgttttctcattaaaaatacgagcttgtaccagatctaaaaaatacacagttgaggactcacacagaaacaaagctatgaagagggtcaaccctacgtattcttggagattttgcttagaaaagcaccttaggtcctgtgatgtagttgaacttgagtatggatagtctatttttcattactttttaccccatttctgcataggaggtagtaaacatgcagcttcatcaagctcttatcaccagaagcagccagtcttctttggaaaggggttatctt

SEQ ID NO: 121185 - DNA, 1025 bp, Homo sapiens
gggtaacactatagcctttaaagctaaaagggggaggaaagcttccctctggtggtaagcagtttgtgtacatttttccaggaaagcctacccacttttcattcttacagcaccaacctatttctaactcttctggagaattaagccctggataaaacctatacaggcactcctgtataggttttcagggtttcattttggttttagttcttcaaggagtagtaaagaagaaggtagaggtgggaggaagaggagagatagaaacatgaatcttaaaattagtgttcaggggtcaaaatgaattctccatcagcctcaggccatgatggtgtctccctgtctacgtgtggtggtgtgcaggagtgtgggcgtgtgcaggcatatttgattatcagaggtgttgcagctgtgggatatctgtgtcttgttctcccatgtatgtttcataagccaaggtacagatattctgaatagaatggtagatgttcctagcattacttttatgcttgacatgccaagaaatgcttacaactcctttttttgcttttttttctgtcctattctagaatgaagtcagtttaattagactccaagatggagagttcaggactggagccaggggaagtgcacaggagtgactcctggccccagcactatgcacatttctgtgttcaagggacaaaaccacagcaagctgtcaggtttctgagtgaactgcttacttttccataattgatagataatacagccatgtctttaagagaactcttacagagtttattattatacatggcaatattaatagagaaaaatatttcatgtgatttttagagaacttaagcatttgccttaaatgtttcttaagccctagaaatatagctataatttcattatttatcctctcttaaacagatgattccctggtaaagagaagaaaaacactgtataaagtacagctgtgtgcatctgagtggatgtggggggttctgaacacattgtaatagaaggtacagattttcctctga

SEQ ID NO: 121186 - DNA, 1018 bp, Homo sapiens
ttactgtagatatgaagtactgtaaaataataattgataaaagtaacaagcggaaaaaactgtcttgtcactgtggcattctgttccctgatatggctcttccttgtcttacctcaagtcctcagttgttgcccagacaggatctcttcctgtctgccacctctcattccagttagttccacttttttccccactgagatttcagcttcacggaaagagtttttatggaactaagaaaagaagttcagaaaactggcacttcatttataaagtgaactcacagaattgtgtctttccttttgatcttcaagttagatctagcacagaagtcacttctgtgaattaaattcttttaacctaaggaactgaacttaaccttgtctgtagcatattctttgaaaagaatttattcttttatgaaaaaatactgtataaaaaacattttgagtagagattaatcagtatctttttttttcttaataggttttcaaatggaacattttgatgcatcacttagtacctatttcaaggcattgctaggccctcgaggtaaggtggtttttggttttgcttaccttctgcagcatcactccctgcctatagtcccttgtaaatattgcatgaggagatagtagaaaatgttagcattttctatgataagtctaaaactttatcctggataacaaggaatttggagaagtctctgacagagacacctgctgtgggtggtcctccgttgactttaactggagtttaaaaatatgctgtaaagcttgtagcctgagaatactatagatttcaccattatcagtggcatttttttctcaattcttggcagtctttaagaaaaactagtttccaaaatgcagtgttgcaataggagtttaaaacctttccccttttacaattttaagggctttttaaggtcttctcattttgtatcatgttaactcactggtaaatatgcacctgaaccttacttgctgtatcttttagaaagtaaatcagcttcatattg

SEQ ID NO: 121187 - DNA, 1030 bp, Homo sapiens
gttctttgttctgctcgtgttagtatttccaggtttttgtattccaggctatggtagttccagtctttctctcgaattcaggcccaaggatcctaaaattctacaacacttagtatagtacatggggagggaactagccaggagcgcagaactgatccatggtggtgggggtgagtcagacgaaggtgtgctgaactccctcacactctcttgctcctttcagctgtatctttaaatatagggtagtttataaagagaatggtcagctccagtcagttttttgtagtgagatacttaaaatgagacacaattataatatagttgcatggttaccaaaaacactccagaatcttataatgggaagcggctttttaaattaggagtgtcttttggaaaatgtgcgttaaaaaggaattctttaaaattggttctaatttacctgcccgtaatccatttttactgtcattattttctgtgtgtggctcttgaactagtgaatagctttggaagactgttttcattgggactttttttcactgggccctgttactactccctgttgtaacctgtaattctgggaagccccctaggttgagtgcaggtcagagactcctggttaaagaggatgggaatcgatgctttggcttggtgtcagcgtggtctttttcctgggaagtgctggccactcccagccctgtccattttcctgtcagtgtgtggggaaccagccagatcaaagaatagcttattcttttgctgcatgtaggactaaagctccttttccatggagcctagtgcctgggcttggtccctgctagtacaattgtacagagcagctgtgttcccacttgacccagctcacccaggctgcctgtagtgtgattcgggttattgagaagttatgtcattggcccaccgtagctcagaagataggaaaccgcaccagtgaggccaaccacagacctggcagtgtgattgggcatcttgtgcaaagtaggtcatgccgttcccataaatccagattactagg

SEQ ID NO: 121188 - DNA, 1065 bp, Homo sapiens
agaaagagaataagcatagattcagagtgttaggatgacagtacacaatcagatgtaccactgttggtgcggtagatatttttgagccaagatttaatccagagttatcatttatttaaatgccaacactttaacatgaattctgtcgtcaagttactttcatttctaaagcttgttagtacttggatcttctttcctttatggtcttcacgacattttgaattttaacattcctcagcaaggtgtggttttatttgggaactgattttcccaacctagaaaaatctttttaaattctagaatcagggttgtgactaccaaattaaagcaccatttaatttttcattctgtgtaactggcagccaacttgaagaatgttcccatgcctgcctaacgttaacgagttgactgataaaagtgatggatgggaatgagagaagagaaaatgcaaggaaatctcagtctgattccttgcagcacatgggtttgtaaactcagctgactcatttttaggtgaacaataaccgttaaaaaaaaagtaaagcaggatatgatgaagttaagctagacaatagctaaacgtttttaaatcaaaaggaatgtgacttgactgataccacaggaaagggagctttcaaagcaagctgactgctgccttagaagccagacaaaccaagacttggccctaaaaatatctttactgttttagagtcagcaaacagcctggttgtgggtttaggaaataaacttttctttaatataattcttataccaactctttactataatgtatatttttaaaaatcttgataccttttaaaacagatttgccttaagatcccagtacttttcctttgctgggcagctttgtcactctctcctaccccaggtagaaatggccaagatgcttaatatttgcactctccttgagacgtacttcatcttgagaattgtgactgtgccttctcctcattaaccccaaccacctccttccgttgttgccacctacccccatcccctcatgttctgttgtccttgggagccaagtggaaaggaggtggaggg

SEQ ID NO: 121189 - DNA, 1005 bp, Homo sapiens
ggagtccctatgatgggatcagtatttttataggaggaagagggaccagtactctctctacccatccccatgtccccaagtccccaggaggatacagccatctgaagccaggaagaggacccttaccaggagcctaatttgctggcaccttgatcatggacttcctagcctccagaaccctgagaagtaaatgttgtttaatctagcagcatgtgctattttctttatagcagcacaagctggccaagaccctctccttttcttctccaacccagttgcaatttattaaattgttcatgtatgtgaaaaaaatcattggagaaaaacataatacattttaaacatgtcactgcttctgtagttacattaattttcttcaaataattgttttcattggattttgcataggaaatatgtgatagcttttccaaatcaaagtaggatattatgtactattttatatccatcccctagctcctgaccagtaaaatgttcttgcctttcaagggtgggtgtgtgttaagctgttgttagtttgtgctgatttttttttctttttaattttatttttttcactcaaattatgacataagacatcaatttctgtgttttgaagtgaactgaaaatatgggtcatgactggaggaatagctagatttctgagctgaagggaaaggaccaggttctctgtccctaccacttgccatagtgccttacacatttggtgctcagtaaaggcatattgttaaacgattatatatgccattttacaatctcagttcttttcctaaaattttcatatgattgacttctccaggaatgcatttctataatttctatacaggaataggtatttgtttctccttcactctgtccttaattttcattttggaacctgttggtgtctctcccttggtgttctggctgtaggtgggcacctaactgacttcatgttaatttgatcactggctttccttcgttttgttacagctaaatggctctatg

SEQ ID NO: 121190 - DNA, 1089 bp, Homo sapiens
ttttagtcatagcttcactgagatcatgttatcactgtatttgcttttatgtcatgtctaggcaggcctccttacctgagaattaatatgaccacgtttatcctgttcctaggatgccaaaatctgatgattcatttgaatggggaagaaaaaccaaattaagtgtcacataaacgttgtaattaatgtaaccattgactcactgacattctatattttacaccattgtcttggtgttagattgtcttggacataaactgttcctcacctaaatcttagactactacttgggacccagtagtgtgttacaggtatctgtaggttgctagtttgatgcatttttctattttcctgacagttaaatttaatcttaatatgattgacagttaaaagtgcaggttgtggagccaacattcagggtttgaatcccattttccaacaagtgcaggctcggtaactgaacttactgagaagattaaattaaatagtgcatgtgaagtgcgtggtacgatgcttagcacacattaagtgttcaatgttagctactatgattattatccttggtgtgttttctgtttttaatggtgttatgatcctgaagcaagggactcaataaaggaagaatattatggtttcataatgaaatcctcttaactcattagtgaagcattgcaatctgtaatgatgcaagctttgtttgatgctgtaacaaattaggccagagttaatgccatttcctgttaaaccttggatagcttatcttagtacttgaccaatgttttgctggtggagtcttctttttcagtgtgacataattcccagatagtgggctggttgtcctcgtgaggattttaatgcccaggtaggagttggttgattctaaatggaagctgttgtgttttatgctgtttgtttattctaggtgtggtgattgagccgaaaagtgcaggcaagaggagtctttggggtttctcatttgtgtcctgtgacatgagtatgaaatctctctgtgagcaagtaaaaatatttttccaactgctcacttagtgcctccgcatgggattggaaaagtcaagctgttttatactg

SEQ ID NO: 121191 - DNA, 1474 bp, Homo sapiens
aagaaaatcaactctgagcattggtctcttttcctttaaaatgaaagattaaattttattttcatttttgcctagagcaaattttattttttatttttgttttgtttctgtttggccagggatagagaatgaaagtgagatcatttagatcttagaaaggtagatgttggctgggcacggtggctcacacctgtaatcccagcactttgggaagccatggtgggcagatcatttgagctcaggagtttgcaaccagcctgggcaatatggcaagaccccatctgtacaaaaaatacaaaaattagctggatgtggtggtacatgcctgtagtcccagctccttgggaggctgaggtgggaggatgacttcagtccaggaggcggaggttacagtgagccgtgattacaccactgcactccggcctgggtgacagagccagactctgtcccaaaataaataaagaaagaaggaaaggagggagggagggagggaaaatgtcagaacagttgatggagattgcagcagcagcagcaagctgctggttttctctttatgagattaaaacatcactgctggagatgttctggcctatcctgacctgattttcagtttctgcaataggaaccctcaccaccaaccccagtttcaacccgtaaatgttattaccagcctttttggttcccactggcgtgtttgctccatggtaacatttttagtggacttgtaggcattcacttttagaattgtgtagtctctggatttaaaatattcatacttggtgaccttttagaaagactaaattcccactcttgctcctccatcctcttctgccagttctgtgtgaagtacagttgtaattgcattcaggcatgagtatgtcttagtattccttattattagattggacttttttaccttttatttgatgtctgctggctgactgggatttagggaaaaatttctgatttattttaagatttttagtgctgatactggcatgctttctctaattgggagaataacaattttattgaaatatacctgtgattttaaactgtaatctttatggttatattaggtaggcaccctcttgcgagcacaggttccatctctgttaagttccacatttaccccatccttttcctcatgtcaacaatttcatcctgtcagaattaatctcttataagcccatgctgaacagacctaattgaagccatgctggcgaattggccactcaggtctgtgttttatgagtttctgaaccccagagtagtacttgttcctctttggtcttggcacagcaaatgctacaacaaagtgagtgttatgaatttctccttccctgaagaatagttctcatgataccaaattcagtaattattcatttgcttccaggggagtttgaaatgtgatgtatctccctaggggtagtattcagggtacttctgcttcagtctttggcagaagaaataa

SEQ ID NO: 121192 - DNA, 1101 bp, Homo sapiens
tcctttatcttgttcaactgcagaccttcactccggcggtctccgtgggcatttaaccctttcagctttaacgatgaagtggatccccttcagcatgacataactcatagaggagaccgtaacgagggtgggcttctgccacccaaatgcggccacagactcctgccacgcctggcagtaaaaaaaccagagttcagggcatcgacaacttcaccggggctattgcgcaggctctgcgttccacgcaggcttattaggaagaaaggggaaaaaaatttcccagagacacgtggaaccgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggtaaagccgtcagctccgggaaacttcgtcgggggccgccgctcggccatgacacccgcgcgagcgcgcggccgggaagcggtcagagagaactgccgttaggtctcggacctggtgccgagaaagagctgccggggcaacccgcgctccgcccgcggcctccagctccgccggctccggggtacagcccggctcctcgggcgcggggaaaggggtgcgggtgcgggcgcgggcggctcgccccacgccgaggctgaggcagggcgctcgggagcgttctctgtgctgcggtcccacctgtgcgcgctgacaggcgccgcggggcacgacaccgtgcccacaccagacgcggagggatggatctgtccgcctgggtcctcccgccctgcgggccggagcgcgcggcgggagagccgggggagcgctctcggagggagcgcgctttctttggagtcggcgaaacccgggtg

SEQ ID NO: 121193 - DNA, 1294 bp, Homo sapiens
cttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaacctttgagtgtgtgtgagttccacagctaaacaaatagtagaagagtttggtttttgtaattaacccaaataccatgaaattattttttcatcattgcgacctcagatgtttctagaaagaagcata

SEQ ID NO: 121194 - DNA, 1026 bp, Homo sapiens
acatgaatataagttttgggttttaagtttctcttaaaattccctgattggttgaaaaatcacataccaatccatgattgagtgatacagtcctcacataaataaaaagcctgttcctcccactgggaagcatttgagcagaaagtagaatccctaagggaatgagtcctaattgcaaaggtgaggaaggtgctgcaacttgtatgtctgatcaagaatattttgacttagtcgtgattctttttttcccttaggttgatgagaacatgaaggtagcacagaaaagagatgctgtcttgcagggaatgttttatttcaggaaagatatttgcaaaggtattacattatcttagatttctaatgtcagcttatgctgcaacaagctgctaaagctcccctgaccctcttctccggcaggtggcaatgcagtggtggatggttgtggcaaggcccagaacagcacggagctcgctgcagaggagtacaccctcatgagcatagacaccatcatcaatgggaaggtaggagggtggccctgtacagtacccctcactgtgcacatcccccggcagggagttcataaagtgtcctgcttcttgtaggaaggtgtgtttcctggactgatcccaattctgaactcttaccttgaaaacatggaagtggatgtggacaccagatgtagtattctgaactacctaaagctaattaagaagagagcatctggtatgatatctatttttcttaatctcataatatagacagcatggtataatcttagaatgttcaatttcttaaagtagtcttttaaaataatgctgtattcatgcacagtttcacatttttatatttctgcaattgtattcaccttataatctttgacactcataatttagattagtagtgctttttttcttatcagttcataaaataggggtgcatctgaaaatcactggcatcttagatgatgaaatggcatctggattgcttacttatcatttacgtccaactgtgttgatcttacatcat

SEQ ID NO: 121195 - DNA, 1421 bp, Homo sapiens
taaataagaatctctaggatgggacccgaacaagggtgtttttaaaggagccctcataagtggttttgatattctcaaccagggctatactactactgctctggtcttcatgtaattgttcataaattgttgaacatgctttctaagtagaaataaactttaaaggataattattttgataggtttatcttacgttatagatttatttatttatttgcttttaaccttagtatttattttccctagcttaataagaatgaaagtgatctgcttttaaaagataaaagtatatttaaatcataccagaaaaaaagggtatttaaattgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctacttgttcctaaagtttcaggttccaaatacttgtgagattttcttgatttttagcaaaaggagcttactttggaggtctgtgtctaggtccacaccagtgccccagcaggcattgtgtaagtagtgaataaaacgctgacactcccgcagtgtccgcaggataaaatactgggtgaggtgaggatactaatcaaaccagctatttcaagcttctagacaccctttcttcaaacttcctgagctatcctgtcgtctttctggactaagaggaagtggtatctctcgctttgcagtgagttcccatgtgatctctttttgcaggcattgatcatctcctggcccagcatgttgctcatctctttattagagacccactgacactgtttgaagagaaaatacacctggatgatgctaatgagtctgaccattttgaggtatcttctcagttttatttttatttatttatgtattgacttctgagagtctggaatcctctgttttatatgcatttcacttcacaaaccaacatggggaggcagttttctgtacctgtggagaacacaaaagaaatttcataagactttcatttacccagtgcagtaaagaacttggacaaataaaaaatcggtttcaagtactcttattttacgattcttac

SEQ ID NO: 121196 - DNA, 1688 bp, Homo sapiens
gtaaggtgcttctgactgagggaatcaaagcaggcttcacggaagaggtggcatttaagctgagtctatagcagcactgcccatagaaacatgtaattgtaaatgttctcatagccacattaaagtaaaaaccagatgaacataattttatattttgtttaacccaaaacgtccaaaaatgttatcatttgatccatgtaatcctttactcacaagtaattttacattttttttgtacggagtcttcaaaatctggtgtatattttactctcacagcatgtgcatgttttcattaggacaagccatatttcaagtactcagtggccactgtgtgcctggtagcttctggactaaacaagcatgagtctggaggataattattaatcctgcagagatgagggagggaggagcaaggtattggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaacggcattctcgagcaggagccaaagaattgatactaatgcaaaatctttaatcacaaagttcccttgtagtgtcttgacaccacagatacattttctgttgagttgtcttagataactaatttgaggtatgatttcattccacttacttgtatgtaatcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcctagtttttactgccatctcgtgacaggctagtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtcca

SEQ ID NO: 121197 - DNA, 2435 bp, Homo sapiens
tatagtgtggaactctagtccaaaacagtaatcatgtgactatttaaaattaaaattatataaaatgaaaattgtagttcctgatgtgactgaggaactagcctcatttcaagggctcagtagccacgtggttagtgactaccacatcggtttggatagtggagatattaaacatttccatcactccagaaagttctgtgggacagcactgctctagaatgaagcagtgccgtaggtgtccgaagatgcaagttctgattctaccttctcccttccacacaaacacattctcattctctcttcatccaatctgattctggtgagcaaggaatcccctcagatttaagtttattactctcccaaaggactattcctaaggttctaggctcatagtaaataatgcacatagcttcaagaattctcaagaacccttgtagctgggaactgttttctagataagatcactaccttcaattgtttacaaggtggatttgggcaggcaacagatactttattttatattaagaaaaggtaggggttaaaaataaggcattgatggccaggtgaggtggcacgtgcttgtaatcccagtactttaggaggctgaggcagaaggattactggagcctaggagttaaagaccattctgggtagcatagtgagacctcgtccctggaaaaaaaaaaaaaaaaaaaaaaaaaaaacttggtacagtgactcatgcctgtaatcccagctactcaggagcctgaggcaggaggatgacttgagcccaggagttcaaggctgcactgagctatgattgcaccactgcactccagcctgggagacagagcaagaccctttctcagaaaaaaaaaaaaaaaaaaaaaaatttttttttaaaagatatgagctagtcttgatcctcaagccaaaagtttcttcccactaatttaaaactcctcccttgtttggctttcgcttagtctttgtcctccctcacagcacatgtaatattgacctcaaattcctaacttggaaaaactggggccatcactaaaagtgatgtagaatttgagctttacacttaggaataaatatggagcttcatttttctgtgttgaaattagagctccttaagtcaagtaagagaataggattgggtttcagacttcagagggtgatctcaggggtagatggggacacctgcagagacactccctaatcttgagggactcatgaggtgacctatagaggcaaaaaacaggctccttccagattcagagcctaccaggaagtgggaggcagtggtgccatgcagcaggtccaaagataatctgagagtttagagatggaaaaggaagacacctcataggccatgtaggggacacctgtcacccatgacagctgatgtgaccaagggaaatgacttctgtgctatcagtccttcctattagatgaagagatggagaggacccgagtaagtgctgtgtggtttgtgagtgagtggagacttggataaagttagtagtgggctggaattaaaagaagatccttgtgagcaagaagtgtggggagtggttgtaaaggggcacagtatttacacaacatctgttttgtaaacacaaagccctctgaaaaggggatactagaaatgaggtgtctttggcaggtgcagtgatggcaagactgcacacaattaattcttgaaaacaaatcccatctatttagttcttcaatttgttgtagattaggctgtcctgggttcacactgcccgaggtcaaacccaacccagtggaaggaggagcttccaagtccctcttctttccagatgaagcaataaacaagcaccctcgcttcaggtgagtatggctttgtgttgaaatgcagatgcccttcactagacccctgacttctgagagtatagtatttctgtctagaaatcctttttgagcattaactgagttttggctctcttcctaagtaaccagagaagatagcagatgtgcacctgttcacatcttcagtacccccaggcttcttggttgttgatgcgtgcaccaggcttgatttgtcaattctccaagtcgtcacaaagttattcgctgagccactgcgaataactcttttaatagggagattattttcagtcctaggtctgtaaatgcctactgggattttttttttctcttagttatttctccttttttgtcctctctaaccatcagtatctgtgatttgcccatcttactctatataacttataaaataggtgcagtacctgatatatataataggcactctcttccattaacttcaagttctgttggtttgttgttcaattctgaggttttaagttgctttaaggctctcactagcctgatcttagctttgtacaatgcatgctcatctgtcatcctgagcctaggctcctgatccagagtgggaacat

SEQ ID NO: 121198 - DNA, 1048 bp, Homo sapiens
atgctctcatgagtgaagacggacagctctgtctctgtggagctggggggttgaagaacaatcaaatacccatagattcataagcgtcaaagtggggctgtgctagcaggaggagatggggagcaaagagtacaacctaggtatccagtggactctggtgggtggagggggagggggtgggatgtccaaggttccaggaggagtgaaataggaatgaggagcggaggacagtcttagggagggggagcagtgtgtgtagaagtcctaggatgaaccaaacaagcggggacttcctgggaactagaagaaagcaagctggccagtgtgactaggaggctgaggaggaagtgcaggtatggggtaaagggaagctggcaggtaattggcaggccaggtcaggttaaccataaattttagttgttctcctaaaagcagttgaaggccttggaaaggttgggttgggcagatggcatcccctttttgctttgcagccctcacttgggctgtagtgtgagagtagctgtggagctggtgccagggcttactaggaggtgagtgagggagctccctgaggggagacaagggctgcctggatgcccgtgggtgctggtgataggaaaagtgggtggtttaaaagatgacagagtcagtgaactgctggggagagaagacacatcaaggcttttgctataggtcattgtcctgaaaaccttaagagtactagagtagaggccaaggagtaggttacagatgttaaatgacaacttctagtgaactggaaaatttaataccttatatgttcatttttttccccttaacattaagagggttgtacatttcacttagcaaattaagaaagtgggaggggatttgtaacacaaaccagaactgttttatatattaaagctgaagaatatataggattgatgggcagtggtgtttccttctgggccagaaaataaagttttgggttaagcctaatgtgccctttaccttgagaatggttccatatgggatagttgcctttttaaaaaagatttagtgtctg

SEQ ID NO: 121199 - DNA, 1419 bp, Homo sapiens
aatcccagcactttgggaggccgaggcaggcagatcacttaaggccaggagttcaagaccagcctggctaacacggtgaaaccccatctctactaaaaatacaaaaattagccaggtgtggtagggcacacctgtgatcccagctacacaggaggctgaggcacaagaatcacttggacctgggaggcagaggttgcagtaagccaagatcgtgccattgcactccagcctgggtgacagagcgagactctgtctcaaaagaaaaaaaacattttggacccaatacttgttgacccttatgtagttgaatagctatggaaaagtaataatcactgagaactgtgaaggacttcttagcttcatttatacctaatggtttctacacttttaaagcaactttaaaaacttaaaaattgagcagactatagcaaaagaataagatggaactaagttatttctcctccgtagccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccaggttagttcctatattaacatgccccagcagatctctcagagatacaggtaatgaaaagagcaagtcacgacccgggcattccaccttacaatcctcatacgttacagatggtttatcttttatagactgcacttgatagactctgtaacagtagagctgcagacacagttgcatgccagcttctgtcagctgtggtggctgcaccgtggtgagtgcactcagtgggggctcagtgggaaagaccaggatactgtgatgacagaccagcagtgtggccgtgtctgccgcaggcgagggtggagggagcagcacgcctgccacacagttctgaccctgtaagcagtagccaaagcttctggaatgctgtcccctggtgactgtgacagttgcgccctcatgcactttcaaaaagcagcatttacctgctagcatatggtggcatcagtggcagatcagaggatctgcagtgctcccaaagcactatcgataccgatgctctatgaacaacgtgagtcattaggtccttgcatattgttctgaaaagaagatttagggtttgtcatcaaatctagttatgaccaaaagtacataaaagtaaatagtgaaattatgttcttcgcttagaatgaggtacatgaatatcatatgtattatacatagaacctctatgtaaaaatacatttctgccaaaacatgaatgtgatttatctatgctagatgtctgtcagatggtgacagtatacttagctcctcaaagttcaaaggagc

SEQ ID NO: 121200 - DNA, 1111 bp, Homo sapiens
acttggcatgatctctgtggggtggatgcagtgatctgcgtctttgacaggcgagagggtgattgtgctgcagtcagtggtgcagctcccctgggggacgggatcctatgggaggttgaattttatgttgaaggatccctagaccctcacctttgcctagccagtccccatgtaaggaatcaacttaaatttaaatggcacttcctctgggaagccttctgatcttctagaccggcttagactgtgctgttacatatgcacagctctctttggtcattttgagcactcgttcagataattcagcaatagcgtgttattggctgtcagtccagccagtgtaagcctgagaacaggagccacatctgcctggctcttcacagtattcccagcacctgcttagcaaagagctttgttgaatggatgaaaggacaaaggggttagtgctgggggtggggggcagggagcgtgtccagcaagacagtgttttttggcactgagtagtcatcaactctaactagagccttagtcctcaaaatggttgcaggcttgtttaggagttagtgtaaggagaaaactaagtctctgagaagcaacagttggttctagcaaaaggatcaaaactattgtttgggccattgcaagagagccagcagtgtggaatggaggagctggccctgaaccccagatgtcagtaggggtctgaagaccctgccctgcacgcatactctacctggactaggtcctggggagcccttcactgtcttgccctccttggcctgaccacctggatagagatccttcccagggtgtaaggaggggaaagtcctcatgctgtctctgggaggaatgtaggacctcacagctcatagtccctgaagggcttggtgtaggtttcttctcttcagaggtcaagcatatgatgggttaaatagtttgagagggaaaattccttccttctcatttacagagaaactgacaaaagaactttctccctaaatggggaactgcctgtaactgctctgagtattatagaactgtattgtttcctaattaagcattgtttttacctctaggagtagatattaagaaattagtatttcataaaataccc

SEQ ID NO: 121201 - DNA, 2596 bp, Homo sapiens
aaggctgctctgggcaggataaataccttgtacaactttaggaggcaccagggtgggtagcaccccttgagggtggaaaggggaaggagttacagtgttgggggttcagcaaaggtctctgaaggagtggcacttgacttgaagcacacaagagccagctcttgaaatactgaggtaaaaatcttccaggcagagggaacaaaagtgtcttaaaggccttgaagtgattgttgtagagacagaaaaggccagtgtagctgcaacatcgtgtggggtgggttgaaatgaaggaggctgagaagattggtcctaatgctctttaggagggatgttggagtttctgctgagtgtgagccatttaagagtttcaaggagagtgacttgacctgcttgctgaaggaccatggtcttcctgactgtagggttagacagcattccatgccagtagctttcacctttgactaaaacaagcgctctgtgaaacaacatttccacgaaacagcagttcccttcccatgagtgacatattctgatatttctattctaccctattaacgattattttttgttatgttgatcacaactcatcatggcccacaaaggagctgtaaccaatgtttgagaaacacaagacactattctgtgtcaatcagtgtatcactgccctggagctagaaaatagtaaccactaacccctgagtggtacagtgtacttaatactgttttagcactttacatgcattgttttatgtaatcctccccagcagccctgtgaggcaagtattacctccattctgcaaaaactgaagcatcgagaagttaccaagattcaaactgattgactccaaagcctgcactcttagctgctcccccacctattaccgcccaaataggcaggaggaaaagagctctgtgacagttttaataggctccaaacagagatgagattgagggtggcgaggaagagaagaaagaatagagaaagggatggtggtaatgcaggaagtaggctttttgttttttaatgaaaatatgaatatgtcatcagccacagatccacgcttaagcattttttggtaccccatagcaggtaattctcttctagtgaaatgccagcactctttcaaaacgacaccattgaatatgcttggtaaaattctcggtctgcaggacaaatgctaacaagtttagtaatgtgactgcagccttcccagctaatctgctggcaagcgagccctgtgaaaaggcagatgcaggacgagccctttctatgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcgtcctgtccctggaggcataggtgacccccagtgagcactagcagtcactttggacttagaattcctgtatttagcattgactctcacttagtctctttagaaaactctcttttttctctctgttaggttgattagtctaacttcagttcctaggaactaaaatcctgaatttctcataggcagtctgaatttagggcagcctaatttataacatgccttagaaggaaatcatgtgtgcattcttgcttgctcagcccaagaagtgtatcaggccctgagcggggcaccgcccactgggggatgtgttctctgtcttgtccccatgctaaagccctaaactctcctgcacctagagggaaccgctgcagaaattctccatgattctcacccactacagtgccccagctctggctactgcagggcagttgatccaaagcagcttctgtctggggatcaggatactgtttcttgtcaaccacgtggtgactagaactctagcaggggaatacgttcttaggaaaaagccaaggaattcatttgtctttagaactcagaacctattgtactgaagtacagatgattggaggtaaataaggactattcatacttacaatgttgtttctttaagagaaaatgtgttctggtttaggtttctaaattacagagtacctgagtaatgctggtggccataagcagacatccccattggcaacttgatgtgctgtcttttctgaggttaatttgtgtgagatgactggttaggttttgctagatttggttcagaaataaagtaggaatgccttaatggtctttataattatcagaaaattaaaactaacatatgcctgaattgtggtagcatgatgtttttaaaaaaatcaaccaatgtaaattcagaggcccagaaaatgtctcatgcatccgtggagcatgaaagagcaggtctacattcaaggatttcctt

SEQ ID NO: 121202 - DNA, 1150 bp, Homo sapiens
ttcttgttcattcattcttttgggttttccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatcttccctcccctccaaaacacacacacttcatagctataaattgaaaccagtaaattacggctcagtttcctacatgggggaggaaccttccctttcctgtttaattctaagtgggaatgcatttagagtttcaacattaggatttgcttgtgtctttccatggcctaggtccagcaactaaactttacaaaccagtgttctgcctagagatgaaatgtctctagattctcagtaggttgaaccattgtttattggaatgatctggaatgcagcaatgttaaaactgttgatttagtgtcatctgccaaaactttttgtgccttccctttctgtttttgaaaattacgtgtgtatgcagtacacattaaatgacttcttgagaagtccatctctgtttttgtttttagcttttgccttagatggcttgccacctgtgtaaattgtttatcttttggccagtgttgttatcaatcttggcctaagtgctgacgtgctgttacaccagtgcagaatatctcctttcaaaaagttagttttttttttttttctaagattgggattctacctcctacagctgaagaaattgtgctgttttaaattaggaaagtatgatgactagtaattcacatttctacaaaaagtggtttgtcacacttctttgaacagaaaaagcacagcatgtgttttggtgatgattcttcagttttactgtaaagttcatagtttctttacagcatctgccattttgtatattcatttttgtattgtgtgtcacaggaaaatgtaagacgaaattgggcagggacattatgcttgttcacctctgttttcctagagcccagccttgtg

SEQ ID NO: 121203 - DNA, 1020 bp, Homo sapiens
gccccccaggctttatttagcttagaagcagcaaagccatcaagttccctcaggcgtttattatttcgcaggcattttcaaacacatgatttttttctggccttttacgtccttgaagatttcttaccagtcgtcagctccctcactgctttaagttgtgtaattttaggcagtgatatcaccaggaatatagaatatgtaatttaatagttttcaggggcttcaggatgacattattgaagatggagtgaaaagttattcactagaaatgattcattgctctttgtggtatttgtttttttgttttcttttgtagaactggaagatttcctttgactggattggcttttcactcccttctgcagggtttgtgggttttcctgtaatgttggggaattcagcttggcatgggaaattacataatttcccatgccaagccgaaatgtcaggtctttctgtgatcctaaatggaaacttgtcagaatctcaaaatatagtctgatggcactctgtaaatatggtaaataaacaagcttttcaaaggttacaggtgatcttgctaatggattattattgctctaacagctgttaaattagtattaaagtttttaggttgtgtaaaatctacttctccctgacttattgtgtgtcttggtgcctgggtgtgtacatgccagacatgagaaccaccttgcaaacatagatatctgttccatcccttccattctttccttgggctatctgttgtctcacctctgagatctgtataacttattaccactggtctctgctgctcctgctccaaacccctgtctccttacctgccacacacaagcgcatctgttttgttcacaagcctcaaaggtccttattttggtggccataccagctgtatgttctcctctctataatttgtttggaagcacagcttaaggggaagccggtaccccttaccagggcagcaaagatgcactctccaggtttcagtgtaataacagccaccttctttccactgaaagg

SEQ ID NO: 121204 - DNA, 1053 bp, Homo sapiens
atagactaacccaggaggatagcgttagcattttgagagccaggaaagttgttggcatttccattatcttcataaataagtgacttggagcagtgaaagcatgtcttactaaaggttgttggggagggtcagttttccagtgctcatatagttgctgggctttaggccaggccctgataaatgcgtggacggtgaagtggttggttcacgttttgactggttcacgcaggattaccagacaaatggccacctcatctgtcactggcaaagaattgaaatctcactgactgtaactaaattctctctcactcagttttttcctactcttggtcctggtggaatatgctccttcataatgtgggggaagaacagctacataaagaattcattgtctgtgactgtttatagacatttaaccccaatgtatattcttgggagatgtaggcatattcccatgagtgaggaaggctgagtccagttaaggtgtaagccctcccgcgtcctggaaagggttgtcagagcaaacgctgtcatatgataccgtccttgcagctcttccagctgagccatcacaaatacacgaaaatagcttggatatttggacacatctcccaactttaagctattaaggttttcaaaattctccaggtcccttgatcctcactgtgactctggagtgtaagttttggataggctgctattggtctgagcctttcactcagacatgtcattaccagtcacaatgctattcttttctgtgaggcttgttttttgaatttaaaaagaaaataagctcctattagtatggaccatattgataggaatcaaaatttcatatttaaaagttctttgtaactcatgaggggattacatgaactcccttattaaagaacttaatatattgcagcatggatccttatgaaaaagacaagttgataattgccttgcaaaagctttcttttctcctcctttctaatactcatgaaaagtagtgctagggtttttctacctgatttggtcaatgcttcctttatttttcttctaattaaccag

SEQ ID NO: 121205 - DNA, 1050 bp, Homo sapiens
gtcgtacaaaacatcaataccaagaagttgaatgatcctctgtcatctggcctaagttcctttttttctcagcagatttacctttttaaaacagtttttctccctaaaatttctattacattttttaataaaataggacttatactgtacatatatacaattttacatttcttttttcccttaaccctaaaacatagtgtttattatattattaaatattctccagaaacatgatttttaatggccatataatagttcattgtatgcatttgccatcctgtgtttaatcattcccctattgttagtttcagttcgatatcttttttctctcctcatagttgatctttccctctgaggtaccaaccctgcttggtccagctctcatcagttctccatctgcaccatcagtctggtcctcccatgtcaacagctcatcccttcagtcaagttaccagtaaagtaatgctgtcctgatccattttgcttttagtaaaagcttcttttctccaagtgattgcagttgccactaccagtctgatccacccttctgatcatagcacaatacagaaaacatgcctggtttcttggttttcaaagtgattcacccttgagctattttaattatggggggcaaccttggggcatttatatctttgtttaggatcattaatggtgacagcttaataatgcatgaaagcaccttggaaacattaaaatataccagcaaatgagaggataaaggtattaggggaggccagaaaaattagaaagataaatattttgaacaaaataaatgtaagcatctttattataaatgctcaagcacacacatgctaacactcagtggaaactaatttgcttctctgaaatttggtcatgcaaggaaaggagtcagcactctttcctttgttgcataaagaaaagggtacttgtgcctctgaaacatgaacctattaaaaattatattttagagcaggagaggccttttttccccctgtgatctctttcatgtatttgtcttctgggcaaatagatgggcagggagaaata

SEQ ID NO: 121206 - DNA, 1061 bp, Homo sapiens
acctgcaggcttgctgctaactttccttcagcagcttcctgtggttaggagcccacattcactcccctcaggcacccctgcaccctcccatgtggaagataggagatcttccggccattccttgttaaagggtaagatgctggagctgactttagctcacgtttgctttgattctaaaagcaaaactagacctttctggatgtttccttgctcaagtgaggagaaaacccaggttttgcgtttctctttaaagacgtttgtaaatgaagagagaagtttttacagcctcactttctgggccaagaactgccaagaccttcaaacactgacttttgtggctttgttttctgacattttaggcgcaaagtcaagggaattgtgtgctgtgttggaaaagagaagcatgagtttagggaaaaagagggcagtgcttatggattatctaagctgcaaggatttatttattttttttctgaaggacaagtagagagccttgggatgagcacagtgcatatggtctcttccccagaatgactagatgtgctcagcagagaggaccctggctcggagccctggctctgctgtcagcacgcggtcgactttgggcaggccccttccgatgccgctgggccttcttttgcggagtgggacaagaccctgctccctgtatgagcccagtgagagtcaaggaaagtgacacacttctcttgtcttaacttggtggatttgtttttttaaaacaggcaaatgtctaaaacatatatgagaaaaaaaaactaggtgtttcccctgaacatagattagaggatgattggagtatatgaactagatatctgaatttgctggtaacattttgtctacaaaaagtgtacagacttagaattaagttctgcaacagttttctgtggtgaaatgcgtatgcttcaatgcttggaacttgtatctgctttctctgctaactgattattagctgcttgaggaaaatgacctctgattatgtgagaagtggtattatcgcatagtaggatcttgctattcaagaatctagggcagactttctt

SEQ ID NO: 121207 - DNA, 1082 bp, Homo sapiens
ttgagacgaagtttcgctctgttgcccaggctggagcgcaatggtgtgatctcggctcactgcaacctctgcctcccaggttcaagtgattctcctgcctcagcctcctgaatagctgggattacaggcgctcaccaccacgcccagctaatttttgtatatttagtagagacggggtttcaccatgttgaccaggctggtcttcaactcctgacctcaggttatccacctgccttggcctcccaaagtgctgggattacaggtgtgagccactgcacccagcgtgtaaatcttttatggctagaaatggggtatcatcccataaaaagtagaagagctttcacagaaagatctgacataacatttctggggtaactgttgtgctgtcttggcaaaaggttgaagcattgccagaagtgtagtgataatcaggaaagacaaatactaggaatgtattggttttacctttgaaggaaaagtaaagggatttgataacatgagtgtcccaggtcccttggaagcaggtgtagctttcttctatggagatgactttgtccatctctgattactgatgatgaaaatcatcccgtgatcctttctcaaggtgtggatattcactaagcactgtgatggggcatctaattttctgatatgggtgctgaggagaggtgatacactaacgtgatgacatcagtacctagttccattagcattcacattggtcacaaggaaattttcttagtgtggcacatttccatagtcatatcttctctgagcaaaccaactgacctggcaactggtcaactctgacctggttagccaccaagttttgtctcactggtagtgtactacacgaggctctgcttcaagcagccaataagcttgcctctttgaagttcttctttgcaatatagagtagcgttaattcagcaggtttccttgttttaacttggtatcaatgaagtgagttaaatttgacctatccctgagaagactaagaagagcactccaagaagggtagagaaatcagttattaggatcatttattttctggtttatgttctttaaagtacatgttcttt

SEQ ID NO: 121208 - DNA, 1049 bp, Homo sapiens
ttataaactacaggaagaaaaattatgcagtagctgtcctgtgttttattataatctcatgggctgatgaaattttctctttagtttctgctaatcaataaagtatttttactcttaggcacttttagctgcagcaataattcatcattttctttcatagagtattcagtagtctcaacatttttttgcctttattcttagagcttgcatatctttctactttaattatttctagatcaccataacaatgtgtttatcatgcccctgtacatctattatgtatacgaagtcttgttttttccttacaagcgtcttatatataggaagacaaggcaaacatgccatatataatgtcatttttaggaggttatttcagttagcacatagaataaatcattatatttatgcttggtatacactatacatgaacttttttaatttacagcgttttgtttgtttgtttgattttaggttgccagaaagctttcctgaattacagaatttaacatgtctttctgtaaatgacatctcactacagtctctacctgaaaatattggcaagtaagtttttttgtgaagtttgggtggatcagggtgaaagggggtttatatcatcagctctagcctccttcccttttaaagctcctatttgtctactcagaaagccatttactcattctttaatgtgaccttcaagaaagattatagccagcctcctatgtttttgcatctaattttccctaaattttattggttaaaaagggtactgctacttgttactagtaaaaaccctaaattgtttggaagtgctctttaaactgatgtatggcaaagtagttaatttaagccaagtactatgtgtcatgtaggtggtcagtaaatactggtagaaacaaccactcagtaattttaaaccatgctggagagccaacaaacaactccattaaaaacgaaaagtatgtgcccctaaagaacagctatgtctgacagtatttgtgaactgtggatccaagaatagggaatgagaatggtgtatttggagagtggga

SEQ ID NO: 121209 - DNA, 1022 bp, Homo sapiens
ctgatattcagcaagaactattgcttctgttgctggatgagattatattctttaggtccttgcaaagatcttatttactgtgagccatgttaaaaatgtgtgttaaattaatagtgaaattgttattttaacagaccctgcctaaaagcattggaaaactaaagaagttgagcaacttgaatgcagacagaaataaattagtgtccttaccaaaagaggtatgtgcttttagagaaatcacatgataataattatgaagaaataataataatacataagggatcaaaaatgtcaaatgctttgaaaagacgcatgtgttgttttttaaaggtgtgaactctaaatctgtgagtatagagccaactggaggaattatgtcaaagaatgatcatcagtaacattaaggagagttggaaaaggtgaatttataggattttaaatgggagaaagaaagagattgacattttgggtttgatatacagagaatggtgacaccattggcagaaattgataatttgggagtttgacagaggaagtggatgcctttgggtttgatttttgaatttaatgtgaaattaagctccatcccataagcaattggaattataaaaattgatcttgatgcaaccatatttctgggcagagatttacattgggccatgctcatgtcttggatgaggttgaacaaactgttcacaaaggcatacacatagaggaaggtgaatgggaagctaaagccagcttcctaggactttttttttggttagtagtctaagcacgagaaaatgagacatcaccatctgttgtggagagtagctgtatggactgagaggcatttaaattctggcaagggaggtggaaatgctgacaatgaggaggaagcttatagtgggtcaaacaaggaggtgtctagtgtgttgtttaaaaagaaggcttacaattagccaggcgtggtggcgggcgcctgtagtcccagctactcgggaggctgaggcaagagaattgcctgaacccgggaggct

SEQ ID NO: 121210 - DNA, 1049 bp, Homo sapiens
gtctggtatgctgtgtagttcttcctatattttttcctttaaaaaaaacaacaacatttatagtattgtgtgttgccagttttagggcacagctccttagtctgtagcagcatttatttgcattttttccccaaatggttgaggggaagatgtttgtaccatgtgggtcacaatatggattctgtttgtgttttgtggtgttatttgtagtaaacatttgcaaatcaatgaatgtcttttgttttcttaattgttagctgcttggaaatttagaaaagtcaggtaaacttgttatcttgtaagtattgttcagaccacagttgcatctctaacttccattctgcttcttaaatgcatgaagattcacattggctgactgctttgtgtgctcttcattgtaaaatattggacattttcttctaaattcattttttttttttttttaatgactgcatggcctggaaccttactttgttatgtgtttttcaagtttgttcagattattcactctcaaaagaatgcttttctgtgaattacattttaagttattcagaaatcctgaaaggcatcatttggcagctcatctgttttcactaaattgtaagtttgtcggcacaaatctgtctctaatggaaaggctagatttgctttatttgctacacctggcatgcctctgatttttcaagtcacttatttgtgtcttttatttttcatcctgttgcttaagtatatatacttctgggaaaagatttcttaaaaactcatagtgttggtggagaggagagttaaggaacatattgtgcagtagtatgattgattcatggatagatggagttggtggtatatgtgtgagcatgagtatgatgaatgagagccagaccataaagagtttttggctagaagaaattgagcttatatccaagtttagggtcctgttttctttttgtctccattaagtccaaatgaaagagacgccaactaagccacacttacccagtcagatgaggcaacatagcatttgcagatcattcatcaaagcttttttcagt

SEQ ID NO: 121211 - DNA, 1008 bp, Homo sapiens
catttaacagatgcagttgcgttagatatcagcagtggaaaatgatttcttctttagaataaaattttttaactgtatcattgattttcttgatttaatttagaacatgtacatctaacattttgcagagatttttatgaacatatggggctgcgttttgtaagatttaaattaatgattgttggtcatcagtgagaccggtgagttatgtggtataagtttatgcatcctttttatactgtttggtaaacaaggtactctgatcctactccatctcccctagaaaactggaaaaaagatgtattttctttctcaccatagatcggcgggtgctgcagcctcactgtgttctgtgtacgtgacaacagactaactcggatacctgcagaggtgtcacaggcaacagaacttcatgtcctggatgtggcagggaacaggtaagcctgttgtagtttgctttgcttgagggaaacaaatatacatacatcccaatcttggcagtgcatcttcaaatttttgtctttgctttatcttacagaatataatcctgatttttcaaatgacctaggcctcagggagttccttcataggggggctagagtgcttgagcccaatggagcagagaaggtcagggaaaacctgagcatgggttaaagtgtcagtggacactttcgtagaaatgcttcccagaatgacagtacagtgatgccagggaaagagcactgacctgagaatggggagacttgggttgtgacttagctcttctaagtagcttttgtaaatcatcatgggcttcagagtttcctcacctgcaaagtgagtgcaaatgagtttgaactcagttttaaccaggggaccttgatatactctgctggtgactctgaaccccctgaaaatacaaacagaattgtgtatttagggaagtgtttacagctaatgtcagaatctccaaatgattcataatacaaaaaaagttcagagccgccagactagtatccccaaggtcac

SEQ ID NO: 121212 - DNA, 1050 bp, Homo sapiens
ttatagtgactttaatttaggattttttatttactcttttatctttttctttccccacaccctgtaattatatcctaaattttaaaataaatgttcttgctgtttatggagcctttttattttatagtaatttcatatttttataagtattcttttattctgaaagtaatccttctatagtaactaggtaagttacatggaacactttcccttttccttaactaccagtgggcagttgatgaatgcacatacatccaaagaaagcttttccacccattttaagaatttctaagaaggtaacatttgtattggaatgctaatgccttgaagctgcatgttttgaaaaaagtagtggaataaaaccaaaacactcactccactgtttgtttttagagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttc

SEQ ID NO: 121213 - DNA, 1046 bp, Homo sapiens
ccttcactcacttcttgtatgttgtcctgggctaagggctgtggaaatgttcatggggtctttgttctaccatctcaaactatgtgcaaatcctaagaaacttgtgagataaagtatttggctagtgggaaaaaaaaaattgataacgtttttaacattaactggagtgacagtttggtaattggctctctgagaaagcttcagcatattctgaaaattggcaggtagctccagagtgagctaattagttaggaatgacttttaatactcactacctttaatagcctacccttggagaaaagacagataatgaacactgggaaatctatggtgctgcaacttgacctttgtgccatttgggggaaatgaggaagatgagtcataatttattatttaaagtcctccttttataatgtgttgttgtgaaagatttgacaaataatgattgctcctttagggactaatttaatcaaagaagcagaaaacaggaagaatagaaaacttgtgtgactaagcaatgtttaattttatttgaaactggctccaccaccctggtgataggaacagaaggtcctatggagtcttcccatagcaagaaaccaggcttgtaacagggtgtaatagagtgacaccccacacctgatgccctgtaaatgcagagtctgcaaatgcctctcttttgatgctttctcaaggtaagtcataaatgaagtcttactgctttaaaaaagtagcttgccaacagttgcccaggctccccatgggactgcgcttcactgagcacctgaagaaagtattcactggaaatgggctctcctgggagactgtctggatcccgagtgtctggcgttcatgttcccacacctggctgctgcttcttgcccttccttggctgcaggtgtgagtgcttgtttgtttaaacctcgctcagcactgcttggaaaaacaaaacaacatggttacttgtctgggcattgaatgttcttcctgaattttggtcctgcccattggcccagaggcggaatgggtggggcaagtttcggtgt

SEQ ID NO: 121214 - DNA, 1046 bp, Homo sapiens
tgttcggggtttggcgtgccaccacttgggacttgttgtaacccgtctccactcccgccccctccagcgctgcaccttgtctcggggaggcgcggttcgagccggaatcagcctccctccgcggacctgacgctgggcaggtaactcccctcccctccctgcccgcgcccaggcgcttgctgcttcctgggaggcaaaccttcggcggccggcgctgtgcggcgggcgcggttgcgcgcggcttggggcaagtaagtggggtttgggctcccttgccccggacctcggcggacgggaccccagcgggtgcagggttgaggtgcttggggtactgggggggcccggggcttcacccgcccctggccggcgcggcggacgggagggataggggactctcccttgggagcgcaggcgggattggaaattccacagggtgtaaagctcagttgcttcagtcttttctacgtttctttcattgtcgtgggggttcgagtgagttgagaagtttgaaaagttgtctcgggcggagtcggtttgggtccccagaggactggcgccgcccctcgtggaggctgcatttgtttcctcttttccagtgtaggagtgcgccgaggaccccgggaggggaagcgggaggagagaccgctgggaaaagtctcgtgggaggaagtccagggtggaagcagagggcatgggggtggggggttccgggaaaaggtgggagagcttaggtcgctgaggggcgtgggtgttctttagatcctgagtggggagcagaacttgaaaagacagttttttcacacaacctcttaattgtacaggatcccgtttctgagtgcagactggtagcgacctgtgtttttcatacttgggtcggcctgagtctgggtctgtgtgccctagcagctctccaggagagcctgtacctaccaaagtttgagaaccactgctctagatcctggtgagtgatctagaagaggagagtaggcctagagcagattgctcctggaacgggacttggagacttttggcctattctgtgtgat

SEQ ID NO: 121215 - DNA, 1054 bp, Homo sapiens
aaatagctcctttcttagaaatttagatgactgaatcgaactccatagctgatagctgatgcttaatatatgccagttatgttccataactctggagtccaaatgcaaataaatcaagtttattcctaaaaatttcaacatccaagggttgctacattgagtagctgccacaattcaactagtcacccaaggcaacaaaccaggattctctatagaatttaatctcactatggattccatgtccaatcagttaccaagagctgctaatctgactttaaaatattttggttgtccttcccttactacctctgctatgactacattgatgcaggtctgcatctctttcctgggtgttcatcctatatactggtcgctggctccagacttgcctttaaaatctatcttccatgctaccatcaaagggttacacctaacatataagtatgaataggctctacgtctgcttgagcaaggatcagtggattctaatttcctgaaaggaagcctgtgctctatcacataatctggcctattattaccttttccagggttaatggtatattttgcctttatccatatacgccatggatatttaagatatcttggactgctcttctctctgcctgcatacagtgccccatatatcctccatcctcttttatacattttgtataaacctcaggtcaggctttacccttcttggcacttttccctgacacattcctttctgcatttttttttcctcagtgggttgatggcctcatatctctgcctccgtaataacctgggcatatctctatttgtggctttaactatggtacagaattttctgttgtgagtccacattgcttgcttgaacttgaaggcagaaaccacattctacgtgaggttcttgaaactccagaatctatcatagtatacgagacatatttaagcacccgacaaatgatttaagaatacatgcagtgttgtttcataatgatatctactggttaaataaaatggtagagaaaagccaaaacaaaattcttctttggtgcgatatcaacaaatt

SEQ ID NO: 121216 - DNA, 1094 bp, Homo sapiens
tggcatggcaacttatttccacatgcttgtacgtaagaagcctggaatgacatttggtttaaacatttgcaaaaaaacatgaaaatattcacatagaaaaaatatattttgtattacatggaggcaatatagttgatgtacatgtgtaggaatacatagaataaatgtttttacacgtgtcttaaagtgagacctttattagttgatgccataatttcacttcagaaatgtggcttattagaagaagcaatgccttgagttgaggaagaattacctaatttatagacaaggattccaggcaaaaagacattatggtaaggccacggaggttagaaacagtgtaggggaatttacaagaaattttatgttgttgaagcatcaagttcaagataatggtaacttaaacaaagctaaaattatatcatgtaagacaatgataaatgatgaggctgaaaacacattctgatgccaaaacttcaaaggcctcactagtaaaggtaaaactcttgaactttatccagcaggtgatggaggaccacaagagttttaagcagggaagtgctatttgcacttcagatttgtattttagaactctttctagtatatctatagaaagtagatttaaggaacataggacaaaacagatcagatcctagactctttcagtgaatcaagaaagaaatattgaaggccttgtgtgtaaggtgtgcatagtacagaggagtgaagggcatattggaaattcatttaagaggtagtaggacctcaagattgacttaacatggaaggccagagagagggaagaaacagctgagttgcatactttttgcatgagtgactaggtgaccaatgatcaaatgttgtcatgtagagacatttgttaaatgcatagctgtcctccagagcagacacttgggcctaaactatgccaggggcagtagaaataaaagaggcaaagcataaaggtcattgcagattctcaaagcagattctcaaagcggattctcaaagcggattctcaaattagctcaaagaaatggaacttggtcatcagtttcctgtggaacttgacaaagctcttgttcttgatgctg

SEQ ID NO: 121217 - DNA, 1035 bp, Homo sapiens
cccacccaaatctcatctctaattataatccacaggtgttgagggagggacctggtaggaggtgatttgatcatgggggcaattgtcctgatacagttctcatgctagtgagtgagttctcatgataactgatggttttaaaagtgtttggcagttccctcttcatgctctctctcctgccaccatataagatgtgccttgcttccccttcaacttccaccatgattgtaagtttcctgagacctctccagccatacagcactgtgagtcaattaaagctctttcctttatgaattaccctgtctcaggtattttatagcagtgtgaaaacagaatacatactcctatttcttaaactgcatggtgactaaaattatgttcattttattgtattgtgttttaaattgtgtctaccttaaatataattgttatattaatggtagcagaaatctaaaagttaaagaaaaaaatgaaatatgtcaatgtaaccattttgggactttttgccaagatttcctgaaccaaagctatcaattacaatattttaaaaaacattgtgctaactcctaaagttattttagaaagtgtccatctgatatctttcagaccatggtcatttgagaacacagtgaagagaccaacagagtaaatcaccaggacctgtttacacaacaaaaaatgtggctggtaaaatattctctactgatgtttctgtaaccagagaccggaaacgtacagtggaaatgaaaccctgtactattctagtgccaacacaaacaacaattatagtgcgatgtgagaaaagttgtaagaaatatttctgggtttcagtggttcaaccaagtcagcatatttctgtaattgtggcagattggacccaaaactttagagtcttcagcaaggaacgactcttagacattaaagtgatccctgataaaacaaccccagggtcatgagaaggctactctgccaatttcatttcactgtgggacccactgacatctggctcagctgcggaagctggaaaactttaaa

SEQ ID NO: 121218 - DNA, 1075 bp, Homo sapiens
ttgtcaatttgtaaaatgctagctattatttcactagccaccattaattttaagagagttctagacatttttattgtctttatatcttcataaatttacttctgtctttaatacagtctttgctaatttcacatatttgattattgctggagagaaactgaataggctgatataactttagaattagtgttaggaaagataatagatttcgctaatattatttgatgaatattgaccaactaaagttatatttcaggtacaaactgttgctagccctctttgaaattcttttttgtttcctcagtggttttataaagctgcctacaaaatagtctttcctatagtaatgttcatggccaccttctagtattatgcaagagtggaaattgatgatagatttttaaaaactgatttaggacatactcagtgacatttagaaggataaggcagaaataatttttagaaggctacacttcttgcatagctagttaagagaaaagatggacaaaaggaaaaaaaaaggcagtccctttgtgagaagtaattggaaaatgcctcctgaccttacattaagtagatacatgggataggactataaaatgatatgatttattctaggtttgttcccaagttgagtttagggcttaaactattcaaatttaatgaactcttccaaggctcaaagtattatcgaataagtgcctgaattcccccacatagcttttgaggacagctgtggtgagaggaagtgcttccgaaattgtgtccctgttcacattctgccttgaacttgagtaagtgacttaacctctctgaaccttggaaatcccagcagtgatgcctgcagtatcagagtgttggagattataaggcacgtgaatggtccctgagtgtgaatgcccacagtccaaagcacctgactcctgaccagtgctcagtactgttatttaagggaatgcctgattagtagacatactgatggatggatcttgggctctacacaagttcactgccttttctgataactagcctttattctgaagattaaagtatgtgtatagttacaatattgagt

SEQ ID NO: 121219 - DNA, 2133 bp, Homo sapiens
tctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatacctgattatttaaagtgaacttcttctattatttgttttaaataaaggttatatgtatgatatatgtttactaagaaacaaatagggtaaatttgggggacatcaaaaacagggagttataataatgttaaccactctttcaacaaatatttctaataagtattagccatgcaccagccattgtaagtgacatgaaactataaggttcctgccctcccctcttcaagagggaatcagttaataagtcactaaaaagcaagggatgtgtggcaggattacagatttaattaaggtaatatagtagtattcttctggcctctgtacatttaaaagtcaaattgtaaaattttcctgaatatgaaaatagtatcagatatcctcagaaggatggcaggttgtaactttaggtatgagggtcccaacattctgcataactttgtggatttgctgtagcaaatgtcactgatggtgttcagattcaagggaacattattacatttttctttcttggccttttcagtggaggccaacactgaagagcctggagtttctattggcataaattaggtgctatttttaagcaatagtaatcccttctttgtccaggcatgggtctcaggtgggagcccttgatgagaaggggaattctaaccta

SEQ ID NO: 121220 - DNA, 1050 bp, Homo sapiens
gtatatctttttaagaaatttcactgtgaaacaacagacataggtacaaaataatcagatattttattagaatcccaataattagtggggaaaaatccctaaataccttttcttgaaattgaagaaggtatttcaccttaatgataaaggacgtaacttaaaggccaggatcctcaaataaaagtaatataataacttttaaaagccctcttatgcttttcaaaacactttcttgtctgttacttaatcctcacattaataataagtgacaggcagagaaaaaatgtgttaccttcatgactccatggcaatctcattgctgagaagtgggagaattggaacaaaaacaacccattctttagcgtttcctcatttcttcctcctcattttcccaagcccctcatttccaccccttcccaccaactgggtgatgttagtattatatattacctctagagatgtctgtcaattattatggatctattatagcaaaaacagagaaaggttcaaacaacctcaagggacatattaacatttgctttaaatattgaaggctatgatgctgtgttcaaaattttttttaagtggaaactctctcaaagtctaagtagttattttgactagtgcaaaactgtgtttcatttcaaataacgtgatgaaacaaaaaaccaaaaaacaacatgtttctatgggagggactgtgaaataaaatcaaaacaatcaaggcattctgagaagaatgattttggtctttcacggttatgaattctgccaccttgagtggtatgtttcataatttgtggcttctcactccctcgtgttgttgagattctgtttaagttaggaatttagctagatcagcattgtcagatcttgggcaaatcatgtgcctcctcaggctcttgatttttcacattttcaaggttatgattaggtgagtgtgaggattaattgtggttatgtgtgtaaaagtattttgaaaacttgaacattctatgtatacaaatcacatatagatactacacttaagtgtatgtatagtatacacat

SEQ ID NO: 121221 - DNA, 1799 bp, Homo sapiens
acaaaagctcctgtttgttttatattttgaaaataatgtagcctaaggtaaaatgcaactccatttatgaagaaatcagaatacatagtgttctgttgggttgcttaggaaggttagcatggctgtggcacagtcttccaaatacatttttcttattgagccaatcccttgagtgcttcttttcctgatgcaacttttcttctaaaatgtgtgctaaaggccagatgtgagcaccctttgcatattcaactactgtactttgtttcttcttctgctaacagtattctttaatgtgattggtatcctgtgtcattttttctagttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaaggtaagactcaggatgaagacttttcctccacctttgcaatcaatgtcccaagtagacttttgaatgttctatttagggccctagaatttgtaggaccagctatctccatttgtgcaccttctcatactgtgggaaatacaggaatttttttttgaatgtatgcttttgcctagtggcccacatagagatgatctatttaggaagcctttgtgatcttccagattgatttttctttttaaagcttcattcatttttttggtgtgtatgatttgccattggatcttt

SEQ ID NO: 121222 - DNA, 1201 bp, Homo sapiens
tgatcagaaacctggaatctagaaatttattcaggacttgcagaatttgtagcatatctacattattggagatctattgaaagggcaagaaaaagatgattgcctgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagtgaaaactgcccttacagaaaagaaaatgagtttataaagatttctcacagagttcagtggaaaacggttttactgtaagagagagtttaatgaagaagaatcaaagcttattaaatttttcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcactgaacagtttggagactcccagcaactgcgactggtccggatcctgcggagtactgtgatggttcgtgttggaggtggatggatggcacttgatgagttcttagtgaaaaatgatccttgcaggggtaaggagatgcttatcatgataacatcatgaaagtatttcaattttatattatatccagcaccaaaacatactgggcataattttggtcatttattccaatagtgaatgtttcacattggtctgtcagcctaaagttcccaaagaacctgtggcagtcatgtaaaccatattcttctcatttttttctttcttttttttttttttttttactttttctggataaatatggtgggcggg

SEQ ID NO: 121223 - DNA, 1058 bp, Homo sapiens
ttcacaagaaaatactcaaatctcatatatttaggttgcttcatattattttatattttgttatgattagaggtaagttttcagatttcaaacaagaaagctactctaatccagaaccacaaagttaaaaatatggactcattttaataaatatgaaaagagaggataatgtcttctccacttgtgcagtaatttttgcttttattcaaaatctcaattaactcggttcactctcttcaaaacagaagaacagtgtgacttcattactctttctctatttttttttttctcttttggaacatctcttatatgtagtagctagataagaaatgtgctgagtttccccaatacagtgtgctacttctaaatgaaatattatttttatttttatacttaaaaaaataatcatcaatgtattcaaaattttaacttaaatttgaaatcctaagattttcaaaaatatgtgtacagaaaatagtctgattatttggtttgaaattgggacaactgggtgcctgcacatctctaaactagatactacatccagaagcacagagtgtgagtatgtgtgtatgttctagagtcatacagaaagtttcctgttgaactaattgtgtctttcttccatttttcatttttatcagttcttcctgggaaatcaggtataaaccagtggaatgtattctcaagttcctgatgatttttttttaactttaattcatagtcattaaagcttgccatggccaatctttcccatgctgtctccctagctactacattgttggttggcgtggtgtttctgtaaacgctataagggtccttgatccaggattcctttttgccttgtgtctctcagatgaggagattacttttaagcaaaccagataatgaattgtagcttggcttgctacaatgttacgaatgcaatttttaattcccattttttataatatgagcatatattttatgctagtactcattggaacacaaatttgattctccacacatctctgtgttaggctcattggtgtttaactgtttaggacatacggtctaca

SEQ ID NO: 121224 - DNA, 1588 bp, Homo sapiens
taactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaagtaagttccaagacagatgactatgactgatacaatttttaaaggaaataagcacattttaaaagtgtgggtctggtaaacttgtgttacaataaagcattgtcttataagttgcctaggaagtcacgacccttaaaaaaatgtttttttggtaaaatttgtggctctggagtcaggaacactcactaactgtgtaatcacagatatgttgttccctccactgaggctgagaacttgttagaataataaagttaataatatatgattcttaaggtgttttctgtgtgtgtgtgtgtgtgtgtgtgtgtgtgtgtgtgtgtgtgttgcctggcatatgtgtaataggaagtcaataaattcaagtccctttttcattctaattcacattctgatctaactttgtcattagtaggaaattagaactctataaaacttcttaagatacttatcacctttttgtttgatggcccaatcatttgtatgtgatttccctgacagatgttactagatgtcattcttaaggtaaatttcatataatttattctttgactagcaattgacccatataaaattgccagtgttaaacattttcaacctaaaaaaacagcattttatatgattcacctaaatagtaattaaagataaattaagattatatataactcttcatttgctgtgatgtaaatcagttttttaaaaaaggattttaatatatttgatcactgatgatttaaccagctacactgagattgaaatgtgcaattgagaatgtcttgagaaagaactaacaagtcactacttaccattgttttcaaaattttagagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtactcattatcttcccattgcgtacaacactgatagtatgttctgccacgatatcatgcacaattcatacaaccattttattttcactctaattgttgtgtcaaagttttaaggattgtactatgtaatattgacattaaagtaaatatttcatcattgtttttggcaggtgacaaggcaggtagctaagtgtaaatgtgcaaagcgatttcaagttgagcagattggtgataataaatacagggtaagttttcaaagtaatgttgtagttcctttaaaggacataaattgaaatctgtatacaatttgatctccattgttttccaggagtcttatttatttacttttttacctcatgtcaaaatttaatggtatatgaaactcttacatttaacattttaatttgtataacggcagcctgcattttgcatattaggaaatatctttgacatctacatca

SEQ ID NO: 121225 - DNA, 1514 bp, Homo sapiens
agagtctcactctgttgcctaggctggagtgcagtggcacaatctcggctcactgcaacctctgcctcccaggttcaagcgattctcctgcctcagcctcccaagtagctgggactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatatacccaggtttctatacgtaactttattgtcttgaagtgtatctttcatattagctagaagaaaattgaaaaaatttacagtaagaatggaaatcatcacaccctttgcattgtctcatttgtcttccattatatatataacattaaagctgaacataacaaaaatgaccatgacgtggataatcttcatgacttagttgttcattggtgaccagcaatctcatagcttttgcccatgttcatgtgacttcaggctctatatacttcttgagctactttaacaacatgacatgacattgaaaacaatcatagttagcttggagaagatttaaaaagaaacacaatttgtgttatatgttttatgcgtttctgaatagaaatgcattttgcgtattacttaattttttaattaaaaagaaatgatgtcggagctattgtaattacttactacacaaggagacaaggtaaactattaagagccctatagccagactccttggctgtctccaacacttaccaaactgagaaacataaccctggacaagttacttaaactcattctgaacctcagtttcctcatctgtagaagggtataattataacttcattggactgcagtgagaattaaatgagctagtacatacaaaatgcttaacctacttccaggcatatagttaaatgctcaagtatttgttgtactataaatcctagctgggacact

SEQ ID NO: 121226 - DNA, 1199 bp, Homo sapiens
ttttttccttgtcattattacctaaacaatacagtataacaactatttacaacaatttacattgtattaggtattattagtaatctagagatgatatgaagcatatggggaggatgtacttaggtcatatgcaaatactacatcattttatatcagggacttgagcatcattggattttattatgcacggtatcctggaaccaactccccttggattccaagggatgactgtacttgtattttgaagtacatgttagaaagtactttgttttctattttgtccccttttcctccccaattagtagatgattttcactgtgaataaaccaattgaagtttttgtttatttgtttaattctggcagtcaaacaaatgccaccagagttttgttttcagccaatgccaacagttaattgaagtctttgtttctgctgtaggaattcatgaagaaactggaagaaaagagagctgaactaaataaagccaccactatgggcgacaccgttttggctatctgccaccccgactccatcactaccattaagcactggataacaatcatccgggcgaggtttgaggaggtcagtgtgtctcagataatcttcagagtagcaatagctttgagagttgaggggtgtgggaaatttcaggaattaagatgcacttatggccatgggaaaatgagacctctacatagaaaacgttcttttaaatacgcttcttgtatgcattacaatctctgcaattcacttttctttaaaagctcaaagaaattttgcagctatgtccctggaaaattagaaggcaaatatttagtacactgtataacattttggcctccttccacattgtttctgttgaataatccagcagttggatggtgtttcggagcagtatatactggtggagtgaattggtatacataaagtgaattaattctgtatttaatatcttagcttttttttttctttcttttgacggagtctcgatttattgcccaggctggagtgcagtagctggatctcggctcactgcaacctctgcctcctaggttcaagcagttcctctgcctcagcctcccgagtagctgggattacaggcgcgtgccaccatgcccagctaatttttttgtatttttagtagagatggtttcaccaggttggtcaggctgatcttgaactgacctcgtgatccgccca

SEQ ID NO: 121227 - DNA, 1038 bp, Homo sapiens
tttcaaaatatggtcttcttaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggtaaaaaccatgtaaatgagagctgggtgtaatgggaaaagtattgaaacctcaacaagaactattctagtaaaaaattgtgaggccctcgtgtctcaatcaggacagtctgaagaaggaaattctaatagcaacattgccttgatccttctcccaccctccctcatgaatttaaattactgctagagggaggcattctaatcttcacatacaagtgctgcgtgagtaatgtctcagcttggaagtatgatggactgccattcatctaaaatcaagttgttaaagtggtaaatttttcttcatataggctttttttttaatatattaagtgttttcttgtaaaatatgtgtatctctatcttcttaatgggagtaatgaagcaattaaatttaaaactttttttttttcattgaagggatgaatccactatacagttttgtaaattgtgctaacaggcatatttgggaattttgtttggggtgtgtgtgtgtgtgaactcttaggcagaggaattccactcggtggtacatgccctcttggagtggctggctgaggcggagcaaaccctgcgtttccatggtgtcctcccagatgatgaggatgctctccggactctcattgatcagcataaagtgagtaatatataaatgctatgtaaagctaaattagaaaatcaaagcagggaaaatagactcgggattacaaatatcaactgcatgaatattttccttcctgagaaatacttaaacacctgatacatttgagagtgtacttctgtccacattgcttacatatgtatgtccccatgcacccacacaca

SEQ ID NO: 121228 - DNA, 1545 bp, Homo sapiens
caaacggatcaatgaatgctaggggtttgaaggcgggggcagggcgtgtctataaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatt

SEQ ID NO: 121229 - DNA, 2073 bp, Homo sapiens
ctggaaaaattggggtgatataaaatttgtcatcatcaggaggaaatcctggccatcatcttcacataggttggctgcttgcatcagtgggtctaaccttaggaggtcatgattagagggatgggaggaaacatattgagcatctgttccctggccagatgagggctaatgaatggcttgctctgctggcaccctttgcctgtgagctgccacattcaatattgggagcacagtgacagtgaacagcaccttccttccttcccctctgatggcgaaatgagagcttccttctcaaaacagaatgctttatttgaacttgaatgtggatgttgtatcgtgtagtcttatgaaagtatattacatattaaagttagagagtcctataaataagaatatctacctttttaaagtctctatttggcaacagtgacctgtattcaaccataacattttttgtatatctgctttgtgaagaaaatctctgtcaataccatgattctataacactggcattctgtttagcataatatgaaaaaaaatttatggataactgtagaaataatgtgattgtaattgtgttgtctattacttagaaatttccagatgtagttgcctattacccatgacaaattaaataatttagtcatattaaaacactttaaagtatgtagcttttaaaggccgtaaaaacttcttaggtaattataaccttgagattattttagaaaagtgtacatttgcatagcattttactatctagggtaattttaatttgctacaaggattgagaatcactgtattaatgtttccattatattttgtgagtttgtaagcttcccattaagttgacctttctttgttctcattcctgctattgtatattcagtaacagttatctcattctttctactcttcctattgaatatttataaacatctactaggtgtaagatgataatgagaggcctacaaagacaatgtccctgctctataaaagcttatgattgagttgtgtagaaagactatacagatgctcctcaacttacgatgggtttttatccccataaaccctctgtaagttgaaaatacggtaaataaaaaatgcatttaatacacctaacattagcttacaataggacaagatcatctaacccaaaacctgtttctataataaagtgttgaatatcttaggtactttattgaataggtgactgaagtatggtttctactgaatccctatggctttcgtaccatggtaaagtcaaaaaatcctaagtcaagtcattataagtcagaaagcatctataattcatctccatttattagggatgcctctgttaatgcctcttacctgtttattagtcccaagaagaaattcgcatttttttcttgttaaatatttaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaaggtaaaatgttctttaagacagtttggttactctgtagacctctttcaaatacacagtaatggtgctttgcggggacatttcgggaaccttaaatatttcctttgcctgaggaacttctgcttgtcctaagtatcccacacacatagcacttgcattgagaagtctttgctgttcattaatttttaactactcattacaataaaaagtgatatcattgtccaagcttctgccatctcagacttgactacacccactgcttctgactcgtcttcccatgtccacttttatcacttctttgacttaatttctacataactactggatagtcttttaaaaatgtaaatggaatcttgtcattcccctccttcacaccctttggtgacttactactgggcatgcattgaaacacaggcttcttaatgtgacgtgcaaggtaccactgatctggccccagcatttctttccaactccatctacccctttctgatctccctctttct

SEQ ID NO: 121230 - DNA, 1773 bp, Homo sapiens
aaccgcaaaactgacaatctaagaaatctcaatattgcatgaaaaaaacaataggcaagaaatacaagattatatgccatcactgatggagcataaagtatgtatttcataatattttgagtccccaaattaattgtatgaatgtcaacttttctttttacagattatatttagtaattgtgttctttggttaatttccaaaaaacatgctttagcgtatattaatttttttttagttacagtgagatgctgcttactaggcttaaagggttttggtttgccagtattttagtgaggcccattacatttataagatatttagttaatatattaatagatatgcataaataaagtggggataggaaaggaatctgccagagaatatttaaactgaaacaaacaaaataaccaaggcccttaaacatcacatactaaacaatctgtccttgcagactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtatgtagtgagtcaaatagataggattctcttttcagacaccaggcttttttttttttttttgagactgagtctcactcctctgtcgtccaggactgtggtggtgtgatcttggcttacttcaacctctgcctcccggttcaagcgattcttgtgcctcagcctccccacaggtagctaggattataggtgcccaccagcatgcctggctaatttttgtatttttagtagagatggggtttcagcatgtttgccaggctagtcttgaactcctgacctcaagtgatccacccacctcagcctccaaaagtgctgatcacaggcgtgagccactgcacccggctgacagcaggcctttttaaagtcaaaagcatgcatttggtatttcgaaagctttcgtttgtcctttaaaataatttcaggtttatgacaccagaagcatttttaagattgatctgattttcatttgtttctacttatttcctttttttctgggaaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcaggtaataaccctttagaaaaattctctgaacttgtcaataaaccacttcttgctgttgaaatatatgttatggatgtacttttatcacaggctgtattaggcataacaatcatggcatggtgccatggtggttctttcctaaaagggctgtggcctcagtttggatgctgacatcactttttgacctggcagcaatttcagcccctggggactaatcttaagaagactgattatagcttgacttcatagacaggctattatcattgaggcccagaaagaagctcagaatttttttttattgggtttgttttctttttctttgtccttttgacctctgttctcataatcagagtgagacatcatacttcattgtattgctaccttttgtttagttcctaagccagactttcttcacaagctatcagtgctgagagccagacatgtagccctcccgacagc

SEQ ID NO: 121231 - DNA, 1044 bp, Homo sapiens
agattatgcacagtagagtttatcctggcattcaacaatctttcatagactttgacattcacattaatagtgatatcttcagagtcctaaatcctaaactaaaataaattttccttaactatcaaataggaaatgtttgattattttacatattgattcacattttttaaaaaggtaggtttttagcactgtatgctgtacagtttttgactattcttgcttttgttcttcttctttcatagttccccacagtaattgtttcctagtttaaaattttatttttctattaccttgtctatctacattgatagtcattgcccagccacatttgattaaacaatttggatttattttgcacacttaatgttgacatagaagcttgtttcattatttaatgtctacattatacatttgcttaaagccctaatgactggtgagaccaactgcctagcaacaaaatatgtttattctcatggtgtgagtttatagctgcatttacatttttataaacctatcaactgtcttaaaggtaacatacatcaggataggaactttgtataatatggtagaggtggaaaaatgaggcaccctgatccagttattttggtgggggataggtaaagacctcttacttctgtttgtctaattttaagtactttgaaatggccccttttctcttctctcttttctttccattcctcaaagatcaaaattagaggacataaaattcccagcagaattgctggaggaaggggcgaatgtttccgttcctttcctgctttcttctcctactcctaagctctgactttgtagcaggactcagaccattcagaagaatgaattttatagaactctcttttatattttggccatgaaaacatttaactttttgattctgagagtgatcctactcttaacataccaaagtgagtgctttctataaagataacttcttactcagttggttttgttggcttttaaaaacactccctaaccagatgcctcagaatatgagtgaaaacagtcagagaaacagtgatgtca

SEQ ID NO: 121232 - DNA, 1068 bp, Homo sapiens
tattttggttattttcgtataggtcagtgatttttatatagcagcctggttagaagtgctcactctgaaatcaggttatctgagtttaggtccaggttcacccacttagggcatatggcctcagtggtcttactggtcttactaactggttttactcctatgtctttagcttacattaaggataaaattatttccccaataagtgggttgaaagtaacttgaacataccaagtgcttactatacctttgttattattttcaaattattattcatgtatttttgaacaaagttaagggacttctagccatgaattttgtactgttacatattaaaataaatattttatgaaaggacagttacctattacaagcaactgtttgctaacctgttggttggcaaagccaagatgattaactatgtcagtgacttagaaagtagaaggagagagaatagcattctgtgtcagcagtgggtgaggcataggaatattaatgaacacagcacagctacagaaaacataaaattatcaggggatacaagatgtgtgtgtgtttcagagcaggaaatactaatttgagtttcttaagacttttttggctttcatatgtgtcaacatatgtttcattttcttttgtataattttaaaactcatttttcaaatgcatatattggaataagttcagccttgaaatttatttttttattgtagagaacaaaatgaaatgaaatgtcaaaattataaatagaaacatctatccatccaaaaatattgaataaagagaaaatattttccttattttttttgcctataattcttccattggtaagcctcatgtgagatttttactttgcgtcacctcccctcagtaagtagtgtgaattagaataatgatataaccaatagatttctttgtttggagttagtgatttttaacaatattttctttgtatatctcttttaaaatagcaatttaagtctgaggcctatcaacagcagatagaaatggaaagactgaatcatcaagcagagcttttgctaaagaaagtaacagaagagagtgacaaac

SEQ ID NO: 121233 - DNA, 1553 bp, Homo sapiens
atgataacttaaaaatccaagatttatcgccctactatatggtttgtaaacttcattaaagtgcaaaatatcccagtgctttgggaggctgaggtgggaggatcacttgaggccaggagttcaagatcagcctgggaaacatagcaagatcctgtcaaaacaagagctgaagtaccccatctacaatttttttttctttttttattagccagccatggtggcatgtgcctatagtctgagctacttggaaggctgaggtaggaggattgcttgagcccaggagtttgaggttacagtgagctatttgattgtgccactgcactccagcttgggtgacagagtaatggcaaaatgattttattttgtattcagtacctaaaaaaaatgtgacttgagcctttttagactatttttattacctaaataaataagaaatgcaggagagtctgaaacctgttataattcagaataatggtcttaatgctaataatttatatgtgcaggatcttaatgctaatctaaataatatgtaagggtttgagtcaaatattttgcctaagttctaaacagtaatttcttgcttatttgaatgaacaaatagatttgaatcttttcctttcagtatatttatacaagctgccttttaagcacatgtaatgaagaattccatgtgattggattctataaatgttttcaaatgatttttttagaagttcataatatatcaagaatctattgaataaacaatttcttttgcaaacttgtatgtatctatttcatatttgggacaaccattttggtatattactgcttttactaatttaggtgaaccatgttaattttttataaaatagtctaattctataatatcttttagatttatgattgtatttttctgtagtacttgaaatactgtagcaatttcaaatgtactgttgtaacaacacgtgggcgaatgtgtctttcaggcggtatttgactgggtagatattgcaggtggtaaattagcttcaatgtctccaattggaacagatctcgaaactgtcaagcagcagattgaagagctaaaggtatgtgtgggggctaatttatcgaagactcccttgcagttttaagtccttgattcacataattttgtacataaatttattttacctaatgtaagtatgacagcttaattataaagctagtttaatgtacatagtgctttcacatgctaagcaatatataagtgttctttaaataaaggaaagaaatactattaatagttttctttttatagtcaattaataactgttcgtatagaaaaatcagaaaatgcaaataaaaaggagaaaaacaaattatttcaagtcacccaaaatgttatatacctagagatcacctttcttagatttgatttatagcctttctgatatcttcatgttagggacatggggtgtgtgtgtgtgtgtgtgtgtgtgtgtgtgtgtatgtataggtagagagagagatgtatttagataatagtgtaaggatttttataacttgtttaacttgtttattcagtagta

SEQ ID NO: 121234 - DNA, 1700 bp, Homo sapiens
agtcttctctctagatctgctcttactgtgttgctgcctaaaccccgtcagaggcatcccctgccatctggatcaagcccaaactccctagagcagggcatgcagctttttgcatgccagcctagctcatgcctatgtttccaaagttatgtttttctcttgctcctttaccaaactccctccctgctactgattagaaagggcgtttcccaaaacaaactgttttgctctttctagcgtcagtgcctttgcgcatcttatttcctcactctagaatgtccttcctgccactctactggcaaagtccactcagggttcagttggatcattacccccatgtaaaaccttttcttgtatacttagcagagttagtgcatctgtgttcccgtaatactttattcatgcaaaggactctgcacatagtatggtttactgttgcttatgcctctgtctttcctgctgtagtgtgggccccttgaggggaatagccatatctatttttctttgtatccccagtgcctggtttagggcttggtttatggttattcagtgtttgttgaatgaatgaatgtatttaaccaagaagatgaaagcaaaagtaggatactgcctttctgttgtggtatctttgtaccttacaggtcctacctggtcctgcctagggtaatgacataaaatgtaaatccaaagctagattattctaaatctactaacaaatatattaatttgtattgtttttggatttatattttacttgtctatgttaaatgtatattggtttggaaaccaaaatgtctttctaagccttacagtattgttgatatttttaaaaatttgttttggtatttgttaaggtatttcttatttatcatttcttaaatatctttataataaacatttgacatttgttactaaaagggtgctgtttttcttttaaaatatttcttgttgaaaaaatttattgcagaaacttagaaaacagaaaaatgattagaatgccaccttctagaaataactaccattgatattgttgtgtactttttaaagttttgatgtggttttgcttaaaattctaaggctgtcattttcttattctagaccataagggaagaaatagatggactacaggaggagctggatatagttattaacctaggttctgaactcattgcggcatgtggggagcctgataaacccattgtcaagaagagtatagatgaggtacaactggcttacttatcagaatggcttttaaaaagtttttagttaactaaaatattttgttaacagtagttgaaagtttaaaatatggcactaaaagaattctaacatacatcttgtagttaaattcagcatgggattctctaaataaagcttggaaagaccggattgacaaacttgaggaggcaatgcaggctgccgttcagtaccaggatggactgcaggtaaggggattacagtgtatgtgctggtcttagctggaaggaggaatcgtactaattgatgtctacatattggcaccacctcaagatctgccagtgcatatgcaattgtgggcaaattattcctgcagttgcctgtgtatctcatttcatgttttgtcttttagaagatatttctgacctttcagatatgtgtagatttatatacacatctaaacacatttctgtatacacattcagtgaaatttactttgaaaa

SEQ ID NO: 121235 - DNA, 2300 bp, Homo sapiens
ataatataacttttcaggatgccataatagttcattaaaaatgaagtaaacaatccattgtaatagacaaatactcagcttattgaacttgatttttaaaattaatttgaattatgataacaggatgaagcagcaggtaaagagacattgctgccatgtcgtcctggtccaattacatattaatatataccatttcttaatggatacactcaaatattcataagaaactaagtctattgtacataggtagtgtgacagaggtgcatatacttcatgattttaggcatgtcttcacacaccaggtggatgtaacttttgaatgggtctgttgataaagaggctaagatttattcttaattctgacattaaattgtaaaaaatgttttttcatttaaatttcacacttggtattacagatcttttttccataaaagatctctttgttttgcccctagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaaggtaatacttttggaatagggaaacaaattttaaagcattctaaatgtttatgcggtttactcaccgtccaattggataacaaaatgccgcatcttaaaaaagatactacaaatgtgatgtgtttagggttgaagggctgtgtatgcaaatcccttgttaatgtcttcctgtgtttgtgaaattatttggttgaatacaaagcgtgccattatacatagaccatgtataaagaccatatgttcaaagaccatgtgtattcaggccttttaaatcagtaggttgaagcatattgctaataaggccatatctggggttttttcctcattactgactctgctaccttacatagcatggatcctgcatcacatagccacaaaaatgggaaccactaccacagccagccatctttgagatacgagctgagggtcaaaagggagagcatgtgcgtagtggaaattcacaatgagagtactctagaagcaagcccaaagtacataccatacattgttacattcctgggactgaacggacaattttactcttgatttggggagcataaaagtgtacctaggtgattatttcactccctttgggattaaggatagccttaatgaacttgaaacttgataaacttggttctactctgagctcacttttgtcaggaagaaccttggtttggcaagaatagcagacccagagatattatgttatttggcatagactcttggacccactgatatccactggactggggtcattcaaaacttggtccagttttagatacttagcaaattggatcactactttctgtgtgaactataacattctgctttgttggttacgtggggctaaccagtcgccttgtggatattgttttgcttcatagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagaggtaagcagaaaatctcatttaaagttagaaaaataagttgtggcataatgaaatccagattccttgggtaaatgttaggagttactctgttaacatttatatttggttctgaaaatggaatgtgcagtgatacagtaggagatagagtatacccacaaatttcactttgagattgtatgtttaaaacaatttctcaggcctgcgtggtggctcatgcctgtattcccagaactttgggaggccgaggtgggcggatcacttgaggccaggagtttgagaccagcttggccaacatgacgaaaccctgtctctactaaaagtacaaaaattagttaagcgtggtggtacacacctgtagtaccagctagttcgagggtgaagcatgagaatcacttgaacctgggaggtggaggttacagtcagccaagatcgtgccactatactctaacctgggcgacagagtgagcccctgtctcagaagacaaacaaaaacacaaaac

SEQ ID NO: 121236 - DNA, 1129 bp, Homo sapiens
agcttctttctattcttttttcttccttcccttctccctccttccccccgtcttgtctctctctctctctctttttctttcttctatttttgtatatatcatgagtgtgcagaaaggaacaccatcagatatgacttggtgtctgtaggttggggacatagcgagttcagaatacttttatataatatgaccctaggctaatgctcttgtcaaaatgtgctactcttggtatgagatgcataataaactgggattcattatttcactgaaccagcatctttgtaccctaaagggtctttggtgtgaccagactgttgtttaatctttgtgtcaggaccttctcttcctggcaaagagctgtatgagccatcatgtgttaaatgccttgtgatggggaggggtttgtttggagtttcttgccagctggatgcattgcaggtgtagacagctgtaatatggaggtgtgaccctgagatactgaaaagctgtttggtttgttatagcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcaggtaattgtttacactagatatagaattgggttcttgcagacaacagagcacagaaagacattttcctggatttcctgattaaattttaactaaaattatttcaccacattcactcttgagtattgatgtctgtgtccctcagaggtgatgtttgcttgcatccagcctttatctccttatctttctctgcctgcttatagatataatacaaataattttcaatgacttaagaaacgtgcagttgtcatcattgtctgaatatttaattcagtgtccatcctgagtagaatgtaatatttgccattgggggagataaaggaaagtgttataattattaataaagtactctcaagaaggcaatgagaagaaagaatgataggctaaatgaaaagaaaaagaatataaagttggatattgatggt

SEQ ID NO: 121237 - DNA, 1065 bp, Homo sapiens
gttctcctttctttaaaatttagtcattatcacgaattattttaggatgccatgaggagacaagctcggattttccacttgtgtaataaggatatttcaaagaactgtagataggtattttctggcatcaggaacgggaacgtgctgacctaattatttatcttttgtttagtttgaccaagcagctgatgctgagttatcctggattactgaaacagaaaaaaaattgatgtctctgggtgacatcaggcttgagcaagaccagacttctgctcagcttcaagttcaaaaggtgaagaaatacatttccaattgccatatgaattatttgctggtgtgctccaactctataaaatgtgcttgtatgatttactttttaagacccctctagtgtaacgtgatatttttaactacttagcctaattgttttcattttagtcatacaatttcttgttttattttttgtctttattttggtaaatcacagacattcaccatggagattttgagacacaaggatattattgatgaccttgttaaatctgggcataaaatcatgaccgcatgcagtgaagaggaaaagcaatcaatgaaggtataatcttgtctgtggactggtagtgggactcttgaaaaaacagcaggtgttgagctttcagtcctagaaaaacacttctccgttatccacagctgccatttaagcagcaaaaataattagtttaaataaggcatttttcaagtttatagaataacagtgaaaggaatatttcttaagagaatcactatgaggacaatctttttgaataggcacaaaggctattaaggtttgagaccttggttaactggcacgcattaagcattcagttaatgttagctgtattattaccattattatcagtataaattattgttttttatatgtatcaactattgtttatgtgcttcagagacatttgggcctcttaataaaaaccaaaatatgtggctctctctaatgctgaaatccattttgtataaagttacagtaagctatatagggaaaatatgatctgagtaattaaggaa

SEQ ID NO: 121238 - DNA, 1062 bp, Homo sapiens
ggctgctttaaaatcattgtcaggtaattctaacatgtctgccatctgggtattggcatctatttgattatcttctttaattcagtttgagattttcctggctcttatatgatcttatgagtgttagagcttaagctttctgttttagctgccttcctcttaccactctggcagaaggtgggggtgctaccaggtgaagatagaagtccaggttcccaattccacctctgttgacacctaggagatggctcgtcatttctgctgagtgggagtgggagttccagctccctatgtggtctctactggtaccacagtgcaggtggctgtgatggtgacacactgagtgatgatgaagatcctgactctccactaggccttctctgatatcaccccagaggagtggagggaggggcagttcgttattgcttagtgggggtggaagcccagcctccccacatggtctcaactgacaggatgatctggggatgaaaattctggctccctacttggcattctctaacatctcccggcaagagtgttggggaccttgtcatggcattgcaaggatagaagtgtaggccccccatttgtcctttcttggcatgagtgtgagtggagcaaccattttttctgtagtgtttggttggaatagagtggttattgtttaaaagttgtctgttttgctaaactactcctttcctggttctttggctagagagagcaggcttgttttgggactttgtacccgtttagtgttgtgtggttgctagtttttccagtatttagtcttagatacgtgaggcaaaaagaaaatcccagagaactcaccactgtgttcttccttgtggcccaaggtccatggtagttctgtcctcttctctcccctttgtggaatcttcttatgtatgttttatatataatgcctgggatttgtaggtgtacttaccacgaagaacagagaaaagctaatgtactccatcttcccatgagttggcatagtgttgcagagtttttaaagtatgaatttttaaaaatctagtttcttatctccacccatctttc

SEQ ID NO: 121239 - DNA, 2192 bp, Homo sapiens
aacccagcttttaagccatgcatgaagtcagtatttgaactcaagcagtttttaacctctcttctttgaaaacaaagtctcatacagatagatacaaaagtactgctttccacatagctaaagacatttagccttttccagttcctacatttgtattttcagagtgatttagatttgctggaaatcttgggaaagattaaaatttagaaaagggcttctcttgagtaagattatctttagaaaaatgtctccttttgttctgtggaaatttcatcagtgttccataatatctgaagaaaccctctccctgccttttttttccttcataagaaataacgtgactttgaaattttaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggtaagctctgatttctgcattttggattagtcttttatcttttaggcagtcttattcacacaaaaataaaattatatttgtcttatgtcattacatatgctgaaggatgccttggtgggtggagacccaatagaaattggcagcagatcaactgtttaaagttttaggagcccagagatgaaaacagtatgttataattgttgcaagagtcttatatttgggagtatagtttattacccaagggacagaatgatgaaaacagaaaaaaaaaaggaaaatgatcattgtttcagagacacacataatttggttggaataccaatatttctataagataacatggggtgggttttctaattatatcacaaacgtaatacactgcatggtaatcattcctcttttccaagatatcagcctctgtttttatcatccttgaagtatgatcacatgtgggtgaaagggagttggtgaggtcaggctcactgagcctgtaatgattctactgtcatgatataaagccagtttgtcatcattttgagggtcacttaattctggcttggaatatcctcttcattttacttttctgttacctgattacttagaggttcccagaaagcaaagaataatacaagttaacttgcttgtttttgcttctgaaattttaaatatttatattaaatttcaaagataaaatcttgccgtgtcgacaaatgaattgttctttgaacttctcaggaaacatttttctttttgcaaaatagctttagataaaaaaggtttatttaactcgactgaaactaagggagggggggagtggggcaaagcatcacattattcgcctgcaaaggacttgagctccaagaacagttaaaggaaaagtctgttgaagctcttaagtgttactaacttatttgtatgttttcaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcaggtagggaaaaatggtttgttgtttaggcaataaattttctccagctgttcttggagcttttacctgaacaaagatgactgttaatactgtttccattcatttgctgtgcttccaaaatgaaagagtggatttgaaaagaagttgactgggcttcttcgacgtctgagcaccagggcaaggctaatctgcacattgttcacagccatctgcctcattgtttcacagatttatccttaccaagtcagacactgcgaagatcagcccagctttccaaacaaaatgcttttgtctacacatatgcatattgctgatattaatttttatgtattgactaagtctaatctgtatgtgagtaaatactgtgaattgttatgtaagtcagtattaactgttcatttacagaaagctggggcaaagagaatgttttctttttaaaaaggaagcagttttgttggtaatgtga

SEQ ID NO: 121240 - DNA, 1589 bp, Homo sapiens
ttagcgaggttcagtttttattgtgtggttttgtgacataaatttgagttatgtactattgttttgtttaattgcaaactaaatccatttaacatgtcatgctttagttttatttatgttttcatttttatttgtccattctttttgtttttcttctttatttttttaaactttgcttaggccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggtattttgatttattttattttatcttattttttcatttcaattgtcattatttcttagtccttatttctgtacaattttatgtttatgatgatttcgatgaattgctgtacttaaaaaaagactgtttatacagattacttttaatgaagtcattttaaagaaaagagtgactctatccaattagctggatatttcacttttcattttgttattttattgttgtatacaaagacctgtattaaccagtacttcagtatgtccacaaagcccattttcatagggccctaagtattttctgaaaaggaatatgctgtgaattatggtagatgaacatgggacatgggccacagaggtgaaaagaagaggtctaaacatgggaacaataagaacatttgaaaatgtgagatatttactcaaatatgtctctgtgaaatctaattaaagttctctgagattaactaatgttaatgctaacttaaatgtttttccccccacataaaaatggtacctgtgttttcaggttctgcaagaggacatcttactcaggaaacaaaatgtagatcaggctttactaaatggtttagaactacttaaacaaaccacaggtgagatatctttcaaatcaaatcatcatgtggtcagcattttatattgttttcaaaatattttagggatgggaaaaaaccaaaacactttataatttttggtccattccaagacttttattctggagaatgctttgaagaccaatcaagggggtggttaggatatgatctcacttttttctcatgatctcacttgagttcttgatggaagttgtgtgtattactcataacataaagcactttggcacaggagctcatcagagaagcccaggacagagtcacattacttttccacttgtggaaggcagatgaacacgtaggttgtagacaatttctttttaagatagatcgcattgcagtgacacacagtatggctacgtgcatagctatacatgggcttcatttcttcatgtctgaatcaccaagaaaactgatacatagtttagtatctagatgagatttttaggacaactca

SEQ ID NO: 121241 - DNA, 1816 bp, Homo sapiens
agccaacaaaacctattaattgattttgcttttttaattgctagaagctttattattaaaatgtatcaaagtaattagttctccttgctgccaaagcacctgttgtactttgattatatcatgactttagtatataaaaacctgtgccaacacagtttgtatgtcttacccttctctttaaacaagttcctcttaccttctgccttggtggtcctgatctcaaaatactcttttagctttttacttctgggtaactgtcaaatctttactccttaattagcagtcaggatcattaaggaagcagtgaagcatagtgtttcatacacttacgccttcctcattgctggtagcacagtgcctgtgcacagcagttgctcatgagccatttgtttgattagattagagcaaggtaaaaggctaattatagcaaacatttcatttcaggtgctttgaaatgtttaattagaatcaaattgaattttgtttctggtgctaaatcctgaaatattagtcttatttagccagctttggagatttctgacatcttctaccctctcttcctgttgccaatgatgtgtaaaagctgttttagtttgcagcctcacacagattttaggagccagttccacctagtaaaaggagccaagagcctctcgttttagccttgttaacttgtgaacttgggctgagtcttaacttccttgtctataatggattgtttaacgtgggaaagggttttgaaaacagtaatgatttataggaaccttttgtatcttgacaggacagatagttgttgaatgtttaaggcagtcttatttcattccgataatggagattttgcacttttttcatgattcattggagttatcctaagtggcaccttctaccgtattattctatattaaaaaattagtaatgagtttagtggccttaccaatattagttttgtctactgtgaaaagcccctgccacagtgtctgacccaatagtaataaatcattaaacaaatgagttacctttaaaatctcgcttttcagatcctttcatatgtgcatacatacaaaatacatttttgtcatacttcaaatgtacttagaatacattgtactttatattcatacaattattcccttgcttttttatatttaatgttttgtctcaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggtaacttatatacttccagttcttttgaaagagtagcagtggcctctgtctacaaaactgacattttgtattttgttaatacttcaaatcatgattttcctatgtttatcatgtatgtgaacagagatagcaaagattgtagtgcctctttcctcattcctctaatggtaatggcttgtcaccgctatatcccaactttttaagacaagcatttcccttgggagtgattacttcatttgtttattacatagttactgcctgcttaccatgcatcaggcacagagttaggtcttgtgttataggggtgagctgggcagatcatctctgtcatcagatagggtacagtctaagagggtttatagccattgagaagtaatgataaatgtgatgtctcaaagttgaaatacaggttgctgtgggagcatatcacaggaagaacctagcctaggggcagggaaatgacagttaagctaagttttagagggg

SEQ ID NO: 121242 - DNA, 1042 bp, Homo sapiens
tccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaaggtaagttagtcatgcttttgtattgcgtttcatattaaatcttaataacaagagaaaaaatgcaaattgtgactcttttaattaataggataacctagttaaccggttgttgctgctgtagacattattttgttagtcattcgacaaatatttattgaacatctaccatgggccaggccttgttccagttgctgggaatatatccttgaataaaaaagatgaacatttctcattgagttcaaagccaagtgggaagggtgtgccaggattgaaagacaataagtaaagtaaataaatgaatggtgataagttagcaagtgatgaataaagcagggatcggggagaggcatcaggaagcaatagagcaaagatg

SEQ ID NO: 121243 - DNA, 1596 bp, Homo sapiens
gcccaccctgatgaaaatttcaaaatgattttacatgatgtttctccactagaggaagcaaaacatgtaaatggtcaaagggaaatccacgatgaaaattgttgcctgcagaataatttgaaagagagccctgtgaagtgtgacccattaattatgccaagaaatagagaaaatgagcatatttttaaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtaattcatggaaatatgaaactctgcagtgtcaaaagtttgcggttctgctaaaagtttgtggttctgtttcagagtggtcactagtgtttctaataataatgaaatccacacttttgttttggaggtttgactagcaccctgcaagatgccacatattgataaatggataattataacaaattaatagggactgttttggagaagaattgatattcccagctgttcagggtcctgttattgattgtgcagatggtggccattccccttcatttagaaggcctccactgtgaatatatgttaatgttaggcttttacacaaattgtggtaaagacactgccatttaagagccattatattggatttattaagcttgaacaggcttagtcatgaaggtacaaacagtattatattgttatggcctgcaaagtactctatccacattaaggactttttttaataggttgaaaaatttctctcaggagctctgcatgtgagagtagagttattatgctgtactttgcaggcattatagctcccaactttttgtgagtggtgaatgaggtaagaaagtaaagggtgcagccttgtaataagtagagattgcttgtcaagcctgtaatttttttcttcccactcagattgaagttcagctgttttggtacttttactaaactcttctggtaaacttggcctcaaaggtagttttattttattttaaacttctcttcatgcttgtgtgctgtgggttagattagggggaaaggctctcttcataggtattttgttaacattgagagataaggaacttagacaatatcagaaccgttcctcttctcagtctgtgaaataattgttcttgttagttatgcctttttcttagacatgcagtaaatggcatgctaatttaaaagcttagcaaattaatttttttctgtaaaggatatttcagtttatttgtagaaaacaattaaatcttaggggagtatatactctttagtagttatctttttaaatccttagtatatttttgggggcac

SEQ ID NO: 121244 - DNA, 1010 bp, Homo sapiens
gaagcttagtagtacaccatgctttctgtttactttaaacggttgctggattgtactgccctgggtgtctaaaagtctggtgtttttttctttcttcctttgagtagttctgaatagcattgaagaagcttaaaacaggaagaaaacctgccttttcaatcaagtttatttatagctactcccccctccaaaaaaaaaaagtaaaagaaaaatgtaactttctcataacgttagacttaacttatttttctctgaagatttgttctgtgccttgatgtgaacaataccaggtccctgtgtttgtcttttaaatttctggagcatggtttatttaccagaatggtggagttctgcaagccatctttaagtggattacagttaaccagagctctgccgaaattaacattcaggctgttaaaatgcttgctcatttggaaattttaatctggaaatatcagactaaaaagggaaatggactgacaatggaatgttctgagtgtttgagccactgttaagtgtgtgtttgtttattttctgtgttttggagtgtgtgaacggggactttgggagctgggaaaggtggacaaaggagatttttgttctctgttattgatgcactttattgtttagaatcatcctaaaatcaaccaggtaaaaggatagttgcatttatactgatgcactgctgatgaccttaaacacctcatgtattatgaaatatattatttgagcatgtgtctttatgctaaagacactccatagctctgttcagaagtatacttttttggaagatgctttatcttatttcttatctgtgtcaagagctgcaatatttgttttaactatctgcaaaatggggaagccactcagcagaccagactgtttacgtcagaatcccccatgtgtagggaagggtgaagaagaggaggacctaaatatcgaagactgttacgtcccacagcggtcaatctatgatactgttagactaaatgaacagatagactctggtt

SEQ ID NO: 121245 - DNA, 1053 bp, Homo sapiens
tgcatgatttaatttcaatgaaaatcaaagagacttgatgctttaatgagtcctagctaaatctgtaccttccccacctctatctaggccaagcttgtcccacccatggcccacggcccacctgtggcccaggatggctttgaatgtggcccaacacaaattcataaactttcttaaataacatgacaagattttttttgccatttttttaagctcatcagctgtcattgctgttagtgtattttatgggtggcctaagacaactcttcttcttccagtgtggcccagggaagccaaaagattggacacccctgatctagaccattgtgaaaaaatgccttacctcagaacctgcttacagtttatttctggccactctgttgctgccccaattgtaattcattttgtccccacaaatgagtacatctccagtacattctctctgaggatttctttttattttcaaatggacatagaattacattgagcagaggatttttaagccaagttgaaaccagagacaaagagcagaacatatgcctaattatactgtaataaattttctctggtccaggtgaaggcattgtttaacccaggcatcattattttaatattcggtaaaccaaaatgccaagtagcatgaggctaaggaagacaggcagtttgagcacaaattcttattatggtgtttatcaaatgatccagaaacaacctctgatgtcaccatattgaaaatcaaactgtccaaaaactgctttaatagtacttttaaagtgttcatattgttatatagaggtcaatgacaaattattttccattttattaagaatggggaaattagataaaactgttgcagaagaggtttttgttagggaaaattccttaatagattggatttttgttaatgaagctaccttagcaaaggggttgcatgttcccttcctctggtatttttaatggtgaaaatatttccactatagacactgtaactagatgcatggcttttataggaagatcacattatttaataaacccagagcaaagtggcattta

SEQ ID NO: 121246 - DNA, 1056 bp, Homo sapiens
gtcttagaaactgatgttatgtaggtgccgtgatatgataagggtgatgatgataatgatgatgttgatggtggagattccagtgatcaccactactgctgctactgagatggagccaaacatttcattgttttagtgattatatctttcttggttaaagtagtaaattgacttgtttacagttcagtatttaatttagtttctgttgggccttagacttttgttaaacattagttttaacataatttttggaaagttttttaaattttttaaatggaatgatttgtattgagtgaaaagctagttataattcctaaaagtgaaacagaaaagtagtgaaggactgagtctgtcttccttattgactttgaaatataatctagtttgacattaatctatctggtagctttagtttaacctaatgtcacagataaaatcctataatagtttttcttaatacaaaataaactgccttctgagcagaactgagaataatagctattacccagttactcagcagggggtgccttctattcactggacccgtaatagaggatttaaagcaggtttgatagacttccccgattctgtttttctttctatagttcaagaaatagctgttaatagttacttgaggttttcttgtaaagacaaggacaaaattcattcgttcatgtttaagataccaattcaaacataatacttaaagcaaatgctattctaaaccaaatgtcctaactcactcagtgaaaactatcctgagattttgaaagtagattggtgttatcttttgtgttagttagcttgacgttttaaaactattttgattatatataagttctgttgtacataagtttttctacttctgaatactagtcattggactaacatgtctgaagggtgaagtgttttctatactgttggtaagttagagtaccattttccacttacacttatttatgattacggttaaattctatgcacactgttataaattggtggaatgaatagcagggcgattctgtttgtctctaggcaggaagaaagaaactcctt

SEQ ID NO: 121247 - DNA, 3701 bp, Homo sapiens
aaaggtttaatcatttgcctggggtcttccaactctgaagaggttaaaccaagatacaaactcatgtagtttttatgtgctacattatgttgcctccataatatgtaaaagtcatagacgtggccaggagcggtggctcacacctgtaatcccagcactttgggaggccgaggccggcggatcacgaggtcaggagatcgagaccatcctggctaacacggtgaaaccctgtctctactaaaaatacaaaaaattagccgggcgtggtggcgggtgcctgtagtcccagctactcaggaggctgaggcaggagaatggtgtgaacccaggaggaggagcttgcagtgagctgagatagcgcctcaacactccagtctgggtgacagagcgagactctgcctcaaaaaaaaaaaaaaaaaaaaaaaaaaaaagtcatagacgcgaaaaagtcatatttaataagagatggattatttatcaacataattaagaactttgccatcatcacttctccatactggaatagagaagacaccagcacagcaggcgatgtgtggcatggccactccctgcaccttgatgcatttttacttatttccttattctttgttttcccctctcatctgtatcctgcatcttttcttgattgtgtattttcttctgcctacttcttgcttcttttcccctttgtcaataacttaagttcacttgtagttcttatagtcaatgctaaaagcccttgcttttcaacaattctatatattcattcagagatttttattttggcttttcatagattaaattaacattttgatgtaaaataaacatatcttgtaattttatttctagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtagggaactcttcatttttacccagtgtttttattgtcaatgaagtttctaatttgcttagaaaggagattgcctattttgtagaactttttaataatgattgtcatacaatatttgagccagaatgagcatatatgggggtaacacccaggcaggtggggcagttacaaggccactggggatttgggcctttgtgggataaggtctgagataaaatcagaccaaagggtgcttggcaaagttccaggcaagccagaaactgacatcatagggtccatttctggaattattcacaattgccatctgtggtgaccgtggctgtgttttgaactctattgcagatgtttatcttccagcaatttcttcaatggtgaattaccgtcttttctgccctttctttttataattatcttctcatccttcttaatttcttccacagacatttttcttctaaaagctcatatttttaaaggcaatatggagttccatgttgtaatctgtttcattaaacaaaggtcttaggctcatgccccagaggattagaggtgaattttttttttattgcatgacataagctcctcagtgccaagaaatgactgccactcaacagtgatcaatgacacttaatgaatgaaacatttgataaaaatggtgggccagtttccgtgtcattggatttggccttatttatgatagtgagaacagaagtcacatctgtataggggacaaagataggtttatccctggaaacaaagggtcctaaatagcaagcaattttctatatggggctgatataaacctttagggtttcacagctcctgttatatttatgaggtgtgttttactggcaaagatatattgcaccattagtgcataaagaataaactaagaccaaataaaaacagtttataaaaccacaaattattttctttgagagatgaatatgaatcaaatggacttccaaattctgtgcagttatagttgataaactctttcatttgcttgtctttaataacattatttaggtgactgaatcttgaaaaataccttctttttctttgtattgttattagttatgattatttgcagtttattaaacgcctttgaagcccagttccttcaaggctcacaaagctgtgattctgtatttagttcttgattcttgaaggtgaaggaaacgtccttattgttgacttgacctccttcattgctctgtcaaatttttgtatttctgatttgcaaaataaagatttcacgtgagagaatcctctattagaaaaacatagttctgtggcaattgctgcatcaaagactgggagagatcttgggagcaactcttccttcgtcagtaaagtttggaattctctctagaaccctgt

SEQ ID NO: 121248 - DNA, 3169 bp, Homo sapiens
gttgagtttaattggtgagacttcctacgggaactttccagcagctggttgttaatgtgtaatttgaatgggaaagaataattggggatagatatacaaatttgggagcaatttgcctagaacggataagtgaagatttgatattaaaaggattattgttcattgttctagtaagtcatagtttaataacacactctataggacttatagaaggaatgagagatcccagaatgctgtctgctttaatgaatattcgatattctacgatatcttctaaagtcagattcaaaattttttccctatactttagttgacatacaaccatcagacctataaaatcgtaggttagtcctttaagtaactatgtaacaagagtcataaaaatgggattatagccattatatatcattttaaatcataccatacagtcctcatagacatagtcatgttaaatgcaaaaaatgtcaaacaccagtttcattttttttcttttagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcaggtgagtattacctaataacctgtctctcgtgcatagcaatttgacttactgagaccaatgttttcattataaatatattaactttggtcagtaggtgttttatttaactgctttgaagtatatatgtaatgtttcagatgcccataagatactgtcctgatattagtgggaatccccaaagaactaaagctataaggcatcttagaggcctcctttgaatcccatgaatgggccaagtctcctgattatttcagtcatattgtgggtggtacagatctggttaaaagggccttctttgaagtattaatgcaattaagtaatatctttatgagaggctagtctatactttttactgtttagaaattactcctttgaggttttatttattttgattgtggtagtagataatgaaacttgtaaaactcatgcatttgagtcctgatggaggagagagagaatgagaagaggacaaagaataagggaagcagagagggaaccctgaaacccagggtgttagttagactagtctagttacaaagcagataaatccacaagggaaaaaaatccaaaaaaatgagttttatttttaatgtttaatgttttacagtcaggcataatagcagaagctctgtggtgatttcagttagttttttaatgtctgagtactggctttagagcagggaggctgttttataagctgaaaattcaaataagtttttgtaaaagtcagatgtttgaattcatatctgttcataatccaaagacaatgaaaacaaaagataaaagtaaatatctggggagaaataattgcctctagtcttggtagtctcccagagatagatagataaataaaatatagataaaagtataaaagatagataaaatatgatactaaaagaatgagatttttggatcattaattttatgagtcaagttgagcctatacattctgagcagcatgatttgttgactaaaacctttataataaagactgtaaacatcaataaattttatgttacaaaaacctttgcaactcaatgcatcatgagttaatatattctaacacctttatcactgtgcattttctttaatataaaattctatagggtattccaaaaatcctacgaagacaaaaacatgagtgggtaaaaacaaatttggtgtaagtgcagtgtgaacttgtttaacagcagtgtttctctttttatatgaaaatttacacatgaatttttgttcattttgtccatatttttcctttagggggatgggattagtttagacaggatatctctgtgaagcactgtggctcttcggatttaagagaattgtactgccctttaagtaaaaagtaggaaagtgataactaaaaaacaaaaactggagaaataattaccatttctgtctgtttggacaccaaatctgtgttttctacaatcaattatataataatttgcgtttgtttacccttgttaccttagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcaggtttgtctacttttaatacatatatttcctggtcagaaataaatgtcatatattgcctatttccaagatgttgccaataatccaggaccccaaagagactctgccccactgttaacatcagtgaagaggaggatgaatacaggagctcagagagcagttttgtgttcataggcacatggaatgttagggtcattctacacacataatctgttggcaaaattggcttcctgaaggcctattaaaatctcaggtaccccaaactggtttttaaaaaatgtaaatgttttttgctgtatgaaagtcttatttagccagaaaaaaacatgaatagttagtaaaaggctttgcatcatcttctcatctgctgttactttatctattctgtcatagaaaacttttctagagaaatgtgcgaaagagaggcatttgtcactattttcctctctcactgtggctataattctgtggcatatgtgatgatatttgtcagaggtagcagt

SEQ ID NO: 121249 - DNA, 2773 bp, Homo sapiens
ctgtacattctgcacatgtatcccagaacttaaaatataataaaataaataaataaaaataaatacaaattaaaaaaaaactaaagctccacttactgctctaaaatacaatttaataaatatgattcttcctagaataaaggaatttattggataaaacacaaagcaacttcacaaaaatttttatgaattaatatttaatgattaatttatataatataaacatactgaaatggtagtgtttaagacaatactttaagaataaattttacatagaagagaggatattgtttgatatttacattttggaccttcatttgattttgaagttgagtcagtgttttatgtgtgattactgttgatggggtttgatttaatgccatctactgttaatgtatagaaatactatgaaactgtgattattttagtgttactatttttgcaggtggagcagtattaaatggtgaaggaacagccacaaatactgaggaattttgggcaaataaaggtgagtattaattttaatttgttactgattaatgtaatttgatgtttttttaataagagaaaatcttagaggcaaacagtagttatattgaaatttcaagcctgaattacaatggtatttaatctaatagtcacaatctccataaaaattatatttatataacattttttgcagttttgtgtatctgaaataagtaaaatcaagttgttcagtttgacacttggttttgttgctttctttttggttaatttgagatattttgtcacttgggataacgttatttgacctaatttattgagtttggtgcttgagatattgctaagtaacattttgtggtttgttttttgttacatttaaaatgtcttttttatttcacttgttatgcaattttcttgaattatttgtgactaaatagcattataagatgatccaaacttttatttctgaaaagcttatgactttatctactaggcttaataatgacaagctagaagtgacaaaataccatgtaaaacaaacttttatttctagacctctgctccaaatgtcctgaaaatgtgtcagtatagttgtttttcttactcctaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataaggtatattctgtgggtgcacctatggaagacatgaaagagaatggattagcagttggaacggagctctggtagtcagaagctctgctctgttttcttttctagctctgtaacctttagcacataattgacagttttgtttaatgtgcctttctataaagattgataataatagttacttttttttaaatttttggcacagccatgtcataggttagcaaactgttgggtgtaagccactttgccacctttaaatcagtttaagtctaggatgttaaccagtcaactactggaaaagatttatttaagggctaaatgtatgaaggatctgttctctgtagtataaaaatagggtagctaataccttccttttctttaatagagggtatttctttctacagctgccaaggttgggaaaatggctttatatggtagcagtgatggcaagatttctacaaattaccaacctacatttgaattctataatgtgttgcccaaaaaaagtgtttattcacatgtagattctccacttctggcagcctttattaagactgattttcttatttattataattttactgatatcatcttgctttattccagagtggcttgtttgaatatatgaaattctttctcactaatggggacaagagtcattatcttcatagtcatagtgttcctctgtggggattcctgtatcacacaattgaacactagctaagaagaggaaaggaaaataattgcaaaatccaggccctcacccaccacaacatttaacagtagattttttcctcttttcattattctagagaaaaataatgctctatcattattgtatttttgtcttttgctgtacacatgatttattattatttttcccttgttagtcgtttgaggcagaactgaagcagaatgtaaacaaagtacaggagttgaaagacaaattgacagagctgttggaggagaacccagatactcctgaggcccccagatggaaacagatgttgacagaaataggtatgttgcgttacttagatgaatgcctatgaagaaaagtgcaatcatttttcatgtttatcatgatctttatcagaaaacattcaacagtcacttatttttggatttgctttaatgtttcagaatctattttttgcataaagtgtcatttcaaattatattgtgcagaaaattggcatatcttatgttttttatggtaaacacagtaattaaatctatttttatgaagaaggtagatactagttaatgaagtgctgtgcatggagtacctgttttcattaatgtttctttttcctagcttttggtgctttattatgctttatatatttttaagctgtattatattgtaaatatttctttcattcatctggaaaagctgtgctcccttctccttcatggagttacttctgggacccctcct

SEQ ID NO: 121250 - DNA, 1026 bp, Homo sapiens
cttccaaagtgctaggattacaggtgtgagccacctcgcccgaccgtgtgtgtgtttttaaaagtaattgaaatttttaggattaaaatatgctgtaaaatgaagttctgaattcctatttatttttattgttcctagtaccttttatttgtgactggtctcttacctagtacagttttacagacttacagttgacagttattttggaacccatagcagccaggaatagcctgactcccactttggctaggattttacttgccacttctgaaacctttgaaggcagaatgggccatacatacccaaccgttaactgagataacagtcacctgggctgtgggaacaaataggtgcctttttctttcatcgactccctcacaaatcagggtctacaattattactactttaagatatgtttaagaaactgaattataatgtgcaactctgaaaatattaagatggaaaaataatgtgtttttatatctcaagaaattacaagaaaagtggagtttaaaaacaccagagattcagaaagtaaacaacagtgggatctcactatgtaacttaataagtgctgtgaccacccctgcaaaggcaatagcagcagttaaatcaggtatgagctttatttacatttatggcaaaaactaagaatcaggtttactcatgtcaattttgtgtatgttattttttaaattaatgcataaaataacctcagaaatacaaagtgaaagtgacaagaaacatggcatctgtaagcacactgtgctgggaatgtatctgtactaatcaaatttcaaatccttcttatgttttattttattagactgtatttaaaatgtagctaaattaatatgtaagaataaggaatgttatattggggaagggaacagatcatattcaaatttgtttgctttttaccttaattaaatggagatattgaaattctatttaaaatatttaattataatatttgataaagaaatgagtctgggcagctgggaaagaagtgagggaaggaaata

SEQ ID NO: 121251 - DNA, 1050 bp, Homo sapiens
atctgccaccatctcccatcacccccagatgggactgcctagtttcaggaaaacaagctcaggctcccattgattctacattatggcgagttgcataattattttaatatatattacaatgtaaatataatagaaataaagcacacaataaatgtaatgcatttaatcatcccaaaaccatcccccctccctggcctgtggaaaaaattatcttctacgaaactggtccctggtacctgaaaggctggggactactgatttagctgatttcagttgtcacctatgaaacctttcctcctgtatcaaagggttagagtacatggaagatggtttcttaacattgtgtgacatgagaataataatttatttattcttctttctgtgacttaaattcttgtatgatttttgttatgtagaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaaggtgaatcattgttatctaatactaaatttccatttgtgtcaataatgaaagattaaaagactaatggtagttttctttgatctaatatcatctaagttttatcctcatatatgtactgtatattttgttgacctttggaaatcatggcatggggcttaactaattcttttggaaaaggacataaattttcagtggatttgcttttttaaaaaaaggtgaattaatgagttgctgactattctagtaatcaagtttcctttcctaccaaatctctacttagtttcagtaattttttataccacttctcataatattaagcaaaacatcctcttcactcagcattttactctagcttgtatatattactataaagagtatttggaaagagaagttatttgaatctcctgcataaatagtgcacaagtcttttgtcttctgactcaaggcttatgccttgaccaatatggcatttttttt

SEQ ID NO: 121252 - DNA, 1141 bp, Homo sapiens
tgagatacttgtatttacttatatagataactgaaacaattttgaaaacttgagaataagcatagggctactttatagatgtttttatattttgatcattttttgctattaaagttaactgcattatttggtttaacatttagaaggaaaattcaatacttcttacataaaagtggaaaatgttgcataagaaaaacgatggcggtggtatattactgaaaatgatctaaacttgctgtagtctctgaagcctagggcaaatatcacatttttatttgcaaaggcagaaataaccttgaacaacagctcgtggttctttgctttctgagctcaactcagaaacgatgtgcaatttcaatatggcctttttaatataatagtttactttttaaagagcagtagatgagatatgaacctgtgaaaaaacactattagaaacaagtgaatgaacctaagttgagctaaaaagctgtacagggccttgtgattgagcttttgtgtttctgatctcacgttagtttagaatatacatcggattttgctaaagtttatgtagaaaagcctcagaacatagaaaagtcatttctcttccaactactgttctttatttcttcagaattctctacctaaaatgtttgagtgctgcctttacttctcacagagctatatgttccatcctgtcatatggtatttaattcacattgcgtagaagaaatgttcttggttttcttaggtgatctctaggttgtttcttctttcaaatgggtccaactttaaaataatgtagttatcagtattagtccagctgcagtgcattcttatctgccagtattctgcacgcttgcatatatgtacgtgtcatccacatgccagatgtaactgtcctcacagttgttcatgtgctgggcatgtgcactgcctccgtggtgcagagcatacagaacgacccatacagttcaccagggagtttcctgagtctctgtaggggaggcacacatgaaaattctctagtcactaggtttcaactcattttgggagacttgaatctggactacctgcagcagtttatccatccataaacgtgactgtagtatagtgtagaaaccagtaggtggcattatgttttcctcatgtcagtgat

SEQ ID NO: 121253 - DNA, 3138 bp, Homo sapiens
ctcaaatctgttaattatatgaaaatagctggctttccttcgaaagtcacttattatggctgaacaggtcactcattttacttaccctgttgatgcagttgcccaattaagaagtcgctaacctgccaacttcaagctgccattcagagcatgtgctcttgtgagtttccaaattagagctcattttttttcttcaacttttattttagaatcagagggtacatatgcaggtttgttagaaaggtatattgtatgatgctgaggtttggcatatgatcgaacccatcacccaagtaatgagcatagtctccaacaggtagtttttcagcccttaccttcccacccctctcccccaactagtagtttccagcatctattgttgagagcttatttttgaacccactgcttgtttcctctgccgatggcattttcgtgcatattaaatgctgtctccctccccactcagtatgctgatgggcttcattgagttttagtaagaggagcatgattttctctttaaatcatccaaacttaacctctcactccagtgaaaattttcaagatgttttctcatgttgtagcattagaacaattatattattttgttgtatagattatgtttcatgggccaaatacaagtcagtaagatgttagagatgtttcaggacacagcttgtccctactgaagcgttctacaatgtataagactaaagcattcagaaataattaaaatatttttcaaattctcggacaataagtgataaataaatttaaaacatcattttccagagagaaagagatgaatacattaaaaaccattgttcaaacttttcattggtctacaatatagaatgtaggatgttaacatgtagggctttagtcaagtgaaaactggacgagaaagggtttttttttttagcatcttgaatctttagaattgaagataaagtttatcctcatatgagataggttagcctgtttatttttctcttttgtctgctgttaaacttttaaataaattcaattagtgtatattttagaagcataatcttaactttaaatggattttcattgttgcctgttttcttaattacttgcatctgccagtttctgtgcatttgagtgatttgcttaagttgtgaagtatgacaaaagcttagcatgcgtgtgtatgaaggagggagatagggtgataatttttatatgtaaaagttaattcttcagaaatctttgtaactgtgtattgtcttgagaatggctgtgtgtgactcacctttttttcctccgaaagtaattttcaataagtatggctaatgtgaaatgtcagattgagaaccagtatttatttcaaagatttgctgttcggactactcttttgtctctctgtgacaattcaaatgtttatgcatccaaaaaaatctcttttcaaatgcagatgggatatatattaacttttaaaaaaagatttcaattttcagtatccattgggctcttttctttctttatattttaacattttaggtggtgttctgattatgcattaggaatttatcattgaactttttattttttaaattttttgtgtggaaattgtatgattcaccttcatgtgtttttgaaaagggatagggcaaagagaactttgtggttaatattcctgatctgtttggagtagatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattgtaagtgactttaaaaaaaagtcccattttcagttttttaaaaaaacagttttataagctcaaagtgtagttagatttaagataaacttaaggacacaaaaaagagacatttactgaatatgagtgtggaaagtaatgcttgcacaaaatcaagtgtgtaaaatggtttatctgtgaagaagtgtaggaaggactttgtgtactttttcttgaatattattcattatagagggcttatgcatacattgagtcttatcttgtttatcattgtttcagccagctgcacatgaggttaatcagatcagtcttgtctagtcttttaagaattaggaccatggctaatccccaggctccattagattctaggggttgctgagtagcagcagcctcctgcctctttcgaccaactagccagctgttcttcactctctcagagagatttaagatggcattcctcaagggacagaccaaacttgtcattcagtttcaactgttaaccttcctaggcacaggttgtgcaagcttatgttgttaggaatagtcatttaaaaaaattctgtcacattatttataagcatcataataaaagatatgcaatatttggtttattttagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggtatgcctcccttactactcaggaggctaatcagatagattaatagttagggcaaactcatatacttagtgccagaattataattggcaatcattttaattgcttatagattagtaaagatctatgttttactcctttaagaatttcaaaccttatcttttccttgaagcctttgctgattgattggaaataaatatcatttatcacatgtatcataggtagtataagtatcatcttacgtaccagaagccacaaagagacaaaatatagaatgcattttaaattaaataaggtttactgtgttccctttcaaatagcctat

SEQ ID NO: 121254 - DNA, 1839 bp, Homo sapiens
ctctaactaattccaccttctcagtccaaacagaccgaacggtggaattgtcttcagcccttggccttcagtagtcctcactgctttgttactgctgaagttgtccccagctggtatctctcctttatttcgtttccattggacttttcccatgcagtgctacaaatttagccttcctataggacagccctgagcatctcaaccccttacccaaaagccctgcataactccccattgctatgggataaaatgtaaactccttagcctgatgtttgaagcctttccaggcctatttctatttactcacccataagcattgtcaaactggatgggactctccccttctcctgtgattcttctgtcctcatctttgtgtcttctgtttgttctgcagggagtggttctcccaaatccacactttcttaaggagccatctcagtgtcattaccattgaggtggccctcatttccctcccatttttttcctgttaacttccagcagcattttttcagactcacctgtggcacttaccacttcctgcctcgaaccataaaatccctgaaagtaagctttgtgtctgtttttatttttgtatattcacaaaatgtagcaaggctttttgaatttgttagatgttcagtaacttttattgaattaacagaaataaacatgactcagtattgagtcaggatctactgatttgggcgagcttatttatctcctttcctggagtcagaagtggtctcaaattttggttgttgtttgttttagtagtagttggggtattgtacaaagcctagaagtaggggttaagggtataaagttagagggttgtatgatcaggaaccagggaaattattatgaacatatgctcaaaggtttatttcaaaacttaatttgtgttatccagactggctgatgcttttgctaatgctgctttataactggccttattcgaagaactctggagtaagttgatgatgaaagttggtatgatgaaaagtttattctgtccaattttactttatcttattagaaatcattttttccacattagaaatctattatttagtcctgctgagtataattgaaaagcgtttaatcctacaggctttgcaaggacagatatcaagtcagcaggttgctgtagagaaactgaagaaaacggctgaagtgcttttagatgccaggggatctttacttccagccaagaatgatatccagaaaacacttggtaagatattcatgtccttgcttcctgtctcacaggtaaattctaaagaaaggtgtcctaatagatatggagaaaaatgttcactagttatagattgtgttctatgtgctctttctctgtgaaatggtgttcctgcatctgggaaaaggcatgccttctttggcaggtatattagaatcttagaggcgggggctatgtgtcttgaaaagagtatatttaaatttaaatttgatatttagaaaacataacaggaactcgctatgtaatgtccaccacaggaagtagaacttcacaaaattctcttggttgatgggattgggcagagttaggccttcaacttaaggccaaagtagaatctctgagggtctttatcaatagtgggaacgtgggtttaagaggttgagaaatgtgcttaattgaattgaattgaatttatttttagagacaggggttactttattgcccaggctgagtgcagtggcacaatcatgtctcactgcagccttgacttcctgggctcaagcagtcttcctcatctcagcctcctgagaagtaaggactacaggaatgctctgtcatgtgcagctaattttttaaattttttt

SEQ ID NO: 121255 - DNA, 1097 bp, Homo sapiens
ggcaggttaatatcaggcagagagaaggcccgtgaaggggtgggaagcataggatgagagcagggaaggaggtcaagctgggaggtcaagagggtggagggcactgcttctttcccaggctgaagagtttatccagcccttcactggacactagggagatgatgtgggccaggtcagcatccccagatccatgcagcctcctcagggttgcttccttttttccaatgtgcattttcagtcctgtttttttttctttctcctttccacaggtacaagaacaaatctatcttaattaagtttttatatccccatgtattgtatattcaaggacaagatatgtggtgggggtagaggagatactgtgacattaaggtcattattttagtaggaaatacgtatcatttaaaataattattgattgcatatattacatttaattaggaagttattttaagtatagaaaatgcataaaatagaaataacacattttaagttagatctatattagtaaacagattatactgcatataaaagtaatttttatataactagagcagaaaaagaataaaacccaaagaatgtgatggttttttaattaaacagatatgtggataaattttaaaacggaaaaacctatttagtaattgctgcagaagactcttacagtcctaagacagttaaagaaatatgaaaaagaaagagatctcaaaggagaatgaattctaattaagtcatagcgtaatttgaaaaattaaatgtacaattaaagttgttgctgataatgcacatatttttctctcagaagatttcagaatgtatcaaggataaatttttatgaggattaggtggcctccatttctttgatgtttattaacattttacaattacttttaacaataatataaacccatgagactactacaaaaaatcgatctttctacatgtagcatactatcttctacttatattctgatgaatcataaatgtaatttttggggcatccaatttgttcatttcatttgaaatgcttttggccaatagcatgttgttattagcattattattcaaagaactgtgaactgtgttgtcaacaatct

SEQ ID NO: 121256 - DNA, 1037 bp, Homo sapiens
aacatatagaaatttattaagcacctttaaaacccttccatcaaatcgatatctatacacatggtgtatcaaaatctccttcctctgatgattgatgtctttatcttttattctatgttaagactcagctcttgtaaatatgtttttgaattggtataaatccagaactatctctttattttatggttactttttggcttcttatagggtacctcttcatataaaggaggaaatcttagcccaacagagtttttattaactttggtggaagtctggttttttttccaagttacatattttataggtcctaagattatttgatgcatatgaaaatagtgggttttaatctcctaccccttttctcttttgattgttagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggtaaaaagcgagagaaagatccacatttccagtagtcttactgaaaggcttccaatttctcacacttttgtgatagtttcagctaagagaggggaacaaatgatgtgaaaagtatacttctgcctccagaggtagttttgactctatttctccacagtacattctttttttttccgaattttttttttttttttttttttgagatggagtctcactccatcgtgtaggctggagtgcagtagtgtgatctcagctcacggcaactgccgcctcctgggttcaagtgattctcctgcctcagcctcccaagtagctgggactacaggcgcccgccaccagctgggactacaggcgctaatttttgtatttttagtagagacggggtttcgccatgttggctgggctggtcttgaactcctgacctcaggtaatccacctgcctcagcctcccaaagtgctgggattacaggtgtgaaccaccgc

SEQ ID NO: 121257 - DNA, 1021 bp, Homo sapiens
ttttaaagcttaaagttacagattctttttccctatttaaaagtttttccaggatcatttcgtaataaaaaatattatacttgtttgtccaaaaattaggtaaagacattcttttttgggtagttgtgagaaagcagggaataaaatgagatcagattatagacacttattttaaaattggaatagaaattggtttttctaaacttctgaaaaatggtgtctgtcctatctgattaagtacatagagaagattggaaattttctttaaaataagattagcatgctcaaaatgccttgttattctgaaatccaccaataaaagggagtacggtatagcttgaaaaggggaatgagaagcaagttgtagccctgtagatcattgaaacctgtcagtcttgaggcggcaaggagctccctgcaggtgttaccccgttactgcttgaagattatgatcaatttgttttcacataggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaaggtaatgttattttgatttt

SEQ ID NO: 121258 - DNA, 1805 bp, Homo sapiens
acattacatattacagattctggtgtttagaaaaggaaagtatcttagttcactgggaaaattagttcatttttatcctgagtgataaacacattaaaaaataaaagtttagaaacaataaatattagcatatatttacaagcctttgtacatgtgctcatataatattaaaaaatctggtgtgtgcaaatttatatagatcatatactgaatacttatgtgttttcagtgtttcactgactgcattctttcgttaaacatgaaaattcatgcttttctttaatattgtttgagtttcaaattatattaagtattgtgattgaaactcaaattaacatactcaatatgtttattcaagctacatatactagactctctctgtactcactctgtcttttagaattacaactctggaagaactaaataggtaataatttaataaaatatattttttccttttgtgttataaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtccttattcaaatatgtggtgcactattgctatgtcaaaaagcttaacagctacttgatttattattaatatccagtggtagtaaataaggattatcactaaggattattatgggattctgggtttccaggtacataattgaccaagtactacaaaaggtttgaagagttggctttgcttaactttttcttaatatttaagtgaggttgtgaaactttcttcttgtgaaatgtgtgatcactcatcaattatagttaaaattttggaatgtatttttaagaacaggggaaacttcaaagtaactgcctgttgctctgaggtttaatttcagttgttaagttttcaattgtgtcagtttttagtaccctcattctaatttaaaatgttctaagtatttacttttggaatgtcttaaaactatgccttggcccacgttctgaattcctcctgtgaactttcccttcccaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggtgtgttgttataaacatatgatatcgttcaattctatttccaggttggtaaagagagaaataacctagcacatgagttcttttcaaaccttactgacaaaagaggtttttttctgtgttcatcatgtcagatataaattattatgagagttctaagcaagtcaaaaaataatgagaaataaattgtagagttggcattctccatgtaagtgaagtagaattattataaagatttaataataatagttaacatttataggacagttaaagtgggcactcttctaagttctttccattttaactcattttgtcttcccagttactccttggggtttttattttcatcttacagatgaggaaactgt

SEQ ID NO: 121259 - DNA, 13335 bp, Homo sapiens
ttaacaaagattccttgggagagttagtttcttttgagaaattttgattataaacccttggtatttttatattctgtagtttcatgtgtatatatatatatttttgagacagggtcttgctctgtcacccaggttggagtgcagtggcatgatcacagctcactggagccgcaacctcccaagctcaagtgatcctcctgcctcagcctcctgagtagctggactgcagacacatgccaccacacctggctaattaaaaaaaatttttttgtagacattctttagttttaaattctctaaaacattactaagtcagatttagacctagtaccctagatacattcttaatgcagataatggcgttaattataactgtctaagaacagctgatggtcgttctgttaaaggaaattttagttaatataagtatgtccttcaaaaatcaatgcagcctcatgattatagtcatgaaaaataaactttaaattgactctaaatagacttcatgggggaaaatatatcttttcattggcccattatttcctcttatttctgctaatttaaaagaatggcaattaatttctgaaataagggatttggaaatgatacactgaggaattaggagaaagtgtgtgacctcttgcttttccccaaacagatcaattttatttctctgacagatgacagtcacagatgacttttacaaagtgggtcttagcattagaaattatttgttctttttttcaatagttaaaaagtttcttttagataggatcttactctgtcgcccatgtgggagtgcagtggcacgacctcagctcactgtaacctccctttcccacactcaagcaattctgtctcagcctcccgagtagcttggactacaggcatgagccaccaatacttggatactttttgtatttttcatagagacaatatttcaccatgttgctcaggctggtctcaaacgcctgagctcaaaacaatctgcctgctttggcctcccaaagtgctgggattacaggcatgagccactgctctcagctagaaattctttattctgggtctgcatacctacagattattactttcaccataattttttcaaaaggaacattgtgtctaggagcttggcagaaggaagatgccctttggaagtagtgtcccacagtcatgtgtctttttgaggactgcagtgcgcaaggatgacactgggccagtgctgagtgcccacctgcgggtggaggccacctttatccacggctggactaggacagatgcaggaaacgtataatgtattattttctcttgaaaatgacggcattaaggatagagagaggagctttccttacggattctaaataaaatactcttatctagctctatagactgctaataactgataggttattcacttgggtcacccagaaaatagacttgggtcttgactaaagcttgattaatttcttttttttaaaaaaaatactgtttactccttttggaggaagagtttgaatgtgccttctttaccttacagatttccagtgaggaaatatcaaccaagaaggaacaattatcggaagcacttcaaactatacagctttttttggcaaaacatggagacaagtatgttggttgtagttagctcttttattttaagtggggaagtattcttaaaagctttcagcaaaacagaggtggtaaattttaattgcaatgttaaatatgggactcaaactaatcacaattaatatagtaatgtaaagagtatcaacttagtaatttaattgtcaattttagtctttattacaactttgaaatattcttattatccccatgtattaccgataaggaaacaggctcagagaggtaagaattaatagcaagtgagaggtagagtgcagactccgagtcaagtcttaaatctaagtagtactctgtgagacttattctttggaaaatatgtataaatatggtcttcattttcttagctgagacctatggcagcctcgtttctcatattttgtccctactttttgcagcaaagcactttatatatttcagtcagtgtttcactcagggaaggaatccacctttttcttaaattctttttggatgtcctcctaggattatttcataatgactttatagtataccttagcaaattaggttaatccccttataaatttcctctttgtttgtgctttagtctaaacaagtttcatcttgagaaatggtaccttattgtcccttttccatgttgggattaacaatgagaccttaccctctgtcagatagcagcaattgttattttggaattttgtatgttaaataagggtcaatacattagtttacaccctttccttcagtccttttctcaggcaagggaaagatccttagatattttaaggccattcttaattttcatatacagtcatactgagacctgagcaatatgtatgtgaggctatattttattttaccatcatatgacaaaattattgaacctaatacatctttatctcttgaggacgacttgcattagtctttttatcatttctggttatttagaatgacagatgaagaaagaaatgaattggaaaaacaagtgaaaactcttcaggaaagttataatttattattcagtgaatctctgaaacagctacaagaatcacaaacctcaggagatgtaaaggtagaggagaaggtaatattatttatttaaacatgaggctgtttcaagaagcttagtttgattgcatggctctggaaatctatgtcaataataaagaaatgaccttgaattttgtacgtagttaaaatagggattgagtttatttaaatgtttggagattccagtgttgtttattaaatgcaatcttacacatgctgaccatcagtttctgtgacatcttaatctctgccttgcatggtaaaagaaaagtatcattcattcttctaactcttctctttaaaagccattcttctagtatagtaggtattttattatattataggctataaaagagcctgtgggtcatctctaaaggtggcattgatgtgttagagattgtttgactttcagagatatccatgagacttatttgagtaatacaaggccatacattatagtgaggatgccctagcatcttcttaaagtataaatcatttaaaatttggctggtacttaaacttttaaaacttgacagtgtatatcaacaggcctaacataatattcaatattcaaaaagttatctttatatttaattccttactcctgggaatactttccacataatttgtcacattttgggggtatgtaacaatttttccagtttcttagtttttgactatctttgaagaagtctgtatgctgtaaacatcaatagcatggggtttgatactctctttcctgccactagactctaatctcacctaaatgcagaaagcatggtttgccttctagatatgtgttctgttttctcactatcatcatctactctgttgtgtcctcactaaccttgtcaatatacacgatatcaagttttcaattcacagatgcatgttgttttcaaagcttttatcacatcctgtgctgttgaatagatcactgacatagatcacttgtgcatttgaactgcctaacattcacagcattgctgcgccttggtaagtagaggatttttatgttgaaatgtattatttattttttaaaaaacctaagttgcatgaaactccgcccacccttgtgtaacagagtgacctgagatttttgcattttcctttcagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaagtaagttgacctatacattttatacagaaaaagctgcatgaaccatgtgagaataatcccatacatttgctttaaacatctgcataaaggttattgaattaaaatgtccaactttgtttttagttttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggaggtaagaattgtctactgcctctttatggatggtagtcagctgatgtatgactgggaaaaagaagcagaacacttctatgtttcatgtttatatttgggtttttcactaaatagtaaataggtccgggatatatttctttgcagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatggtaggcataaaatgtcaaaattttgatttatgaagaaaattttattatttgaggatttagtcataagctggagtattttagttttagagtgctaactcttaaaccacagtcattatttgtaagaatttgacattttggggaaagataactgaatgcacaatttttttttctagtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaagtatcaaaacaaagatgacaaaatatatttcaaaaactatgactttaatatataacaagtgtttagaaaatatgactttgctaaggctacaaaggattatttcctttctttgtctctagagatgtctttattcatagttgacacaactataaaataatcacaactttaagggtatcattctgatgctatcccaaaagccttatcatactcttacaccactgacatgttgagatttttatttatatatttatttatgtgttagtcacataaatatataatagtatgaattagccatataaaaatcatcatgtaaatacataataatatttgtagtacagtcatgcatcacttaatgatggagttacattctgagaaatgcattgttaggtgattttgtgttttgcaaacaacaaggagtgtacttacacagacctagatggcatcctttactgcacacctaggctatatgatatacctgttgctcctaggctacaaacctctacagcatgttactgtactgactactgtaggcaattgtgacacagtggtttttgtgtatctaaacatagaaaacgacaggaaaaataaggcattgtaatcttatgggaccaacattttatatgtgacctgtcgtatgtggctcatgactgtgtttatatgttgtcacttttggcatactttttttttttttttctaagttcttaatttcaacagcattcctcatgaacaatgattaggcttctggcctgagagtcagaaaactgaaattctggcatatttcattcatatttcaaatccctcaaagtattatttatatcttaccacaattacatggatgttgtaaatgttagcaagtcatattttaaggtagatgtttctcttcagtgtgctaaatatacctaagttaggtctttgccttttgtcagagttatattttaagtgcaatgtgacaggtaaagataaaacatttttagagggattatttgtctttttatataatactaactaccatggtatttaaataattaatttatcatttattactagatgataaatagatttttgatgaatagcaaaaaaattcataaaacttccattccctgatgtgagaaatgtatttacaaaacataaatattattgttaatataaattttatcatggcttaactttctactgatagcttgtactacttttttaacagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaaggtttgcctttcttcgtggagttggcattcattgtttttagtgtgaaaccataatgtagatacccaaggagtatagtgtgacaggaaagattttctggaaaggcattaatggataagatacagtgtacatacaaatcctacagtgtataacaatattgttttcactaatgatgctataatttagttgatttgaatttttgtgactcccaaaaatacttaacttcaagtgagagtcttgattgcctcccaccccaagactaggaaatttgaatgcacttagaaatttaacacattgaggaacatatgactaaagaaggttaagagtttcgttttcctctgggaaccaatacagcacagcaattcagatcatgggctctggagctagattgcctgatttcacatcccagctgcactactcattcattctgtgaactagggcaagttacttaacctcagtttaatcattggtagattggaaataacaatagcgcttacctgctagtgttgtgagcattgataaaaagaatgtatgtaaaacatttagtaccttgcctagcatgtgttaggctcttagtaaacgtgatctatggctataagatgaataattagtgtatacatagtaggaaaatgaaaggtgcaagtaattagtgttgacttcttaatcttttagaagatttaatgaattatatgagtgctatatctaatagcaataacgagcaaagaggtgagaatgcacttagacatagtgattaagtaaaaatattgcatgcaatgttccttttattatttcttgaagcaccagacattgtctctagcatgataacctatatacacatatcaaatatgttaacctacaaatcacaactaacttctcttttgatgtccttttgcagaattaattctatgtgtcgcaggtttcaacagcttaagaaaatgggatgtttcttcctgttggtcagaagttccatctcttacaaatatgcatggccagtattctcttgagcagtttcatctaaacatgatcactttctttgtatatgggatatgctcatattttctgtctcaccttgctcagtttgtaccctactgctatcatgtttacagcatacttataaaagcttattagacaaaacttggaaaatgtgttctaataagaagctatcacaatagcgattttgtgaccaccatacatttaagatgttttgggttttcttcactttagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggtagaatttggttttctatcagcagatctatgttgatgttatgttcgattactatcatttggaagtcagtgaagattattgaaaataccagtaattttagctttttagaagcaaggcatacccaagacgccctgggcttgagctttaaactttatactaaaagttagatttccaacttcaagcaagctaggtaatttttttgactttttttggtaagagatattgagtggaggaaatattaaaggggatttgataatgaaaataccttgt

SEQ ID NO: 121260 - DNA, 1041 bp, Homo sapiens
gctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggagga

SEQ ID NO: 121261 - DNA, 2367 bp, Homo sapiens
caaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagaggtatactctgtgttctgagaccttatcagctacctaatgtcaagtttcctcatttgtttcctttctctcctagactaaatttttaaaacaattttgaatgtgattggctcattgtagttctgacaggaaaataatgctatactctttctggtaacttacttgaatctttatcataaattaactttaatttttgaatgtttgagattaaacatacagatgtaatagatatactgttatatctgtggagatacattctgaaaaatgtgagtatcaaaaaagctagaagaaccaagcagttagctttaacttctaacatattctgtggctagactttgtcttagtcttttttaaagatataattttaatacctttaattgtcatctaagataaaattcagactctgaaaataatataatacttattcctgaaccctccttggtttgaaatttttcttcttttcactaatcttgtctttgtaattcaaagaattatgtttggattgagaatggataaagtgacataatgttcttgaggtgacttttaacattttataaattcctgttacagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagct

SEQ ID NO: 121262 - DNA, 1302 bp, Homo sapiens
ctttgtttttttaaccataagacatgggaatataagtatcatttttaatttctattaggttagaaaactaaattctttagcatcatttggttcctatgtgttgggtgttcttcctacctcttaggattatgttgcatgcaagagaagaaagggcaccgtcgtgagagttttatttcccactttgtcactcacccaatgtgagtttgcaaaaatatctgtcctcctcgtttctccctttcctcatctgttgtaaattcccttcttgctataaaattctaagctagctaatttttaaaataaaattattcctgaggggcaaaaagatattcttcagaaaacctgtcgtgaagggttttttgtcctcttctgctgactttctgaggcttcctctctgaagaaggtgatgctgctggtggtggtgatagcgcttgttctgcatttgagttcacttggttttgtaagtacttttatgaacattgattcatacgttgtaagatattttgaacagaacaggcttgacactttcaaaatgtcttttgtagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcaga

SEQ ID NO: 121263 - DNA, 3442 bp, Homo sapiens
tttttttttaaataagtaggagtacactctaaaacaacaactaaaagtatagtgtggtaaatatatagaccagtaacatagtcatttattaccaagtattacatactgaacataattgtgtgtgctatacttttgtgtgacgggcagcacagtaagtttgtttacaccagcatcaccacaaacgtgagtaatgcattgtgccacgacatcactaggcgataggtatttttcagctccattataattttatggggctaccatcatgtatacggtctgtctttgactgaaatgtttcatgtgaaacacgactatattttctttatttaaacttaatttaatgaatctaggttctaatgatctgtgtcaaatcactaaagttattttagtgaatctaggttctaattatctgtgttaaattattgtagaatgaaactctagtactttgcttcaattcattttatcttattgactcctttatacaggactatgaattacaaacaatgacctaccgggccatggtagattcacaacaaaaatctccagtgaaacgccgaagaatgcagagttcagcagatctcattattcaagaggtaataaaagtatgagagaaagaggggaaggggcataaaagaaagaacacttactttttaaattttattttttgttgtggtaaaatatacatagtataaaacttactattttaacaattttaaatgtacagtttaatgacattgcagtatatcacaatattgtgcaactggtaccactgtttatttccagaaccttttcgtcatcccaaagagaaagtctacacccagaacaatacattctattaagggtttttaaaaaccctttaaaaatgtttattcaagattaattattaactatggagataaataaatgtacttatgtacttcatggtgaaatttagaagagaattatcatttgccatgatttgcataatagtaataataagctcattcttatcatttattatggggggagttgtgtgctttgctgtctgaaggcctagttaatgtaattattattcaaaattcattcaacttagtaagagtaactggaggtaatgcttttattatttttttccttacttgcagttcatggacctaaggactcgatatactgccctggtcactctcatgacacaatatattaaatttgctggtgattcattgaagaggctggaagaggaggaggtaatcattaacagtgagcaccctgtaaatataaaggagctagagatgagcagtaactacagtgtagtttgggaaagcaaaacatgtttcatgataaatttatgtggccggtagcagatgtacaaataaatattgaattataaaattacaatgaaaatgactgaaggcctaagatttttgtttgtctttaagattcattcaaatagaaagtcatttcacttcatgactttacattttcacttcaggactctaatatggtggggttaatgtcttaaataaattacgaaattttggcagtttggcagaatatttttcggctttctcacagctgagaggtatacttctttgaagtatagttactgctggtatgatgtctacaggaataccacacgaacacatttgtcttatgcattttaaattaatttgtatctcaagaagttaaaattattatacataatgtaaagatgctaacttagaagtagtagacgtttttacaaaatgatactttttaagaattttggagttttttgttgttttttttttgcaaaaagatatagcacatggcatttaaaaaggctatttaaatgccactctgatttggagaacttctgcagctttgattctgcatttaaaaatcatatttctgcatttataaatcatatatttaaaaatcatataggaagagtaaggacttatttataaagatcagtggtcaccaaaggctcttgtatgtaatctaaaagggagtatgctatgctttgttatcttgatgtactttctattccccagaacagacaaaaatagtagaatgaatgttgaaataaataaattgtgggccattagctattttaaattggactgttgttgaaattctaaaggtgattatgcttaatgtaactccatatgagagctgaaacagcagtaaacatctattggatgttactttctcagtttcctaaaaatgtgaccacttttataaactgttttagtctgttcagagttaacagttttctgcagctaaatcactaacatagctaattgcaagactttataaccctcttcctttgtgcttaggagaaccaggatatttgtgaccatcttaaatgcatgcatctctcatctatgaaagaacatccataattttcttatatttttagtttttgagagatcttattccattttaaatggtatacagatcttttaaattgaatatgcagtagttaaatataaaataaaataacttaagttcttttctcatagtatgtatctgattatacatatatgggccacttactcgatttatctgatgaggcagaatgctaacaattgatagaaacaaaaaatattttagaaggccttaattgaatgcaagttattattgtccttaaaaatgtcaaagatttgtagttaattgaaaccagcaaatacagttatggaagaacaagcgaaggctataatttaaaataggttaaaaaaaactaccacttaacattacgttaatggaatgtcgtgtaaaagatacatagcttaatttttagactcaaaagattggtgtttctgcaactgaggtttgaagacccacatgaaaaaccttggtctaaagcagaattttccataataaacataaaatcaaagatggatgcaagttaatttcagaagtaatactgatttagttaaaagaaatgttactaaaatatctgtaatagatattagatattagagagagatgctttagtctgtgctgagaacaaaatatgctaagtattaatcaccgtgattaaagggcaagattgaggaagatttagagaaaagttaaggaagttatttttatgcaaataagtttgagatccacaagaaagcaagtcagcaattggactaaattatttctagtaatttttctcacatttgctaaaaaagtcaagagacaacatgatttttttttttttttttttttttttttgagacggatctctgttgcccaggctggagtgcagtggcgtgatctcggctcactgcaacctctgcctcctgggttcaagtaattcactgcctcagccttccgagtagctgggattacaggcgcctgccgcctgccaccacgccgggctaatttttctatttttagtagagacggggtttcaccatgttggccaagctggtcttgaactcctgacctcatgatccacccgccttgggttcccaaagtgctgggattacaggcatga

SEQ ID NO: 121264 - DNA, 1915 bp, Homo sapiens
atgatacataggtttaatgtggtggttttttaaatcatagagacaggtatgtaatcacagctcctggaaaatactctctgagaccatgttgaaccattcattggactaccttatcgttatttcaaaactgaactgccatttgatgcaagccttactattcaagacactgtaattgataataattaaggttaagcttccacttttcttgctttttaagtttagcttcttgggcttgtccctagaataatcactgtcactaaattgcacaactcagggagcagaatgtttatattcaacccaataaggaatgcccttgggggtgtgcctcagggtgctgcagccttgagttctttatacatacccgtcttgtgcttagttcattgcagtccaattattttgtctctcccatctctacatcttccaccctcctgatggatatcgctggacaccgtgactattcggttactattctcttaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaaggtatgtaaaaataattccctctactgaggttatgtctgcatttggtcagtcatgctcctcatcttcctttcctatgttaaatgaaaaagtcaccaactctttagaggaaggtggagagtatataaaaaatattaaaatcttgcaacccaaacctacatacatgacttatttttatttcttggaagtaatttttgaaagcatgggtaatcagaaagtggagagtgttgggatacttttcaaattcctaatgataatttatttaatcataggtatagaaatctctttgacactttgctggcctcaatagttttctaggttcctaaataagtaaaaatggttagcaatggaaaattaaataccacatttgacagaaagttgaatgctttgagatttttgttctatcttaggggccaatcatctctagctctattttcttcagaaataggtggtggccaagggcatcaagtctgcttttggataattcctaaggagtttagtaatttctgctttgaaaaccacatggggtgggtcacttctgtggcttaatctgaaagtttgtaattttcccataaggcaagttgtgtattaagtgcaaagggctaaggagctgtactgtgaagtgatgtagatatgtcttagttactgagcatcttatgtagtagaatagctgaattccttgtcatttttgttctaaactgtgtatatttatagatgctggtgtccgaaatagaaatgaaacagagcaaaatggacgagtgtcaaaaatatgcagaacagtactcagctacagtgaaggtaggaagattcattaactttagtaaaatttaatattcaggtttgtgattctacatgtactgttaaagccatgcaagtcatttcactcagtgtttaaaagaatcttcatttgaacttttttgacacttatctaataattctttgtgaaattagtcacatgacagccccccagttcattcgtcttcttctctctcacatatgtacacccctgccactcccagccaccagaatacatagctctgtagttggtttcttatcacttttctttcttttttctttaacattgttagggtatttcatgggagagcttctaactttctcacttagggggacacttttcatgcttttcaagttgtcattgacaacttttcagttttagccctccagatccatagttccattgcttagctggaggaaaggggggctgcatagggctacactattgttacatatattttcatgagcttctaaacagacttg

SEQ ID NO: 121265 - DNA, 1076 bp, Homo sapiens
agtggtgaaactattgcaaagcaatttttaaaagttatctcagtgatttttaatgcatgtatttctttttaacagtgggattagtaggcacttaaaagcagacaatgaaaaagacatattttattaatggaggtagcaaacttgcttatggaatatattttattttgttgatatgcaaattttattaggctgaacgttataaaattgtcattaaaaaatcagagtacaaatattgaaaatttcataaggtttgaactaatataatattgtgcatatgaaagatattctttcctttatcttattttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggtaaatgagtaaaatctacacatatgaggctatttttttacttccatagttaatttgttaattacaatacctctacttagccatatttctttcttacttggaggactttagtaagacatttaacttaaaataagcattttttcaactctgttactattcatgtattctagcatttatatagttaatctgcttgccttttctgaaggaaaaaacaatgtagttctctaattattaccaacttataatattcaaataaccatgacttagtaagagcatgaagcatgcatgtgatagggctgtgtgtagcttctatactggacttaagaaatgtaaataaatggaaatgccctgatgttcattttaattgaagatacaagaaagtcaaaattctcagttactgaattaaaaaaggttttagggttcat

SEQ ID NO: 121266 - DNA, 1992 bp, Homo sapiens
ttgggaaaaaaactaactctcttaatgaccttatgtatcaactcttgtgacttcttaatgttcagttttgcacactcacactagccagtctagtgtgaggtgaggtctgattgtgtaattattgctgattataaactaggattcagtctacctctgactcaggtaaacatgagaatatgtacacgctcaccttcattgtgatgaaggatataaggacttgtaataaaagtcattatacacctgctgtgtgcaaaagtactaagttagatgttgaggctaaggagatgaacagtaagggaattattgattgtaaaacttgaatgctatgatgtagtttctttgataacaaacaaagaatatgtagatttctaagtcattggttcttaatgtgaaatgtgtgtttttcaactagtttaagaaaaacacctcatcacaggtgatggcctgatacctttgtttgttctctgttttatagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagtatgtaactgctatctcaatatataaattgcttcatacaactctcatttttatttactattaatttaaaattttatttttattaatataaatattaacttttattttgtcttaagaaatacattattggctgggcgtggtggctcatgccggtaatcccagcactttgggaggccaaggcaggtgaatcacctgaggtcaggagttcggtaccagcttggccaacatggtggaaccccatctctataaaaaataccaaagttagccaggcatggtggtaagcgtctgtagtcccagctactcgggaagctgaggcaggagaatcacttgaacccgggaggtggaggttgcagtgagccgatatcgcgccactgcactccagcctgggtgacagaggaagactccatttcaaaaaaaaaaaaaaagaaatacattatttttatggattgatgacacttctctatgttgatagtggatgtgcttcagagatgagtgtgtaatgtatggtcctcccacattttgcatgtaatttgggtagctcagcagttgtagccaatgaattttcatctcatacttaaacaaagttagaaagaaaccatcttatgttgcagtctcttgctgaataccacttgtggggcaggggatgggttggagcacatactctctattaagaagaaagccagaaaaatgtcagtttcatagtaaatgtatcagtgttccaaggtgaagaacatgttatgtcatgtgtcataatggtgcttcaggactacattatgcaaaaataaacatttaaccataggtggctattgtttaatttcctttttaaggttgaaaactgttaacttggtgttaaaaaacactcaagctgcagaagccctcgtaaaactctatgaaactaaactgtgtgaagaagaagcagttatagctgacaagaataatattgagaatctaataagtactttaaaggtatgagactcacttttggatatttttaaatatcgtattctacaagtatttctctagcacttagatcttcaaacatcaagtgttaaatatcttggatttttgaatggatttattccatttgtgtctctgtgatctcacagtttactctaagtatgttcagtcattttagtttgaggagagttctcatttgaagtttgaacccttttgacagtagcttttgatagtcaattcatgttggcagcaggaggagtcgaagctaaaaattaaattatttgtaatagattaacttgctgaaaaagaagttaatttaagatatcaaggaggtaaatagagaagttaatctgagaaaggaaaaagacttgtagttcaact

SEQ ID NO: 121267 - DNA, 1023 bp, Homo sapiens
tagggatgttatgtatgatcttttatataaaatacggttttgtgtctacatgaaatgtcacatatgaatgttaaaaacgtagaagagtagggaatctttagggaaaggagagtaatggagggcctgggatgtggttttgtacactaatacactaaaaagagtatttcttagggtggagagatgaaaactgttaggaaatactattatgggccaagaattttgatgggaatggaacatgtgaatgtcactctgatcacttttatgtaaaaattataatttaattaataaaaaatttcttaagaagtaaaatgaaaccttagtcatctttatgatcccatcggcctgtcctgtgtcttgtttgggtacatggataatatttagttaattatcaatactgtttcatattttatatgaaaaaaatatgatacatcttttatagccaatttactgaaagtagcttaatttgaggtagaatatgatcatgatatgttgccagatattcaatgctgcatcatacattccattcggaagtcctgcctaagtatagctcagcaggaatgaacttttccaaaaggagggaaaatgacaggcttacttaaaatagtcattaaagcatctcgagtgccctcttctggaaatcaatgaattgcaccttaaatagaaaagagtatttcatgtttccttgaggaaggaggtatcctttgtacaatattgtttaccctcatgaaagatacactctctattaaattagaagttcaagaaacacatttttaaaataaaaattcctagtattatcatcattataattccagaattacaccaatttgggagtacacacattttcttttccaccctccccaaacctcatcccagcaaaaacaaagagaaaccgacataaccatatatttctgtgttagaaggtatattttatgatctagcaccgtaaaaattcagagaaaggagagatgaatgtgccacgaaagaaaacatatcggaggattccacaaagcagatgtaagagtt

SEQ ID NO: 121268 - DNA, 2239 bp, Homo sapiens
tcctttgactcagtaatttcacctttaggaatctatagtaattctaaatatgaaaaatatatacataaatgtaaaaatgatcatattatgctatagtaattgtattcattataaatcatagttataaagacaaataagattgaaagtcctcatagtacaatgctcattgaaaaaaatcatgatgcaaaattttagcaatgtgatttcaattgcctcctcattttgcttgtttgtatttttgagccgtttaggcatactgaaaaattgagtgaaaaatacagagttcccatatgctcccttatacctccctcttcccctgttatttacatcttgcattagtgtggcacatttgctaaaactgataagccaacattgatacatcattattaactaaaacctataattaacattagagttcactctttgttacaagtgcctttatatttcaccttatccctttggattttcttttcagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtaaaaaaatgtttactttacctgagtgtttcagtctttattgttatcaatttcttttttaaacttagtattttactgtctgaaggtacaactggaccgcactgagtggggctcagatttgccaagtgttgaaagccatttagaaaatcataaaaatgttcatagagctattgaagaatttgaatctagtctcaaagaagctaaaatcagtgaggtatgtgaatttaaaatttgtatatatttcattttagtttactcttgttttgctttttacatgaagaccctgtaaatcaataatagatacattaagtgtgagtcagaattccttcagattcctgactggagtgtctttttaatctcatgttatagattcaaatgacagcacctcttaaactgacttatgcagaaaagttgcacagattagagagtcagtatgcaaaactcttggtaagtttttttttttaaaccttctgtttcccttatctatatttggcaaaaacatgattcttatgatgattttccttactaaagaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgtaagtacaccctttgtacttgcatactagggttgcattttaggtttatatatttttctaacacacttcttaattatttcttgaaggaattaatgagagaacttgatcaaaaggaagaaaatattaaatcagttcaggagatagcagagcagctacttctagaaaatcatccagcccggttaactattgaggtaaagctggaaagtgtaatggtgttggttgaatattgatatgattatttcccttcagattcttttattgctgagaagttgaaaattacaagccatctaacttttattaaaacctggctcagaaatgtttctgacaaattgtactgattgccttcagttctctggctctaagtatgtcacccatcacttagaataaaagtacccttgtcagcctctgtggctgagaagatgtattgctgtaaatatgaagtaccttctctgtgtaagcattgccatattatttatttctgattgtgtaacattgcacaagtgacatagtattgccaagcctcattttcctaccaagaatgggagagattacctctaatccatagagttgtgatgagaataagaaggaaataatttactcttactgct

SEQ ID NO: 121269 - DNA, 1580 bp, Homo sapiens
gcatatcctttccagtgacgcccaatctgcctgctttgttcatacttgtagggttttaatacaagctacaaaaggcaaacctcagctagcaaacgaatggctttaggctagattcttttgaatagttatcagcatattatttgctgtgtgttgcatatgcatgttgaagcatatttaaggagccactaaaagctgtaatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggtattgaatcattggtgtgggattgtgttttactttttgatgggcagcacttttcaggaatggtgagctctttgacttcaaagggagaagctttattttattttgtctcatcttttaggttagaaatgttgcaacagattgccaacagagttcagagggacagtgtcatctgtgaagacaaactgattcttgctggaaatgctcttcagtctgtaagttaattttaggagccattggggttgtggtagaggagtcactgtgcgtttggatgaactaaaacttttacataatgtttggttgattcttcgtaatactctccactgaaacttaaagtttgttaaagattatgattggtgtttgctctcttgagagacaagaagagggaaaacatatttttgaaccaacaaggaaaactaaagaaagcccaagtaggcttctgttccaatatttgatgttttatatttcaggttgttttgaaacttgtttcacagaattaatactgagttcttttaaaatacaggattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagaggtaagagtgctacttattctttctctgtcctttttttgtgtaactgtttcatgggcatttgaaataggaatgtagagtatgaaaattttatgaaatatatttctttgctgttttttagttgaaaatgtgtgtcacatttttatatattttggtgtttaagtaggtacttgtcttttaaagattagcaatagaaaaaatattttatggtgcgtataatactgctgcagtaactaactcgttaaaatgaataccctagatatagatgtaagttacatgcatacatttacatacatttaaagtattcatgggatgtttgaaagagaaaaaaatctaagaaaagtgtctgttttttgttctttgagatgcagttttgctctctcacccaggctggagtgcagtggtgtgatctcggctcactgcagcctctgcctcct

SEQ ID NO: 121270 - DNA, 1289 bp, Homo sapiens
tttagccctttctgctaagaagttttttttttttgaaggatagaaccatgcaatagaagagagtttttttattgctttctttatgggaattgcttcaaattatttttccaaagactgaaagctaaagtgcagcatttgggaagtgcatcttttaaagggtatgttttcttgtttggaggatgagagatttttagtagagcactagtaaacactgaatggtttattattatccagatccccctgtggcactaaatcatggctcacatcaataattacaccctcatcaaattttagataacccacgtcaccagctggctggaaattggtattgtctttgagtgtcggtttaacaaaggaattccactgactgcatatgatacagtacataacacttgaagtggtggcttagtgagatcatgaaaacagatcttttaagtttggtccttaatttcttgtcctttttattttaggcactttataatcagtatttacagtttaaagaaacagaaattccaccaaaggagacagaaaaatcaaaaattaaacgtctatataaattattagaggtaagctcaaatttgctttgtattgtcaagcatagtctttgttttgttttgttttcatttttgcttcacattaaagttttttgttttctcaagatttggatagaatttggacgcatcaagctccttcaaggttatcatccaaatgacatagaaaaagagtgggggaaactcattattgccatgctagagagagagaaggcccttcgtccagaagtagaaaggtaggccagaggtgttttctgccatgaatatcaagtggggagggggcctttgtgttcttgtgaaagaacttaagttaaacctctgtttacttggccttggataagtctcttaatccttttgatcctccattttcttacctagaaactcttctaagagattttaaggaggcaatcagtgaagtaatgtatataaatgaccggctaggctggattggtatgtgaagtctcatctaataaggctttacagttttaaaaccagtcaaaattacttgtaatttctcatattgaccttaagtcaccagggcctggatctaaaagcttataggacaacagctgattttatttcttattacatttttttgctatagttctctttccaaggggcattggaaaccaaaatctagcttgccttcatttaaagggtgttggatggcgtctagaacacactcagtaaatgttagttcaggttccctttctgccacgcttctacaagtggatttac

SEQ ID NO: 121271 - DNA, 1048 bp, Homo sapiens
caggaagcatcttttgtgcaggaagaggtacacagtatttcaccatgaatttgaaaatacatgtctgacttccagtataagtgaattcatggtttagtaaaacatttgctaatactgaaaaacttagggcaagcttttgaggcaaagacattgcagatataaaagccattataggccgggtgcggtgggtcacacccgtaatcccagcactttgggaggccaagatgggtggatcacctgaggtcaggagtttgagaccagcctggctaacatggtgaaaccccatctctattaaaaatacaaaaatcagcctggcgtggtggcacacacttgtaatcccagttactcaggaggctgaggcaggagaatcgcttgaacctgggaggtggaggttgcagtaagccgagatcgcatcactgcactccatcctgggcgagagagcaagactccgtctcaaaaaaaaaaaaaaacattacaaaaagccattacaaatatgtaaacttattaaagagtaagttgtctcatttgtatatttggttttataatagcaaagtggtctactttatttctagaagctgataatgcgaatattgccgacaaagccttaattctttggtttgtaagctttattttcatgatcaaactgggatagaaaaaactgtaataacctagggtgagctccattagagttattcattgtgctcctgcatccgtacagaatatctgtagaacagctttcattctcattgccacggggagtttgtccttggcacgaaattacttggcatctgatgatatgatactttttaagtgttctcaagctgtttgtgtgatgtttccctacatggacatgtaattttccagggcaggaaaacttttccctacaacgaccatgtggtgccatgaacagtgtttagcacacaggagtattcggtgcttaatgaccaacagacgtcctgaaacattgcattctgatttcaaaaccattttcagatttcatgttcaaatacacttatttccaaatggatttccattgtccagacccttg

SEQ ID NO: 121272 - DNA, 3440 bp, Homo sapiens
tgactaggattatagaagacaaagatgatgtgaaagggtatggtgcaatggggaggccatggacacagcactgaattaagctacaagctttttgtcttagaggaaaaacattgacaggatgctggttggattggaaagatgctgttggagtagcgtagcttaaatcagttgaataggacaaatactcatatatattctgactatgatatatttgtagactttgttgaaatttatatatgttcaaattgttatattttcattgttatatttgctttcgatacagaagtttctgagataagtgagcaatgttaaatgtttgatgaaagtctctgcattttaacgcaggcttggtgttaatattagcagatgttgttatgtaaatggaaacctatataattatataatgttgaattggcacatgagaaaacctaattaacacagtgaattttttcctaggccggacctgatagatatgaatactgttgctgttcaaagcaaccttgcaaatttagagcatgctttttacgtagcagaaaaaattggtgttataagacttctggaccctgaaggtgagttattttcttgattatatgtggactggcatgaaagtctgatcaaaagtaatttatcaacattgtgaaataattaatttatgttgctgtttttagatgtcgatgtctcctcacctgatgaaaaatcagtaataacttacgtgtcatctctctatgatgcatttcctaaagtccctgaaggtggggaaggcattggtgcaaatgtgagtattgatttttccacaccggaagctgttgattcagtaatgaccaattgactgcatttattgataatgatttttgcagtttttgaatgttgaatatattttaaagaatttgagttaatatgctgtttgatgaattgatattctatgtatttcatgacattattctaccattaaatttaaagtataactcattaaaacttttgtgtcataaataaaagaggctatttatagttaccgatcatcttataaataaaaggtttaactttctgaaatttagagttttccatttttagctggctgccgttttacattgctgtatttgctattcttttgtatgtatagaatatctcagttttgaaaacaatttcaaatttgttacttcatacgattctatgaaataagttggcttgataacatttttgtgatttaaaggaggactccagaggaaaattattggatttggccaaattagcagagccacttagtaagcagggaaaggtctctgacacatagctttgggctgtttattagtctactatttcttaaaggtttgtgtaactcacttcagtgatgctttttttttttttttttttttttgggtggttatgctaacaagtgcttatgcatttctgaagagaacaggaagcccagtatgtgtcacatatttggggatgatccccttcacttggatttctgccttcctctttgcagacaccttttttcccctacattactttgaagatttaggagctcatctttgattagctcccctggattaggagctcccttttctgattgcttctgtcagttctctgtgctgtttctagacctgtttccatattcttcctcaggttcttcttttcaaaggcttcatgctctttgatccctgagtagcctgttcccatgctcacccctgatgattcaatgttgagcgttgcttcagaatgtttctttggccatctcttgctgctgcttctcccaaccttcatgctgatcctgctgcctattactgcagaactaggccgatagctttcctacagctttctgtctccattttgttcttcttcccactgcctcggcacactgttgccaaattaatctgtctaaaacctgatgtctttggcttgaaaattttcagtgtctacatattccttgcaaagttaaatgcaatctagatattctgacatttaaaactgcaaatatttattctgtttacctacatgttttagctatgatttcccaatatgaactgtttactggtagccaggacatttccatgtcaatgtcctgactcacttgggactccccttttatccactctttcagcacccccactcacctccccccatcaataattacttactggtcattgcagaacatctcagatactgcctttcccaagaagcctttagaaactattttaaggcacagatatgcttgcctgattcttatctcaactagcatgtactacccgttttagttatttcaacatttcaacacttaattaaatactgctcttcattttgcctgtttatattatgtatctctcttgcctctgcatttagacagtaactccttgacaataggtattatatcttaaagtatttttttattataacactcaacacaacctttgaacataataataagcactcatcaaatacttaaacagagcagttggcagccttccaagtttcctccatttttaaagagtttgcctactgagtacttggataatcccaccatatacatttcctgtagtttgtgtacatatctggtttcctatatattgggtaagtcttttgagtttgagatacatagtagatttagatctaaaatagttggcaaagatggcaactaacttggcttatgcaagttgttactgcccaatcttgagccctggtaaacaccccaaattgactttggatttttttctgctgtgcttagattgagccccaaaagccttctaaatacaataccccaggcagccactttctttggatcagaattggcactcataaggctagtgttagtggccaaatgttgatagcaaattttacaggtgtttatgtgacagggattggggctgggtgaaagtaagaaaacatttagctggttctgtctgtcaggcttcaaatacatacatttacagaatgacttctgactaaattgtcttagatatgaatgttattatctacagatgtgaaccttttctatcatttgattgttctaggatgttgaagtcaaatggattgaataccagaatatggtgaactacctcatccaatggattagacaccatgtgaccacaatgtctgagagaacatttcctaataatcctgtagaactgaaggttagtgtcactgtagaaattacataggattgattcaattgtaaacccttaagtaatgctataataattctgtaattttagaagttcaacaaaagttgcccttggaaagccattaataagtaggcaaaatttgtattactcatttctcttattatacagagaaaatggaggtaaaacattaacaattaaaacagattagctgtagtcactcagctttggttgagaggttaaaggtttaatttgagagagtctctgaaactgacattgtcagattgattttagtacatgggaaatgcttgcagcccccga

SEQ ID NO: 121273 - DNA, 1087 bp, Homo sapiens
cattttttgtttaactaattttctttatctgctgtcttttagtggaggaaaaccatttcagtttttgttccattaaagtgttaaacatcatgataaaagagatgacttactcagactcattgtattctacagctgcttttgtgttgaaatgactatgtcattctgaaggaagttttatgttttattctcttagctgaaaaacttgattcttcaatgactttattcattccctctaggattactcagtgtttactttctttgctaatggcagggttctcataataacatgccatgtcttgttctgagatttggcagacttacaaagtctgttttttatttccctaaaaggtgcaaattttacggaaacaaaacgattttttattgaaagaacttcagatatttgtttttgtctagactgctatacatacctgtttactaatcttgaggttggcagattcttcagatgtttctatgtgaataaaaaatgttacttttggaggtctgttatttacttccatagttgtcaatggatttattgttcctataataattgtagggtcacttttaaaagagtggtcatattggtggcaggttgaaaacattaaaggatttcctaataatttcctggaatatgagcatgtaggtgatggtaaccacattcccaggttatgaacagtgcaaagtgatataaaagtataagattttcttgaaaggtctgttttctcaccataaaagagtacaaattgccacttagctttctaatattaatgatatattttcaaacagcttttcatataagcagcctgccaagtagtatacaaaataatctgcatttcatttctcccacactacctttgagccctcccactctttctgtggtttcccaaatgattattttgagcaaacaggaatgcttgtggagcttgtagagagcctttctttgtaagctatcaacaggttcttactcagtgatttttttgggtggtgagtaccactctttgaaggctttcctgtttccacattgttccggtagtctttcaatgctttgtttttgagatccaagtttcctgactggcttctagccttg

SEQ ID NO: 121274 - DNA, 1002 bp, Homo sapiens
tgcccaaatatgagcatgaagggatgtctacactgagttacgcaggcctttttttttttttctttttttttttttggtgattgcaaggtgaggtgctttttgcaccaataagaacagtaaggacatgctaagtctgagcatgatttaatcgaaacagtcatcttcaggaatttgttacggtaacttctctgctatcataggataagtgaggcatatgatcttttgaaaagcagatgttaagtggcatatgtgtcttcagtcacctctgtgtgggttgttctgtagtatagagggtgttctaaaaatgatctttaggaatggagtgaggcttgtttttgtttttgttttgttttacacttccacacaatcccttttcaattccttgcaaactgctgagtatgtactattttgccagcaaaggctgagcctgtatgaacccagccatgtgctttgtctgtgcatgtccccacacaggaagcacaccagagaaagcgatacttcagggtagattgatttcattagaacttcattatcaccagcctcaaatggttctggccagcagtctttttctatctgtatgattaacccttctcttcctcacagcacctcctcccaccaccttttctcagtgttaacaggtgatctagactcctactctcagagaaaattgaagccaacaagtagaaagtcttttttgctaccaaagacacaaacctatcttcttctgcatccatcctcacccccgctgctgctgttcaacacaggagtcctctctccacctacccaaagcctgtcccctcctgctgtgccctggatcttatctctgtcattgccttagaaacctttcttgtatatattcatctttttccttcaatagatctttcttattggattttaagcatgttgcagcctcttctgttaataaaacaacaatcaacaaaaacactctcccttaactgcatgctttattccagctactaccttatatcattcctttccttc

SEQ ID NO: 121275 - DNA, 1912 bp, Homo sapiens
tgcctcagcctcctgagtagttgggactacaggcatgacccccccgcccccatgcccaactaattttgttgtatttttagtagagacagggtttcaccattttggttgggctgttctcaaactcctgacctcaaatgatccacctgccttggcctcccaaagtgctgggattacaggcatcagccacctcgcccggccaaaaaagatctttatagatgtgatgtaaggtatagcccacattctcctacttccatttttgaagcagaaaactgaaaaagtgacacagccacggtaggaagatagctcatctggttgtcctcttcatgggagactggcaaacctagttgcaatttctacagcaggcacttgttaccacagtcctactttttcttgtatctgtgatttttaaaaaataccatatggtattctattgtatgtgtataacattttgtttagagtgccttattgatggatattatgttgttttttgcttttaaaactgttgtactgaactttgtatgtgtctttgtgaggcatgtgaatatatccataggataaggtcctggaagtggaattgctgggacaaagggtattacatttaaaattttgagacgtacttctgaattgtctgccaaaagagttgtactgatgcatacctcttctgcactgtttcccctccatgatgcctttgagaaagaaacacttcttaacttgttaattaccttttagcaggtctaagccccactcttttttttctattctttcttttactttgccctttcattcataaaattatttcttttcagcttttaaagatgtgcccgtgatgaaattgaaggcctatgtttcactcagtttgatgtgcaagctgttagtctaagcatgcatgtattacgagtttagggggaaaagtgacgaagtaagttgacaaatttcagtgatgtgatcatttaaaaagttagagggtcggccgggcgcggtgactcacacctgtaatcccagcactttgggaggccaaggcgggcggatcacccgaggtcaggagttcaagaccatcctggccaacatggagaaacggcggctctactaaaaatacaaaaagttagccaggcctggtggcaggtgcctgtaatcccagctactcaggaggctgaggcaggggaatcgcttgaacctgggaggcggaggttgcagtgagctgagatggcaccattgcactccagcctgggcaacaagagtgaaactcagcctcaaaaaaaaaaaaactgttagagtggggctgtcttgagttagcttatgagagtgcctatcactctcctagagatttaggaagtatgtaatcaacatgagtttcccctccccccgcatgctgccactgatccactaacaatagggctgtaaagcttgagggaagatgggttttgatcaaaactctccttacttagaaacttgacaagtcctgcctttgtcatgtttccctttagcattctcttacctttctctcacatgaagatttcttttacattacaggagcagccggtatatgtaactctatctgtttttctttgataggttcatctatttgttttaacacttcttgtattttgacttgattattcacattatcatcttagcctgtgatatgaagtagtttgagatttagttttctaccataataaaaataaattgattcccactaccccctttttggggagggtgtatttatccttattagtcactaaagtttacttaaattttccttttattcactaaaatataggtactggaggagttacttctctatcaacatcaataccattctctgtattcattaaaatttaggctgttaatgggattgattgttctttgtgaagtgagaaagtcataattcattagatatgttttaattatt

SEQ ID NO: 121276 - DNA, 1087 bp, Homo sapiens
aactagaggtgtgtgtgtttgaagagattatttctgcttactagtttctgcctgtcttatgcttgtttttaatttatctcattcatttatttaaattgcctttaaaaaataaaaataaaaaagctaaacataaataaataaataattttccttttaatgtccctggcagtcttttcataggtttgttttaaatatgttagccaattaagactcaaaattttgggaataggttgtatgcaggagcaaagcagtcaaatgttttctaattaagcagccaggaacttttcacttgtctgagtatgtagttggatagcaattattttgtccattgtttgcattttgaatgagaatataatagggccatcatatttcattatattaaagtttaaagatgctgtaattgtgaaggttagattgtaaagctgtggtcagagtcatcttgtttaatagcatgacctggaggccggtgattcagtcacatgcgtgaattcagtcacaccttagaagctaaactggattggactggtttaataccgggaggaggccctttagggtttgaaatgttcccataggaagttggcttagtgttgacttagccttcaggctgcagaatccagaggtatgagggtgtatgtatgtgtgtgcatacacatggccatgggctgtagtttggccacaagccagacacacacagagcctgaaagttatcaattaaaaagtagttaacagtatttcagcttgtgtagaaaaaatcaaattgcttatttaccttgccaagtgaactcaaaatgattgaactttgagaacagaaatggatgacttctaaccattatcacattttaaaattcttagagttaatgtacactgcttataatgtagtgcgtctgcatccaagtgaggtgtaagagttagtgtctacatctggtgaccatttttattgtatctatatggttttacctacagtttgggagatgtaatttggcatgtaatatttggaggaaatatctgaatatattactttctttttatgttcctggccttcttgcctagattaatttacagaaattctctgtaatatgaagcctcc

SEQ ID NO: 121277 - DNA, 1655 bp, Homo sapiens
ttattcaaacctatgagactaggaaccaggtctagaagcctgtctcatgactctggtcaagtgatattttccctgtgacagaatgatttgttcttcatatgccttgcttcccatctctgacttgctcattctgattctggcgtgcagcctgtcttgttgatcccttggctttgcgtcttgcactgattgagggaacagttgttggtggtgttaatctcagctttggaattactgtgtgacccctggtaaagtcactttgtgccttaatataattatcagcagattaagtaggacccttatcaaagagatgcttttgggagaatgtaaatcatggaaacttgtgacttgttttatcattattcagtggaagagacttttagaaaacttcatgaaaacaaaatacaggagaaaaaaatcagttgataaaggtttcaggttgagcaagccaagcaaggactcatgagaaaattagaacttctggccaaattgttatataggagagaatactatttctttcattgttctttacacagaatacctgttggatcaaattctgctctgcaggtggtagtatagagtaatttataggttttacctctgatctacttgaacttggaaaacacctccttaagttgtattaacaaatctgattaggaaagaagaacgtagaattttcaatactgtagagttttggtttagtaaaaagagaataaatgcttttaaattggacacaaatgagttaaatctgactttttcaatctgttgttaacctctttgaaactcagatttcctatatgtaaaatggataaaatttatttatttcctatatgtaaaatggggaaaatttataagggagaggtatgagggctaaataaaaataattatatagaatagctaatggtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagact

SEQ ID NO: 121278 - DNA, 1768 bp, Homo sapiens
gcaggagaatcctctagattgcttattgaaaaacaccttgcttgagatttaatttaatcagaatatcttctgtcatgagacagtattgtatatgttttaggcacctgctcgtgtgtttttaaaaacacaccagatttagagaatcagcatcaccttagcttagtatttgccatttcattttcttcttaatgtaggttttctgataagcaatgtggactacgggcctggcaggcagaagatcgaagttcttctagtcaggctttgccaccagacagctgcatgacttaggcagtcttctttatttctctaggtctcagtttcattttctataaaaggaggatactgtactagatcatgattctactgctaataataatgctatttgttgagtcctgctatattccaagcactccccaactacatttatcttcagagcaagtctctgaagtgttctgttatgagctccatctttatagatgaggaaactgagtctcaggaaagttaagtagcttactcaactcacttaacaatgagtggtacagctttgatctaacccaaaattgtctgccaggctgaactgttacctgaggcaatttaccctccttttcctacatacctcttttccagttttaaatttctgtgaattcatgtgcataagtgtatgcctttttgtttgtccagtgttattactcctctctctttccctctcttcctttatttctttatgaaacatttattatgtattgaacccaaactaggcactcagagataagtaaaacgtagctcttttccttgtgcattatatctcattgtttgttcataacaaatgacagggaccatggctgtaaagttagtcacctgagaattagtcacctggggtgatgatcaggaataagtttaacttctcagcaaaccatgtggtgactctattaagtaatgaaaattgaactgcatttctgttcctttccatcctttggtgaattgctaatgaatagtgcagtggcctaaagtaaagaagccgaagagagaaggttaagaaatgagtgtggctgttgtacacaatatattgtcagtctctgaataatgaagaattgaatatttttattaccttggcttttgtatttaaaaaactttgaaaaaaaattaagagctatctcagaatgtgagaggaattacattcaacctacctgaaatatatttattcattatttttttctctcaccaactcttttatgaagcttagactataaaatttatgattggaattcaaggaccaggataaaatctgaatgtgtttagccttgctccacagatcttgaagacgaaggtcattcattctataattgactaactcatttcttgctgaaccattttatctctttctttaaaaatgaacattcatattgatttctcttgactatttctagtcatttagatttcataaccagtttgtgaaaatatagttttagaataattgtatagaatttgggtccctatcatcatgatgcctttctctgccttttaagttaaatgaaggacatgcacagtttaaatccttggctttacaaaaaaaggtagcctttcccctctgtttgtataagtaaatgataatttgttcaaagtagttatcaatttagagcattagcacttggactttatcagctttttaattacttttgttctccatttcacccttcccttatataggcagtttgtaccagttaaaattttaaaaatgtttgtgctgtctttacagttaaaaatattt

SEQ ID NO: 121279 - DNA, 1037 bp, Homo sapiens
gttattttcatattagtgtatgtaaaagccatagagtttctgttgcgttttgttagtagcctcaggtttgattgttatgattttatttttgtgctgtgcacattctttgaccacactttaatctaaaaatcctgtacattttcattattggtggaagactttaaaaagcactacagtaagagagtgcatatcttttgaatttttctggttcatgattcttgactttgcctgtggaatagcctgtggaagcttagttggactgtaggtaaaagttcaattagaaatagtcatgagaagacaatagctttgtaacaaataataggatactgtaaaattatcagtcaataccgacttgctgattcatgagtttgaaaagccagattctggttctctgttgattttcatgtgcagaaacattcacataattgctgtcaattctgtgcatatgttttgagggctagggtacatcttttcctttatgttattccccagccccagtctaaaatcagaaattgttagggtagcatgccataggaatttgaaaatgacacagactactaggaagttgagatctttattcctaacactgatatttagctttagacaagttacttatctggggtttttacttgtctttaaaatataattagataggtatttatttaattgctcaaaaaatgtattatccacataacctctacatgttactactcaggagttgatggctttttctttaagctattcctaactttatcttttaataaaaaatctgaacataaagaatatttgtgatgttaaacattcttggcaaggtcattgtatcaatgagcagagatcatttgcataatgatagaatgaggttttatgagggttagtgtgcgccatcatcactgaccttggtttctgagttctcctgaaggtgtcctgtttatatacaccgctacaccttgccaatattatgccatcagttctgtttatattttacagtggttatattttaaaaagaaagcattcagtctgtgtcattatctatgtag

SEQ ID NO: 121280 - DNA, 1091 bp, Homo sapiens
acaatgcaggatctgttattgacaaacatctacagtatcattgctaacttgactaactgagtattcttacttagtaaaatataatgagttccatcttttgatcagtctaaagactacctagtgaaaggcaattattaatttttttagtagtgaaatgatttgtacttatgtgtaaatccatttcatgctattctaatttttttttttttttaccatatctatgactcagtgttagaaatatgcacaccttagataatcaagtctcatactgattcattatttttccagcaaggccctcataaaaactgtataatatttaactagggtatgattataaaagttacatataaagtttaactacatatatatatatgtatatatatatatatgaatgcacatatatttccttttgctaaatctttcatgctttaaattatataatttatctatttggtatcacattaaagtcctaataattagataaggtcatggcttggaaatttatattatttgaaaagtattataaactattttaaaagattgattttttttagaaacaattttattagagaattataagcatttagcacttatctctcctgctagctattgaatcagcttattattttttatgacttgttttgaataagagtcttaataaaatttacagagatctttgagcttttgatgtgtttgtgtgcaagtaccaaaattagttggtatttcttaagaaaaaaaaatatatggtagagggtagagagtctctgaaattcaatttgaaaggcactttgaatccaaatttgaagggcactttcctaaatctctcctgactggtgtttgctttctttttgctctcattcgttgaaccaccaaatagtttcaaaggttaagtgcaaacttcattagtgtatctgcatttcagaaaaccgaaggttaaaaacagtcataatcttctcatacagtgaagctaagggtttgccttgagagctcatcagtgttgtaatttgacagtgagcagtaatgtttgtctaagaggattggtggccagaaataagccacagtgtctaatgagacacggaccggctgggcag

SEQ ID NO: 121281 - DNA, 2065 bp, Homo sapiens
tggctggtgggaggagtgggggttgtttcagcatgaaactgtttcacctcggatcatcaggcattagatttttataaggagtgcgtgcgcaacctagatccctcaaatgcacagttcacaaatagggttcacacccctataggaatctaatgcagtggctgatctgacaggaggtggagctcaggtggtaatgcttcctgggccgctgctaacctgctgccatgcagcccagtccctatggtataggtttgggggttaggttggggatccctgctgtggaagacaagaatgcaataatacttgctctttctttgttgttaccatatgatttgtaatataaaatgattgagaataagggtaaaacaatatttagttgactactggtgtttaaattattccattttttctttgtataattttagaattgcttttatgtaggtaaagataactggttcaggtttgataaacagttggttttatctcttcttcacattcaaaacaggtgaaattagtgaatattagaaatgatgacataacagatggaaatcccaaattgactttgggattaatctggacaataattttgcactttcaggtaagcccaaattttcttaatttcagcatctaattgctagttttcaggtggttcctatgaagggtgaatgatgcattcatgttctatggaagaaaaataaatttcaagcttctttctttaagtaatatatttgaattgttcttttaagcaacatgctgcttgtgaatctggcaactagtttcctgttcttgataaacttaaatgtagttttaaagacaatgtctgttatctcagagttggaagacatatttctttttattgactggagacacactttttttgctcattagaaagtattacctgttttagatacttaaatgttttatgattagtccttatttagaatgttttttagtaatacaggttcttagcactgtcaactatttcctcctttgatagacactagatggcagcataattataaagagatgtgaagaagaaaagtattcatgttttatgcagagctgtgctttctctctttagatttgaggaaaatgcaaatttattgactgaattattatctaataaacctgagccaattgaggaccgattttgatttagttttggggaagtgatacattaaaaagaatcttcatttgatttaaggagattcctaactttagaacttgctttagtttactaactgctggtctgcttaagaaatgttctgctactagaggtgggaaggagggggaaaagggcatgggctgaaaaactacctattgggtactgtgctcactatctgggtgatgggatcatctgtaccccaaacctcaacatcacgcaatatacccatgtaacaaatccgcacttgtaccccctgaatctaaaataaaagtttaaattataaaaaagacccagaaatgttctgtgtgcagcacagagcctgacccacagtaggcactcagtacatcttaccaatagattactgtacagttggatcttgaaggaggaagtgatcctttgccagcttcaaaaaggacctggggttttgaaacaaatctggtgaggaataagacttttttaaaggctgggcgcggtggctcacgcctgtaatcccaacactttgggaggctgaggcgagtggatcatgaggtcaggagatcaagaccatcctagctaacgggtgaaaccccgtctctactaagaaatacaaaaaattagccaggtgtggtggcatgcacctgtagtcccagctactcgggaggctgaggtgggagaatcgcttgaacctgggaggcagaggttgcagtgagctgagattgcgccactgcactccagcctgggcaacagagcgagactctgtctcaaaaaaaaaaaaaattttttttttttaagttggctgaaatacaggttacgtagacaaatggtggagaataatgtacctggggggcttgttgggaacaggatagatttgacaggtatggagagctacaggaatcagagtctaggtaggtctaggacctgaac

SEQ ID NO: 121282 - DNA, 1044 bp, Homo sapiens
tcattaatatgccatatgtatatatatatgtgtgtgtgtgtgtgtgtgtgtatatacagttataaaaaccctcttgctaatagtgttcaataagaaggtaaaatgatgaatgatatttaattatttttgtgcctccatagctaaataattgtaggctagcgttgttttattaccaaatattaagtgtctgtatattctgtaacatcttctcttttccttttgtttaaacaaaaaatttgtcataaagtatatgtttaaataaaacatacttggaaaaaaatccctagtagtttacattcaatctcagacaatataaagaaattgaaaccttcttagaaaatcttatggccttacctaaacggtaaatactgttttgatatattaagatgaacagaaattatatttaaattagcatggtctgtgataacagaaactctttttcatacctgcatttttctgttcttagcccagagaaaaaggtcggatgcgttttcacagactacagaatgtacaaattgcacttgactatttgaaaagacgccaggtatgatgttttgaaaatactgtaatcatataaatatatgttactaatacatccacgtagaaacatgtcaaggaatgacaaggttaaatttgcctgtgaattgtaaccagtaagcttgtgctttggtgaagcaaatatttaaaaatgtttttaaacatttgctcccaagaaaagaagttaatagtagggataagcccagaggaattataagtgactacatttccatctatgtaagaacttgtgattttctttctgtttgaattggattgcatttgcctaggaagttaatgacattttagtagcaatagaatgttaagaatgcctatgaacagttcttaattgtggggaagcaatacttcattttttacacttagtatataaaaatagttaatttttataaaaatactttatataatacttttaatttagtataagcatttttcatagtagggataaggaaatcttttgtttttataagtagataatattggaaaatttat

SEQ ID NO: 121283 - DNA, 1048 bp, Homo sapiens
attggcggttagtatagtcatctgtgaaggaaagttaccaggcccaatgcctatgactcactcctagggtaaaataaaagcttttctatgtaggcttagctgtctactttcccttcttttctttcccttaaatttcttgctcgatcagattggaaccccaattctttcccctcagttcattcccgaccaccctttacccataatgttgatttttaatttttaatagcatcctcttttattccactcatttgtgctgaggaaactgactcagtattataaagtacttagcacaaggttaggcatctagtagtaactcatggtgtgtgtgtttttgtttattattgttagtgacatttgcttttcggaaaatgatatcttatattttgtaggatgttttccatatacagtatttctgtggaccctcagaatagtcagctgagacaggaaaagcaggcagtattggggatagccagtgtctttggatttttttcaagcattatagaagttaaattagtttatttctgcattttcttctaaaattcttaaaaaattaagccataagtcttaagagtagcttttattttatacattttctaagttgacaggtcattgattttttaaaatgataataatttgatttaaagattacagactttttgttctctaggttgaactaggagttttctgttttccaacctttattttaaagataaaaaaaaccctgaagcctagagagtttaggctgttggtacaaattcataaggccaagggcagaagcaggactaaaatgtcttttcccttatcacaggttttctcttttcctaatttagagggagtctcactcttttgcccaggctggagtgcagtggcatgatcacagctcactgccaccatgcccagctaactttttgtatttttagtagagatggggttttaccatcttagccaggttggtcttaaactcctgacctcatgatccacccacctcggcctcccaaagtgctaggattacaggcgtgagccaccacacccggccatcttttcctag

SEQ ID NO: 121284 - DNA, 1501 bp, Homo sapiens
gagctattgtcctagttaatgggttttaatattatcctttcttttacctcatagtttgttattgttcccaaatgtcttaaacatctaactttaattttatgttaacttaaaaaacttaagaaacacacttaaggacactttgattttactgagcagtatatataatagagcagttttaacatgtcttccaggttgctaaatagaattcaaatttaatttctgattaatactttcttgctgaattttaaaattaattttccagtgttgagaagattaaataaaaacatgttttttggaagggaaacagcagttttcaaatcaggttcccaggaacaccggtgttgtgggataccctgggttgggggagcagcggaggaaggtttcatttgccaaagagattggaaagtagcattttctggttgaagagatttatggtacacattagcatactaaaaagagaaaaattctgtgggagagaaccctgtttaatccaatgtttcctaattcatttggtcttggaatcttttgtcaaagagtatctattaatctccctttgggaaatcctgcagtagagttttaaagtgagtgctttcaagcaaatttaattaatattgtattaatttgagttacagatctggatggggcctagttaatttggtggtcattgcagaaatgttttctcacagcccttcttttttaaattttttttgaaacagagtttggctctttttgcccaggttggagtgcagtggtgtgatcttggctcatcataacctctgcctcccggggttaagcgattctcctgcctcagcctcccgagtagctgggattacaagcatgcaccaacacgcccggctaattttgtatttttagtagagacagggtttcaccatgttgttcaggctggtctcgaaccactgacctcaggtggtctgcctgcctcagcctcccaaagtgctgggattacaggcgtaagccaccacgcccagccctcacagcccttcttataggtcaattattttctaatttatggatgacttacccttttggttctcttgaattataactgagctatttctttaattgtctaaaattctcataccctaacttccacctacttatcttgggccagccccccagaatgatataaaatgtatatggcagctcttgaatacctgaagaaactattttgtcctccttcaccacgtttttcttttaacttgtcaaccagatagttccatttcctttattttattctcatgtgataagattttctatcatacatttctaacatattctctttcagtttttatatttgaaatttttaaggctactgagttgaagacagaaaatgagttgaaggaaagtctgccatgtaatcagagctatacaatgccagagcatgcacagaagttacctatgttatgatctcaactatgtttatattatcttctacctttcacctccctgcctttgtacatgttcagctatttacttacct

SEQ ID NO: 121285 - DNA, 1034 bp, Homo sapiens
acaactttaattttcacagctttaaactgaggacagtactacccaactcagaattattgtgaaatccaaatgaaaatgtatccataaggcatacataaagaaatacccaaaagtggttttctcccagaaggatgtatgtctagcctataaaggtgatccttccaaatcatgttactagcacacatatcagggataagttaaacaagttaggctggattttttttatttttattgcagggaaattctgcctggggtgttagaagagagaatgtgatgagttagttcagctgtgaaatctaacatcctattggttcgcctcattgcaaaacaaaaaaagggaattaaaactttttttaaaggacttcttaagaacaactttaaaatgaaaagaagaaatagacaatttggtttctttttagtaacagttgtatatatcccctacaaaaatagtagaggagtctggctttgttaatatttgtttaaaaggaggtgttgactagttttcagcttgcaagtaggagtgtctagtcagtgttttcttttctacatagaaagttaacaggactctgacacatcagagtttgtacggagagagtttagggaactgctgcacagatttcctgcagaatgatggggcagctcatgaaaaatgatcaagattggaacgcaaagctggtgggactgatgtgctgtatgggttagtagtatcacatatactatcactttcatgttttcagaactgggaagggaaagttgcactacctgctttggtttgcatggcgatagttcagctgattgtcgggcatctttcgaaaacctgtactgaaatcaggacaacttctgaggctccctggagagaactcccctgcctattgttgtccacagaatatgtatttatataatctcaatacttactgcgtgtgtggtactgagtgagtttagctttgtttggatttcactgaaaaccagtcaatatagattgtaataatcagtactctttttgcatttatttgttcccccccaattctgttatt

SEQ ID NO: 121286 - DNA, 1015 bp, Homo sapiens
cataaaatttcaaagaaacttgaaaaactgtatttattccttataatttgttgattttatttttatctgagttactggaggtcctgctttaataaattttgaaggtatcttgtatgaatttgatttttaaagtgaaaactgttctgtttatgtccttacatatatgtagtgattataaaagttttcaaaactgaatactttaaaacaccaaattacttaaggtcttcataatataatggatttaccttacatataaataatgtagaaatgatgcttattgaatttattttcatcgagttacatatctctgtgctttggggtatattcttatctagagctctgaatctagaaagaaaggctgatagtgaaaaccttttaaaaaagtctaatttcttaaggttagcatgttacagattaagagttgcagaagctttctgtccttaaacagtgactcagatcagcagaagttagattatatataatacttaaatgttatagcagtataactataattaggaatctctttatatgtttttaggatgctcaggtaggagaaggtagattctaggagttttatattcaattcttagccaattgtgagaacagataccagtaaattccttgtcagagcagaacctgatcccctagatcccagccaacaataagattgaacctcagctgctcagcaactgcacttacaggaaggcaggagatctgatgactgggagagcagatagtggtagaggaggagatacacaaaaaagcatttgtatggagagatttatggcatttgtagtttacatctcagcttacctagcacattctaccattctactcttgtcctgtgtctggattcatgacaaatgctgacaaaaccatttgttttgttctgtggcaattaaactttgaacaaggagactcttcacgcagtataatttctgactatattctcagtaactgattctcctttcagagacctcctgtgccttcactgttttgtatctcagactgggca

SEQ ID NO: 121287 - DNA, 1077 bp, Homo sapiens
gtatggctagcaaggctatgtgtcttgctgaataatcctattttataaaccagaaatggttattcctgtctttttatagaatttctataatctcttttttaggctgataaacacttcatgccaaaaggcaaaagagaaaatgggaataaatttcaaaatattattttataatacttgccttaaagtctaccaaaatttttgtcttcttaaactttacatcatcaaagtcagtctctgagctagtagtgtttagcaagaataggggatttggtaatctgaagacctgtgatcaagccttgattacgagatcagtgataaggataagctgctctcattgagtagtacctcagtttcttcatctttaaatgtaagtatctgccttacttacagagtatatgtgaatgtaaagtggggtaattacatgaaagtattctgccaatgcagtgtgattttattaatactagtttccttgtctcacattatgctcatttccatttgtgtatttctgctactgctacctacaattgtcttcttaaattttacataatcaaagtcagtctctgagcttctagctacccacaactgtgcaactcctgtacaactcctcctgcgtgcccacaggtctgttacaagtactcagggttacactggtaactcttctctcagtccctattctgcatgtagtcaaccggtttcctatttagtgtctaatgtcttgttttttttttttttattttcttcattagatttgaaatgacttgatggcaaggaatatatactttatatatgttttatacatttcatacattttctggtattttttatagtcctggaatgtacttcggagctgaaaaaaatagacattacttggtattactataagctagtgaaatagaagggataatccaattatattttctttataatcctgttgtttatctcattcctttctgattctgaagagtacctaacttctgaataacttatactaactgaaattattcaggacttatgaactaaagaacatatgtttaatttaaatactttatccatatctagttttgactgttagaaaat

SEQ ID NO: 121288 - DNA, 1068 bp, Homo sapiens
ttgctattaaattatttgcctctaggtacatatttcaaagttagatatgtgtctttgaatatatttagaaatgttcagacttgtgcaattttcttttaaatttgtgttctctcaaagttattttcttttttgcttttgggggacatggaagaaccaaaatatcctttatatgcttttattttttgagtgggtataaggagatagaaatcctattatttgttaatttaaaaaataaaaggattttgacatatgcagtgcatactctatggttggaccacaaaatgattctgtgaaactattagattcttcaaggactcactttgcttagaggacaagaatggcaggtggaaggagtgctctttgccttgcctagagtgtagtgtctttgatggggagtagctgtttaatgagaggctttaggacacatccagtcagattcacacgcgcctctggaactctttgttttcaggctgcagttccttggctgtgtcagcatctttattgtctgagctcagaaaccccttagtgcaccaaaccaggaagggaaactggcagcatgcaaatgactgacaaagggattgtaatatattagaggtctctgatagtcattaaaaattttgaatggaaaaaaatatgccagcagttaataatatcaaataaattaaaactacaaagtcattcctgtagctgtaaaattagtttcttgagatagacgtttttgctacttgtggtttttgatttatttatttatttattgggatggagtctctcactctgtcacccaggctggagtgcagtggtgcaatcatggctcactgcaacctctgcctccccgattaaagcaattctccttcctcagcctcctgagtagctgggactacaggcatgtgccaccatgcctggctaattttttttgtctttttaatagagacagggtttcaccatgttggccaggctctccaactcctgacctcaagtgatccgcccacttcggcctcccagagtgctgggattacaggcgtgagccactgcgcctgggctgatttatttttaaatattggggtacat

SEQ ID NO: 121289 - DNA, 1878 bp, Homo sapiens
cctggggcacagataaccatcactccggggttgctgtttgcctctttctgtgtgagatccctttctgctggatcctgtggtctcaagacttgattacaaccttgttttgacaaactgtcttctctagtagtaccatgaggaaagatgcatggaagagaaattttgtgtgtcctggaaaaattttttattggtgctcttgcacttaattggtactatctagattggaaataatttttcctttagaattttgaaagcgctgattgatctgttgtcttctgggctttcattattgctattacaaaatctcaagatcatcctcccttctctctccctcccccactctttcttgacattataggattgtgattcttaaccctggcttcactttagaattatctggggactttgaccaaatcctggtatgagagattttgaagtaattggtctggagtggagcccaaacatagatatttctgaaaagctccctaggtaattctaagatgtagccagagttgagaactactgttttagtgtcttttctttgtctctcattgctgaaatttcttgatgatatgctatgatgtaggtccctttccatccgttgtgttaggtacttgattgttccattaatctggaagtttatgttaattttggtaattaaaaattttattttctcccgttcttctgatctattattttaaaaatcttgttatttgtagttcctctgcttgtctctctgattttctgtaactttttccttttgtttacagagtgatttcctcagtttgatcttccatccctttcactgagttttccttttctgtaatcctattttaatttttctgagaattcatttttttgtactctaattattctgcttttatggactcctgtttgtatttaaggatgcagtatcttccctcctttctaaggatattaataattttttgttaactttttatctcccttccttgctctgtttcctctaaattactttttgaaaatctgttacttgttttggcctcctggtttttcctataaggggctttgctcagaagccttccttggctatgtacctatttatgtttaaaagctaattatggactcgctatctgtgtggtggacttctcaaccttagcctttaccataggatctggctgggtcattgcagtgggggaactcctgggatcagaatcttgggatcttttctcttgggctggtcatattccttagagagtactcttttcaactccacttttggaagctgatttggcagaagatggctggaggatgacttttaggatgtgaaggcatgcttaatttgcctttctcatttatgtctcttgtcatgctgattagagcccctgtctctttgactctctccagagaataaacctccagcctcctgggggttgggcaagggagaggaatctctgtcttagacttgtcctttctgtgtcaaggcccaccccaccccagctttcatggctacctgctgctatccttttctggtgaggtttttgtggggtttcaaggtatgaatcagattgcttctctcagctttcctggctgctggcttagtggtcacctctctgttgagtcaggtacaacttgttcttgggttttccagctaccaaatgcccttgttcttctcaactccttttcctttctccttgttggtaagtatgtaccctaaacacagattccattactgtcaacgtaatgtgttttcaggagagagtggaggtaagctaaaggtcatctactctgtataatcagaactgaataatatgattgtggtaaatgaaaaataaagagatggtaaaaggcttcagattgtcataatgattctattttgcatgtcagctctgaggttca

SEQ ID NO: 121290 - DNA, 1057 bp, Homo sapiens
tagtttctctcttaataattattatgtggacggctgggtgtggtggctcacgcctgtaatcccagcactttgggaggctgaggtgggccaatcacctgaggtcaggcattcaagaccagcctggccaacatgtccaaacccctcctgtactaaaaatacaaaaattagccaggtgtggtggcacatgcctgtaatcccagctcctcgggaggctgagtcaggagaatcgcttgaacccgggaggtggaggttgcagtgagctgagatcataccatcgcgctccggcctgggtgacagagcaagactccatctcaaaaaaaaaaaaaaaaaaaattattgtgtgacttgtattagtaagattagaacattaaatacattttatattatcacttctttagacttacattgtgatttttttccttggggcttctcaaacattatatgtaagtcctttatgaacatgtcgagtctttgggttctccatgtagttataaagatgaagttacatatttggcgggttggggtggggaagagaattttaattctctctggacattttataagagaagacattttagatccttgactagcttgtgaataatatgtattaagcaaatatacactcccagtatgaaaacagtttatagggccttttcatattattatcttattagatattctcagatagcggtatttcctcattctacagcaaacagacctgagaatcagagaagttaaatgttttggttaaatttatacaaatgaccgtgcttaaacaagtatctcctgagtgtaagtgaaaaacagcctttgagactggggagatacgacaattaaatgcattgtcgtcctggatgagatcctaaaacaaaaagaggatattaatgaaaaactgatgaaatccatataaaatctggagtttatgttttaaaaaatgtggcaaaggttaaaaattctttggggcaacataatgtaaaaagtttgaagacaaccgaacagattaaaattttgcacatgtgtgagtagataggaggtttttttttttttttttttttct

SEQ ID NO: 121291 - DNA, 1064 bp, Homo sapiens
ttgttttttttcatattttgcagtctccttaacatttaagaaactgaaggtgtatttaatcaatagtgtcactatgatagatattaagaaagaaaaaaacaacgccgatggaaaactaagcaaagttaccaagtaagattgcagcataaattttaaaagtgatttcccaaggaataggctatatccagacacttggctaatattattgcccttgttctacagttaatggtaggtacgctgtagtattttaggagcacagggttttacagttttggttctgccagttaacctaagattgactttcctcacctgcaaaatatggataacatccacttccctgatttttgtgagaatcaaatgggatgatttatgtaaagcatttagctcaatgcttaacacattaaaaacagcccccaaatggcagctattattgcagattttcatctcagctacagtattttggattatttgtcagtactgtactatcttttaatgtatgatattctttctgtgttctgggccttcttaaagtataatgatttcccttttctcgaattgaatttgaccttttcaaaagtctggaatttactgaagacaaagaattatccagtgctttatgaatggggatgtttatattggtttggctggcttccaggtggcaaacaacattcaaaagcagacataaatttttcccttccaagaggccacatggtgctcctttcctgcatcaggctcccatggatatcaatgggtgtaatgtgtgtaaagcaagggaaaggtcttgctactaaaaagtagggcactgtgctatatcagataaattagtacgttcccatgagctcatgctttgtcctaaaagatgtctttgtcttaatgtcctgttagagtctagctggcagttaggagtcaatatttgatataattctcagtggttgaatcctactaggatgttcatagtttgtgtatatatgtatatatatatacatgtataaaactagtagtattaaagcccaaacaaaaatatttattaaaatcttacatgctacactttgttaaagtgttat

SEQ ID NO: 121292 - DNA, 1001 bp, Homo sapiens
atgatactagtacctgcctgttttgaggattaatttaagttacactcttagaatggtgccagtaggcacatggtagataataaatgttagcagcttattgtagttctttgaaaagtgacatcccatgcttgtcttattcaataaaaatcatttaaccaaattgatagtttaaccagttgttttgctctttaatcattctgcttaactaggaaatactgaaggtgtttttttttgtttgtttttaatgtgaatctgttcgtttttacttaagagctggtataactactgtagtagttcagggatagtattttgactccatggtgatattaacttcaaatttcagttaatagtaagttcagttttattttttaagataacatggaaattttgtcttccaatagtgaatgtgattttccaaagaccttgtattttaccttgtttctatataaactaactcagtcataaggaaggtatttgatttgctgacacccacataggaaatcaaaactcttggctgcctcgtttgtttccccagtcccagatgattcagtttctttagaaactgcatgatgcacatgatttatgaattatttatcaacttagcttgagaactctgtcagttgtttagaccttgttttacagacaaaagtaatctgagtaattttaatgaataaatgatgatttgtagaatatatatttatttaaatgtttaaaattaaatataaaattaaaaatatggaaatgatctttatataatcagaacactcacaattttgtaccctaaatgaaatttaatgaaaaatttagaattaaaagggatataatttttacatcttgtaaagtgagttcaaaattagttaagcaacctcagcttgaaatgacagcttgaaatgacactatagtagcaaaacttgctgattctactttttatgaatcagtaatgggcgagaagtgttcttgtatgtaagggattactgataattattatcaacagaataaag

SEQ ID NO: 121293 - DNA, 1052 bp, Homo sapiens
tccttttacgtaattgttttggctagtctgttcctttatatttccatgtaaatttttaaatcagtttatcagtttctataaaaatgtttgccatgattttgattgtaattgtgttgagtctaaagatcagttgggaggctggatgcagtggctcacacctgtaatcacaacactttgggaagccaaggtgggtggatcgcttgagcccaggagttcaagaccaatctggacaacatggcaaaaccctgtctctacaaaaaacacacacctctagtccaggctacttgggaggctgacatggggggactgcttgagcctgggaagcggaggttgcagtgagctgagattgtgccactgcactccagcctgggggacagagcgagaccctgtctcaaaaaaaaggtcagtggggagaaattcacaagtatcaatattgagtcatttgatctatgaacgtagtatatatttagatctcctttaatttctctcagccatctttataggtatatagagctataggtatattatatagactcatatctgggttcaaatcatggctctgtcacttatggagtgaccttggtcaagtttcttagcttctgtgagcgtcatcttccttgtctataaaatagggataatatgtcattggttttgtctaagggttaagtgaattgatgtatgttaaaggcctaatgttatgcctggcaaaaagtttactgcacaatacaagttgttgtcattattatcatcattgtcatctttaccatcaagtaatgatggcctgttggatccacctctgccaaatagttattcttgcccagcaaccagatggttagtagcagctgctcagggctccctttatggtcagcatggctgatgaacactgccacacgcttgcttttagggcctctcttttctctactccacactaccattcattctccagctgtagctgtttacacattcttcctttggattatgttaataccattgattaggccacagctttccttgcatttagtccagtcttcctttgattttccaatattgct

SEQ ID NO: 121294 - DNA, 1383 bp, Homo sapiens
aataaagtaatactgataggtaaaaatgctatatttaaaattcctaaaaatttgcatatcaaaatttaagttgttcatataatttcttaggggaaaatgaagcagaaagaagtttatttaaaagttatacccttgtgattgaaaatctgtctaaaatatatcagtttcttttcttgttctagttcaaggtggtaaacataattaagctttattgagtatcttgccacagaatgaatcatgaatggttacgtttactatgattttatcaatgatctatgtggaaggtgggagattaaattaaatgtgtgcaggcatcagccaaaaatttattaaatattttaatgctttacattttttctttcaggtagaactatgagagatagtatattgcaggctctaatttctttggtttctaatgtttgactatataagaatataatcatcataagatggcaatattcattattaaatttaatttatgctaccactcaaatggttaggttgtgaaataagattgtttaatagtgtttgaaagatttgtatacccctgagactctagctagcaccctgactgatgccctgacagaaaaagatgattggagcattcagaagttatgcctcactcggggaggggcagttgagatttgttccctgataccagacccattccttgaatactttgtgactgatgagattgactttggagtgggagacagagaaagaatttggggtgcggtagtatcttggaggcttaagggagagcaccaagaagcagatcacagggcagaagagggatgagtgcctttcaagagaaggtggggaggtttgagaggagtgagtcaatagtgtagagtcctcacacaatcctgcctcccagctgttccctttgccatcagatgctgagtgatttgacattacagatgaccatggagggcagtgtgggtgatgaggaaggctgcaccgcactgtgggattcacattaggcagtccaatataaaccagacttacaccagactcatgcaacaaatttgcccactagccattattcacaaattactgaagttatcactgactgataaacacagaataccagcaggtgggaggaaatgttgtctagtttctattattagcttgtgctccatctgctgattataaaagtttcactggttcatttattttaacctctcaattgaatcttactgcaggaaaacaaattgtagaatacatcttactagttgtgggaaatcaaatttaatttgaatagcaaaaagtaaatagaatgatattttatgctgaatctaagtagccacatccgtagtcttctttattaaaggaatgttgggttagctcaattgtggataattttattattttcatttagga

SEQ ID NO: 121295 - DNA, 1090 bp, Homo sapiens
aatctactttcagggtcagctgtgcttgtttaactttagttgcactcctggtgtcctctgaaatggctcaagctctgaacttaggggaggcagaggtgctgggacttgggcttcagaggcatcttccatatctctttgtgaggatcatctttaaagggcatgtgcacagacctttcacccagttctaaaagcagagtatttctgtgatttaaaaattgcttgaattggtcataatcctttttggaaaaagatgacaaactcaagctagataaatacagtgcttaattaatttgctcagtgtagatatgatatactaaagctgtcctgccctataaaaataaagtggttataaatgcctcaaatttaaaatttgtgtttatacgtataccttggtgtgacaggcaactatgaataaaagaaaaacaagtcttatatatactgcacattataggaagctgtgtgcattggccttatttatagctccattttctattcataccctattctcctccctacttttccctttcaggctaatgtttctgtaaaactttctgcttgccagatactgttctaaatgctttatatatgttaaattaatctgcatagtgcagtaaacattataatttttattttatggatgaggaaatgggtgcacagagaggataagcgacttgcccacggccacaccgggattatagcgagtggcagagcggtgattctaacctcggctgtgtggctctgcagcctttgccccctcatgtctcacctacactgtgctgtctctgccaccgtcctgcctctcatttatcttgctgtaattttgtaagtgacttcaaatcatttttggaacatggtgggagtaccactgaacaaacagataaaagctttcagtgtatattttgcctctctttttgttcaataatattttgattcagcaattaaactttaaatatatcattagttatttttgacgaagtatacctctagagttacctttggagtcttctgccaaacatcttaagagtagagagttcattttcatttttcagggtttgcttttaatagttctgtggcgtggtgcaattaggct

SEQ ID NO: 121296 - DNA, 1475 bp, Homo sapiens
taagtcgtgaagttgcttttattaatagaactatttctattcttgttcatttaagaaaattataatattagatcagtaaggttacctgaagagacactagaaagggagatgccagagtgaaaagtagtagtccttgttagtttttttataagtatttttagtcctctctttttccctcctcattaaaaaaaaaatttaatttactttgtgtgtgtgtgtgtgtgtgtttaagtggcttaaagctacacccatttatctcactatttccatgggtcaagagtctgggcattccttggtaggtgagttctttgaccagggtttcacagaggctgcatttgtagttggtttttggaacattgtgaaattataatctagcagagactataaagatcttcaggagagaattttaaacataaatatgaacattattgctaacaagctgtactttatatatggtaggaatattctgaagagcatagaaaaagcaaaaaaaaaaaaatcagcctatttaaaatagctttctccttctacttagaatatatttacgaacataggaaatttgaaattaagggaaacatagaccaacccgactgcgaactttgaggcttgttgagtgtctcctgctaactactgccacctcagtcctgcacgcgataggggattcctatggtattgtttatttcatagataaggcttgttaataaactgccaggatgcttataatgagcaacgagaacaatcacaaaagagtgctgttgctatgcagttgaaccataggcctataataatacattagggacaaagataagtgtgcttacacatgccacagcttttgggtgctcttctaaatctctttattggctgaatctgcatgaagtggatgaagcctcttctgtgtgcagaagagggcatattaaaggggctgtagaaacaggtctcactattctcctcagagtatcgaagtactttttgcattagtttggcgctacaggaagcgaaaaaaatatcaggtaagcagtttgtcaaggttcttaaattttcatcagctgattaaaccctgtgactttgggtttacctcatgttattgaaccgacttcagtaaagggggatataaaattggaattaagtcagcaggaagttttaggggagagattgtgatattaatgagattgagggagtactcctttcagggtgtttatttttctaccctaaagttgcccctttgatcagagatgctttgtacggacatttatggctagaaccctaaaatctcacggagagtggaggaagaaagaaaagtagataaattactcaatcttactttttttcagagtcagggaatgagaccatgatctttcatcattttgttatcagatacccaaattgtatgaaatcatctttgtgtcctgaatgccttatgtctatttagatgctagcaaatatttgctaatagtagattaaaacacattttattt

SEQ ID NO: 121297 - DNA, 1933 bp, Homo sapiens
tctcaagttgttatgagttggctctagcatactactgaaaacaggtaacacttacagaacatgtacactgccttccaagcatagtataagtgttttctgtgaattatgtcatcctcaaagcaatgacttgaactaggtacttaaagtatccttattttgcagttgctatagttgaatcacatagtggttaaataacttacctgaagttacggtttgaaaacggcagagctgggattctaaaccaggccatctgtttctagagcctatgctcttaaccagcttgccatactgcctgttgaggttacagatattcttgaatgtgaggcagtagtagctatgataaattttaagtaaattactcatggttcagaattattttatgacttgtttcaataattgtttggattttatttgagttttatttatgacgaaatgttactatccttaatatatgaatgcttatataaatcaacaagaaaagctattctctcttcagtaggaaaacagaccacagacttcaataggcagttcataagaaaagaactaacaatggccagtaaacattgaaggcaaggacagtgtccattttgttcattgcaacattaacccaacccttgcagagtgcctctataaatgttattgtagtacctgttaattttttatacattttaataaagtacataaatatttcctgtccttttgcttatactaagctattttctaatgttgcctttaaataattgaatttttaaagaaagtgtttctgattatatagttagagacattttgttattaaaactccctaagttcaaacaaggatgaagaggcctaataaattacttttttcctaattataactaatcaatgtatgccgttgtatataatttcactaagtaaaatggaggttcttaaacttaagagacctactgaaattatgagaaatctctgtgtaatttctagaagctttaagttacaagtagtgatattttaatgcattgagctattttatctacaaaccttgttgaggaacagtgtaccctggaagttcagagactgatgtttttcctttgcggcttttcccagtttgccatctctttctcctctctggtagatgttttagccgtgtcagagctcaaatatacttctgatggatgttgtgaattattttgagaaataataaaatgtatcagaacaatatttctggtgctgacagctcctttttggagtttaggaatttgaaatttctgaaatggcttaaaggaagtgttttagttgcattactagacttgtcatccttggtatagataagcccttgctgtagtattttttttctgaagatggaaaagtcagtaagggtaaaggtgggaaaaatggacaaacattgattgaatgatgatccagggtcagacccagtgctaagtgtatacatgcgttattcatcaaagtaaaagctttcttattcagcaattcggaaaaagcagttggcgggggtggtaggaaaccagttcctatggaaagtatgcagttcactaaaaggtaatagtattgctctgtgacattgtttacatatcagagtactttgaaacctttgggatcagaacccttttctgtgttccagaaacatcccaaataaagttggccagaatattaagtttttggctgaagttatattactctgaattttatgttgatcagcatatatctgactgacaatgcagtgtgtcttatacttactaaaaaggaaaatcaattattatttattatgtttagttcatttgggagatgacacactcttcaaatcattggagctatgaaggatggagcatgaggtggagtaaaaggggtgtttactatggaaaaggttaatgattgttgctccatttggtctgtcatatgacttctcatgccatcacagatcaatgtattataataa

SEQ ID NO: 121298 - DNA, 1065 bp, Homo sapiens
tctagaacctctaaatataaaaggtctagaggtatactgctagggtcagcacatatatagcaacttcaggtaacaggaaatttaatgttacctattctatcattttaatgatttatttgaggatctgggaaatttttgttgctgtgaacttttactttttacttcagaggcaatactcttgattctgcctactcctttctgatggttcttcacctggcttcatacagtttctttacacacatatacatggtactcaggtaagaatgcaaccccttgcagatctctgggatttgcttttgtgcagtctcttttggttctctgctctgcaaattctagttgtcttgacctcctcagatgaactgtctcttcacctgagggagaactgctgcctccccctgcgtcccatcccctccctggtttcttcttcctgtaccatatcctggaaactctccaggcagtaagctgagggtaatagtaggactcaccttgtctatttctcttttctcagagatgacactcccctgtgctgcgtgttgtttattgccccaaaactgtgatttcataaatttgtgtctgtatatttagttatttacagtggagaataaatcccgtctctgtcagtatcatgctcagaggtagaatgtcctccttttctctttaaataaaattcacatgtacataaaatttgcatgaattttctttagaattagatagactatagaaatgttgtgggcttataatccgcaaagtctttaatatactctctatccacatctctcttaataaacgtggataaagtgcatattaaagactttgatgaaagtctttgatggaagacttggatggaagctctggactgagcttggtgatggtatagcagggaaaaaagtctagtctgagttcatgtatttgcctttgtgttaagctaaccctaaaaatattaaagttgggtcatagctggataattaagacatgataggtcagatttctatattttcctactaatgtgaatgttcctatgtgatatttaaatttggatcagtttagtaaaactgttttcatagg

SEQ ID NO: 121299 - DNA, 1061 bp, Homo sapiens
ctccgtctgcaatcccggcacctcgagaggccgaggctggcggatcactcgcggttaggagctggagaccagcccggccaacaaagcgaaaccctgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcgactcggcatcagagggagaccgtggaaagagagggagagggagaccgtggggagaggcagaggcagaggcagaggatattttttatgtaagtctttttaatacttctgctgcttatcatggtgcttggcatattgtaaatactcaataattattttttctaaaaaggttgaatgaatttctactgcaggttttgggcttttaagattttctgaattcagtttcttaaccaagctaactctagataatagttccagtcaagtacactaccttcactaattttctcccagcaatttaaaaactgccaagcagatgaagtttgaagtaagttttgtaattttcaagaattatacaggccaggtgtggtggctcacccctgtaatcccagcactttggaaggccgaggtgggcggatcacaaggtcaagagatcgagaccatcctggccaacatgttgaaaccccgtctctaataaaaatacaaaaatgagctgggtgtggtggcgtgcacctgtagtcccagctactagggaggctgaggcaggagaattgcttgaatccgggaggcggagattgcagtgagctgagattgcggcactgcactccagcctgccaatagagcgagactctgtctcaaaaaaaacaaaaaaaaattatacacatttccttatttcatgctacataatttctttacgtggaagataggcaaaatgaactgttgccatagtgaaggacaaaattctagagagaaaagatgcaatttagataaaagtaacatagtgctggaacatgtggaacaaaaatactgaggggaggctcagaataggagtg

SEQ ID NO: 121300 - DNA, 1020 bp, Homo sapiens
aatgttaagcaactaataagtaatatgaattaaatctctaaatattgacttctaatatctctgccatgtagtttaaaggaaaattaaaaggcacatgattatgtgtttggctttcttgtaaaaaaagaaaaaaattctatatgcaaacagagagagctatgaaaatagagaaaccaaacttaagagtggttagctctcaagaacaagttttcttttcatctctgaatttgacattttaaaacatatttattacttctataataaatataaataccaccacaaataaagtagaaagtttaaaataataaaattattaaatattttcatgcatataaaatattgccagtttttgagaaaagcttcttccatgtgattctgacaggtataatttataagcaacattgtgggtattaagtgacattgacttaatagaccatctggtactttcataaacaatttatagacttattgtttgtgtggtcatttatggctgaggtgggccattatggccctagctattattttcagtgtctgatttgatcatacacttgcaggctgtctttctaggcaaagtacagtgggatgagaagacactgccttgcataattcagacatgtgtaatattggtccctaagaagggccatcctaagccaaaggatccgtttgttttgtttcttatctaactttacttttttcattcatttatttaataaattatatatagtgttattgagtgccatgacatatacaaagatgaaaaaagatgatgttgctttcctttaggagatctcagtctgttggggaaaaccagcatggtttgtcacaggacaattaaggtgctgtatatgcagtacaaatgaagtactctaagagccactttcttaaaccctttacctggtgagcccagtgtgttctgtacccattatcttgtttcacagttttaattatctgacagtagggatcaagaagttttagtcctatatagtacaacttctttttctgcgaattgtaatagaaatt

SEQ ID NO: 121301 - DNA, 2045 bp, Homo sapiens
ctcagtctttccctggaaaaactgggaagagatgaaggatttagaaccgggagaagcagatcttcaccagtttggaacatgtggtttaattccaaatacttattgatcctatacattaaaatatgctaaggaatcagggcctacagaaggaagaggaacacaggtttgtagcctctcaaagagcagagtttggtgacgaaagtggaccagctacactcattatatgtgagtgctacacaagaggagtgatacgagcatccaggggtttcacaagcagggctggcatttgaaggaaggcagaatttcagtgggagctggggaagggagaggctttgtgttatgtgtgggtggatggtgcagacagagatttttcttggttttaccatgtcatttggacaatctgaccttgcatttcaccttttgcattctaggaaaagtattatcacaaaattgaattactactttaatataaacaagatagattttgcttatacataaccggtgttgagttgaagattttatcctccatttttaagaactctgctttatcatacatatgttatgaaacctgagggtttagtactgagaaataagttttagccatggctcagcaaatgtaaagattggatgtgacactcttaatatggtgtaggaaactctcaattagattgatgatcataataattttagcactttatacttttttttacatatatgatacaatttgattcttataacaattctctgagatgggtaacataagtgccagtgcccttattttataggcaaggaaatcaggcttccatgattgcattgactaggtggtggactggggctagaattctggtcttctgatagccagtctagagaacaccatactgtaggtaattgtggctcatccttatatgcagtcaaagttatcattaataatgtggactataggtaatatatgtggtgagaagtaatagtctctgtttaagtaaacagcagttgaatattgctgttgttctggaattacagtccatagttaggaagaagtatggcttaccttttgtttaatgtggttttgggctaccacgtccataaactttggtgaaaagttctgttgctgactgtagaggatttagttacttgagggaaaaactccattattatctcttgctttcgttgttaattgaagtggctcttaaaattagagggttgtacatttagacagaaaaactatcctgttgactaaagatgtaatttctgtagtactcagtgacaaaggaggaaccatgtaagtacttggggaaaatatggaaagaaaacttatgacatatacttggtaacatttttggaaaataaagaagtggacaaaagtagacaaaatgagtaaaaatctgtaattcaattacctatatacgttaattttatgacatatgtccttttccatttcttttttctccataatatataacatttaaaaattgggactactgcgtgtacagttccatatcctgcagatgcacttaatatatcacagcattttttaatgccatgaaatatcatttcaaaccattttcatgacaatgcacaatgtgtggtaaacagtctgatgaaacatttaagcagttttgtatcctgacagtttttggttaatattattacattggtatttttccatgtaattacaagcttcagaaacacagtttttcaagataagaaagaagtcatatgggtgacataaaccaattagcaattaaatatttataagatagtgcctagttcatgattaagtagattcttgagttatatatccaattaagaaattctaatcactatgaattttagaaattcaacaataaaggaagcaactactagtactgaggagacctgattttcattcctaactcatgctaagtagctagttttggatggcttatacatgaaaatgaatgattgccaaggttctttatcatcctgttatacctgccttaattaattacttcattatttatttatttcttgagtgtttcttgtgtgccagcaactattttagattc

SEQ ID NO: 121302 - DNA, 1059 bp, Homo sapiens
ttaaaattgcaaaacagtaactaccatttatatgtcaacctactcatatgcctggcatgatgctgggtattgcatatgaaatacatatatgttatgtatatatgtaagtttaaagagtcgcatagctatagtggtagaaatggcatttgaacatcaaatgtatatttggcctaaactatatatttttagtgtcattatattgactgggagatactgcagaaatagttatgaaaatatatttattaagattctgattttgattaatactacaactttctcagatatgttaaatgcatgaaattaaagttaatagtttatacatttatagatattacttttattcaaatattagattttggaagtcaaactgttgtgtcttagttgtattatcaattctaatgattagttataaaaagacaataaaattttaacatgagcatttccagtgtgtatttgggtcgagaagattttgaaaagaactgtttttgtaaatgttaccaatgaatgtgactgctttgatacatgcctgaaatgtttcctggaaagaattgtcaaagagcgttgacaaagtcttgattttactctagtgggtgaaaatatttcccagtgaaccctggtattaaagatattatacaaacatactattgttctagtgcccctgtattcagtgctatggttttccatgctgggcatgccagtgtaatgatgtattttcttgattttggtgtgaaatactactacttgtctagtgaggtagatagacactgggttaataaaggcgggataaaatagggcatatggaatattctgagcagtagagattatgtaggtagtcaatgaattaggtagatctaagaactcaagtactgtggctcttcctacaccagtagtcttttaaaaaatgcacacattattttttagagcagttttaggtttatagcaaaattgagcagaaactacatagttcccatatactccctcttcctcccccatagtttctcatatttatatcggtactggtgtggtacatttgttggaattgatgaaccaatattgata

SEQ ID NO: 121303 - DNA, 1560 bp, Homo sapiens
ggttgaatttgctgagtgttagttaagattatgtttgactgtttgtaacagaaaacaaatgatactgcttagccaaataggtgttttctttttcttaggtactgagaagtcctaaataggcaaaactgggttgtagggtacccccatttgccagtagggactcagactcctctatttctgtgtggctatttatagtgtatcttgtggttgttttgtgatcacaagatggctgctcctcttccagcccttatatctccattccaggggacagctgttccaggggccatctctatctgcaggtagactaggaaatgtagatttttaagccggcttcatttagtgccctgaacaaaattgaagttttgtttgtaaagaataaggaaagaatggcaactggttttgcaatcagcagtgtctggcacatggagggcaaagtgtgctaaaattgggaacttaaaatttggatacatattaacaatcatcacacaatatatttgacttcactaaagtttgaagaagatctgagagcaccatgaggtttcttagtattttcaaaatgacgcatttgaatgttttatgttacaacatgggtttgaaaagtcattctcaccaaataattacgattaaattgtgtttattgcctcacacaataaggagtgtatatgagttcagaaatgtgggaaattattaggtattgttagtgaatttaattttaaacttctactgatgctcttttcagtttcttttgttcttagagagttatctcaacatttatttagcccagagactttaaaaagaaggcttatgctttttaaaacttctaggttttttttttgttgttgtttgtttgttttgtatttgaacaatttggagatgcttgttttctggctcaataactttttaggtaatcagtgtaaggacaggtggtgaaaacaatttattgtcttactgctatcttgtagtctgacaaagaagtgcttgtatttctgccgttgggtcatatgtgcctcaggatcctggctctgtggggagctggaatatttgaccaaagcatcttcatgcaattggagattatgaaaatatctgaagctatagaggtgataacaagatggaatatctaggctgtcatgttcatttctgttttagttccacaactgagtataaaagtgcacaagaacacacccaaatcatgtgacctggtggactaattgggaagaaaagatgatttgtagtttcgaatgtttgttatttcatattaactaaacacagatgcttctgtttcatggaagtctctctataatggctttgaataaaaaacaggaaagacttctgtgtccatttcttagctcttaatatttcagggattacattctacctatgtccaaggaggaatttcaggtaattatttgctgaagtatgtcattgtttcagtaagtgatcaaatgagaccccttcttattcattttttttttctgcttgtcctttaatgcaattttgtttgcttttgttttctgacttgcttcatctctcccaaaagaagaagcaaataattctgcttag

SEQ ID NO: 121304 - DNA, 1029 bp, Homo sapiens
tggtgacttgctgtggggactgatctaatcagaaaagaattgtaggctttgaatagggagtgtcagttcactaaacgttcagagtacggttgctcactttctgaaatcatgcattgttcaaaacattttatgttctcatttaaacttaaagggaagtcattttgattttatttctgacagagttccttggttacagaatgagtttgcattcatctagaatattatcaggttgccaagttatcatatgcctcagctgttgagtagtgtaagtggtggagtcagctggaaccaattcaaaatctgcctgttgtcagaaatgtagaattgtaataatctataatgttaggaattatgagcattagatttagaagtcgagagttttgttaggtctagtcttcagacagccttgagaggagttcaaatcagactctgtagaaaaacaagaaaagtggagagtgagcgctaattatttatggtgtagtcagtctattcttgtatcttgttttggtccattacttctgagcaaaaataggcaactgtttgctgaattagaataacacagaaagagctatttgctacaaagaagggtgcagtgttctgattcatattcgagtcctgttacttgtaaaatatattcatggaatattcagggacatctgattaaaaaaacatatttcttcagctgataccaaacttcggctgaataaaggcatttatttttgagtaaaacataattctttattattgtttaggctagaaattgtctacatcagaatggctttcttttatatctatagtaaattatccagtgtatataccgtgtaatacaaaacattcttagtagcttagcttaaaagatacagtagtatcttattttttttcttaagtgtaaggaaactaacccatatgctgttattataaatgattaattagttctcatcttatgaaattctgctttttgagtttatcattggaatatttgttttcccaacacattgttactttgtagtatgatgttaagtgagaaaa

SEQ ID NO: 121305 - DNA, 1022 bp, Homo sapiens
tccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaaggtatgtggtccctgccctggggctgcggagcttggcactgatcagagaggcaaccgctgcctttccttaatcagagccaccactccttgggcacgagtaaacaggtgtctggaccagtcttgggaatggaccaggtctttttgcacgggatttagtacccccagcgcagggaggatggtggggtgggcgacagtccggagacgcccttagatgagcggtagagaggggggaagggggttgtttccaagaagcacattgcgttttctctcccttgtaaaagctcttaagcactacgcgtaatcataattcttcctgggagggtggataccgattattctctatgggattactaaggcattgctgctgctgcttggctagggtattggttagccctgtagaaaaggttcagcatcactagatcattttccttaaaatgatctttcttatttgataaagtttgtgactatatacttactctgatatattgtaaaaattattttatagcgtgatggataaaagactttagtgagtttgttgtaaatttaaatgtaaagaatgtattttgagatttttttctgcccatcctttatgttcaggaaattctatgccaatctgatatttatgttttagtataatgtttacttggacttcatagttgaatataatgatgaaatacaaattgcagctgtccattttttaagtgtttttgtgtctggaaatgtatttttaagtgtgtgtataccatctttttattgtggctcccaaaacactccgaactcaagagcagctcacagag

SEQ ID NO: 121306 - DNA, 1037 bp, Homo sapiens
gtgctactgggtgtcagtctctgatgaaggctcagacgtgccttcaatgaccttactcattgtaaaggagacatttttgagagacctatgtctatacatgtgtggtctgtaaatgaatgactttcagggacttaattgctaacccttttatttcaagaaggtgtcccatatgatgcctggttgttactttatgaactaatgtgcatacaaatgcatatcgagctgtaagaaaactctagtaaccttaaagacttactgggacagtggttcaaactcagattataaaccagtggtcaggatagaaaaaagagatgtggtcttgctttgtttggagtaacagaagtaggccaattgctgaggagtgctccagttctatctcaagtcagtttttttttcccacgagtacacaattttttctttcaagaggaactcatccctatctaagcattaatggaaaatggtccatagttcacaacacccaacgctaacaaagaaataaaaaatcatggagggcaaaaggtcagtatatgtgaaaggaggaaatagggaaggaagatttagacaagacgtgaagttgacataggtcagactgtcaacaatcagctgatttatctaataatagcagtagcaatgaggtatcatcctgtcactgtactccagcctggatgacagagtgagaccccacctcctaaataaagtagtaggtgcagcagctaatccttatataacaccagacattattctaaacttcatttactatacaactttatgagttaggcactactatcgctgttttactgatgaagagagtctcagagaggataagtaacttgcccatgtgacacagtaaggagtgaagattctatgtacagcagcctgacttcactgttttttttttttttgagacggagtcttgctctgtcgcccaggctggaatacggtggcgtgatctcggctcactgcaacctccacctcccgggttcaagcagttctctgcctcaacctcccgagtagctgggattataggtacccgccac

SEQ ID NO: 121307 - DNA, 2479 bp, Homo sapiens
ttagtattttcatttgtttttaaggtcctaaaaatagaattgattgtgaaagtgtctattgagtcaaaaagactatgtggtctgtgggataccttaattcacccacatttagcaactacttattgagcccctgcaataaaatgaagattagcatacagttctgcctttaaaaagtcatagtttcaaaagagattggtgaatggacacaaacttacagttaaaagaaatgagtcctaatattccatagcagagtaggatatctatagttagcaataatatattgtatatttcaaaatagctagaaggaaggacttgaaatattaccaatacatagaaatgataaatgcttaaggtggtggatacctcagatactctgacttgatcgttacacattctatgcatgtaaaaaatacttgcagtatggtgccctcattaatatataaaatatcatgtatcagtaaaataaaaaagaataagctggaaaataaaggtcatagtctaatatgataaatggatgtgttgttaaacagttacaacgcggtaattattagttgttacagggattagttgagatggctataagcacctaaaattaaaagaacccagaggacagtgtaattaacctgaggggagaagggaggcatgggaggttcctgaaaggtttctgagaggaagtgccacttgaattgagatttaaagagcttgatggaattagggtgaaagggaagcccactttagagggatggaactacaagaacaaaggtagggagatgggtgtaaatgggaactgcaagtaaagtgtgttgctaagtgtgggatttggaagggaaagacagaaactgtaaagatgtttgtgtacaatcctgaggcaactggactatttatgttgtaagtgctagggaaccattgaaagatttttaagcaatggaatggcataatcaggtttacggtttggaaagtcatattagtgaaggcgtcacatgtcttaacacttcttattatttatttgtttatttaaaaatttatttatgagttgagggtttgctctgttgcccagggtggagtgcactagcatgatcacagctcactgccacctctaagtcctggactcaagggatcctcccacttcagcctcctgagtagctaggactacaggtgtgtaccaccatgcttggcttattaaaaatttttttttatagagatgggttctcattgtgttgcccaggctggactcgaactcctgggctcaagtgatcttttctgcctgggcctcccaaagtgttgggattataggagtgagccacagggcctggccaacttcacttttttttttttttttttttttttgagacagggtcttcctctctttctcaagctggattgcagtggtgtgatctcagctcactgcaacctctacctcccgggctcaagcgatcctcccaccatagcctcccaggtagctgggactaaaggtgtgtgccatcatgcctggctaatttttgtatttttgtagagacaggcttccaccatgttgtgcaggctagtttcgaactcctgggctcaagcaatctgcccaccttggcctcccaaagtactagtattacaggcgtgagccactgtgcctggcccaacttcacatttttagtctttagtgcttttgtatctgttgtggtttcatcatattaaaatctgagactatagtatgtttacttcttatctcctagggtcaatgtgagaataaaacaatgaaatataaggaaaggggcttttaaacacccattgtataaatgctttttacatatgagcaatacagatctgctgttgttagctacaggatattgtaagttgggtttttcagtcataaactacctgtaaagttacatggtttgtcagtgataatgctattttaagaaaaggatttttgtcctatccaaattcttcgaagttggaattgaaggatcaaaggagaatcagactttgaactcaggcagacttggttttaattccttctctgtccatgactagttgtgtttacttggacaatttaccaaacttatcttagcctcagtttccttatcaaagggtcatggttgtggtgattaaatataatagtgaatgcaaacaattctgctacctccttggcacatcaaatgctttataaatgatagcttacccatggccagatgttcttctaagcacttaatatggtatcctatttagacctcccaagaaccccatgaagtaggtactatgattttctccattttcagttcagaatctgctgagaaaggaagaaaaactttgccaaggttgtagtgtcaagaagtagtagagctaggatctgaattcaggcagtctttactccaaagtccaagctatttactgctacgcttttgcctcttctctatggaatacactattattattagcatattgacccaatgttacccttccaagaatgcatggggtaaaggctgtt

SEQ ID NO: 121308 - DNA, 2868 bp, Homo sapiens
aataaggacagataggaagccatttttaggaagatagaaagcagccaaagaaacccaataccctcttaaaagtctttaagaatgtcacccttttatgcagagccagccaaaaacaaaatctcagaaagctcaagatggattttcagaaaagcatggaaaataaactgggttgataatagcatgctgtgactgacctaatgccactcacaactccctatggattgtagctacaatacagaaaatcaattttatttactttttgcctcaagtttgcctaatgccttattgtcattagaaaaatatacagactgtaaataaataaattagccaagatgatgaaattttatgtaaaataaaatggaagacagcttttttggggggaaagaatagagagctacgtcttacatacctcactttgtgggaaatattacgtgaacttctaaaataatggggtttacacctactatgtgcccacaaaaaagaaaaataaataaaataaaataatggtgttgaccatgcatagccacaggcctaaacagattgaggtaaggttggtagtcctgatgcaattagagtttatttcacgtacctagggtgagtgttttgggatgtggctcacacagcctgtttgtgctgcagttgccactgcttttgtgggaagcccagtgtttttgctcaaattggagcatgcctcactgatttctgcctgtaacttgcttcttaggaatccatggctgcaagttacatttcaggaattcgagttataccagttttgcatctttaccatgagtctcagcgaagtagaattctcagtaggaaagtcaagacttccttttgatatgtcgttatgtttataattttgcagcagagatagtcaacatccttgtttccttagtaagccagtggctctgtaaataatcacaaacacaacccaacaaagaaggaaggaataacatcttgtgccttttccctctatggaagatattaacacttttatgcaagacatgaccctacagatttgctccagctagatgaagggaggactaaccttcaggcaaagtgctttggcaaaagcatcctgtttctcatttcactgtgtaatgaccaggagctgagaagagctctgtttcctgtcactgcgcagcatcattctcatttacattattggcagctgttactttgctggaagtttaaattatcttgagaactctaaaccgagttcagatgtttgtttattggtgctgccataggcttctgaaaacagtcttttgtgttctcccagtcttaagaaaaggctcttctcagaatcagcccttcctccctccttgctcttttctgggaacctgcttcagtctcatgaagaaaattaaataaagaggacaggggcttaaaactggtcagaacggagtctccagtggtgaggtgacttgaagcggaaaggagttgggactcaacatcctgcatttgtgctttgttttcgaaacttcgagttagttgcattgatgaattaagcagcaggctagtaatggaaaatatttctactgtcctggtgggggagccaaatactataggtttgtaacaggaaggctgttgattctggcttcattgttgggccagtcatttgtgagctggtggccggaccacaggccacacacttcttccgtgcaaatcttcatgtattgaaactgcctgtgtattgtttttacgattggagacttggccaagaaaagatggtgagctccgggttttatttttttggtttctgcatattccctcagctccgaggatggtgcaggatatgccagacccagtttgggggcagggagggcggcggtggttggtgggggagatgtttaaatcattgagcatatgtgagtattttgctgttaatgctttttctgtgtcattctctgtagagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcaggtaagagcatctggggaaggggatggagtgggggaagagagttgcggaaattcgcccatctacctcctggggggccatagcgggagctgatgcactgggcaggaatctgtgctcaaggtgggggaggatgatgaccatgtttactttatgccttgttttaccgatagagccatttgccctgcctgctggtgactaagctgtttggccctgccttctggttggacgaatcgattcctttgaaatgcaaggaaatatttacagacatttgcactaaactttcctaattactgcattagttaccataacattctgaaagtattagctccagtgattgctagtatatttgcgggaagctggaagtgagcagcctttattttcatttttgcccaggggcactgagctacgcagattgagaagatccatggtttttggtacccaggattgcaaagcatattccagcaacttggatgttgtttttctttaaatgtagcatctctgtctgcatcattgtatccatagcagctttctgtccttagtgcttttgagggtttggccatcacgccttcctgattaattaatacatgagatgtgccaatgtttctgttctgtgttacccggtgttcccttgcattggccctaaaagctgaaccagaagtgatggcttgttttacccagctgaaagctgagaacactgtggaaatcaaccttccaacccctgcgtggtttgtgtgtatgtgtcctgtg

SEQ ID NO: 121309 - DNA, 1057 bp, Homo sapiens
gagctatgatcatgtctctgcactccagcctgggcaatggagcaagaccttgtctcgtaaaaaaaaaaaaagaccttgctatttcccctcaattcttcattttgaaaatattcagatttatagaaaagttgaaagagtagaccaatgaatacttattgttagcctattatcacatttaatacttttccttgtttttattgaaacaataaaaataagtgcagacatcttgggtttcctcagcctgcatcttctatggataaggacactttcctgcataaccacaatactattattgcaccttagaaaactaacaataatttcctaatattgtctaataaacaacccagttccatgttcagatttccccagttgccccaaaatgtctttttagcttttgaaaaagaatcaacccagaatccaaccaaggttcatgaattggttgtgtctcttttgtccttttaaatctagaacaattcctcctttttgagtgtgtatgtttcatgtcattgacctttttgaaggatctaggacaattgtcttgtagaatgcttcacaatcaggatttgtctgtttccttgtgtgctttctatttttgggttttttttggtgaatattttgaaatacacatacagaaatgtgcttaagttataaatatgtgggtatgtgggtttatgaaagtttacttttcagcctctgggattttaaacttttggctactttgcaaacccttgtctctgcacttttctccgttgcctgtagagaatgcctattgccaagacaatttcttggcactttcctacagatcagggtgctaaggctgggcggcatccaatttaggcagttccattgtacttatctcagatcccccaccggggtttcagttaaagaagttattgttcagttccccttctaaaaatgttgcattatgtaattatcctggctttaggagatttgggttgtctttataccatgcgaatgaatgggctatcaggaaagtcattttaaagcttttggtgatctaattcaattgttaaaactgctttaataactaggttgt

SEQ ID NO: 121310 - DNA, 1036 bp, Homo sapiens
tctggggtaagaggtgttcccttgtctttttttcaactcacctcaggttctgactccccggtctccatgaggccaggcctggtgttccccatttcttccacctcagaattgtgttaaggttctggggtcctgtaagatgcataccacggtgtcagggaatgggagggaacatttgtgcctccaggttatgcccacctcaaaagattcaggcttgtggaaaataaaagtcaggtattcttgcaggctgtttctgcttcccgtcctgccatatagcttcctctaggggtaaagcaaggaagggacaggtccagatcacctcaggaaagagagataaaatgaaatctactggggcctttagtgcagatacgggggctttgagccacacagttgttccagatggatctcaggtgttctaagaggaggatgtgcaacaaatgtcagggaaaacccaaatattgttaaggacatttggaatgaacttagcatttattcttgagaggaggctgtggttggattggtttgctaccatgcaatatgaagcatcccacctgagcagagttttccaccaagccagctcagagggatcaggcactgatccctggttccgattgggtgcagcttaaggtagcagcagaattgttttcactgaatgtacatggaacagccctgctttcctcagaagagggcagtgggagtgccaggcacttaaagtttcatagactttgcttctgtgcagtaataaaagtttttgtttttaatgaaaaagtaattatttcacttaagtgtctactgtttgtagtgaaagagtaagtgtgtaaaagctattatcaaaagcaattttctgaagtctcattaatgaagacaggtaatgaaaatggaagcataaagaagatataaagacataactttgcttatgtgtcaatagagaagaactgaatatctataattgcttttttttttaacactaacatgtttgtctaagtttttgttgtctccagtaatggagacaatgaatttaaaagaaaaaaaccttctg

SEQ ID NO: 121311 - DNA, 1074 bp, Homo sapiens
agatacagacatggaaataacctttataaattaccctttaaaggagtttgcctaagaagagacaggaatttaggcagtaagctggggaggatataggattcagaaaggtctttcataagatgggagacatttgagatattttagggagatgaaagggggcctttcctgggcctggacagagtgcaggtgagggtaagagtagaaatggatacatttggggatagttagaagttgttaaagaaaaacagtgctgagaacccagttgatgttagatggttggacatttgtcgagggattaagctgcttcattgagtagtgttttcaaagcacatttcagccatttagaattgggagttaaggtgaatgtttcaactgatccaagatagagggtggacttgatagctctaaaggaggcagctgggatattgatgtcaagagaatgcttgaaatgatgcatcatgaggcttgatgaagaagaacaggaaatcttaacggcagtccaggaacagagcattagaggtctggattagcttgaagaggagtgagagagctggagagccaaaaattggaggtcacatttttggattacagtgagaggtctcagagttggttcagtaccaggtgatgtgatcatccagaatggggccatggcatgctgggagaagaagagagaagataaagattatttgaactcaggaggctaggaacttttgtggctgaggtgttggctggcccatccacattgaatgtggaaatcttcccagatgactacactcaaagtgaagaagaagcaatgagtcaggttccaaagtcctcagcaaatgagggagtgtgaccagaggtcagacagtgacaattcagggaaaggaagagagcggcattggatgatgtttccctccgggatttcgatgagacatgcaggagaagcagaagcctctgctggagaggtgcagaggtatagagagcaggcacttaacaaatacaacgtggaatgattaaggtaaggcaagcagtggagatggcactttcgtgaggagttagagcttcctgacaattaaatgaaggtttcaaagg

SEQ ID NO: 121312 - DNA, 1039 bp, Homo sapiens
agctgggataacaggtgtgtgtaccacgcccggctaatttttgtatttttagtagagacagggttttaccatgttggccagtctggtctcgaactcctgacctcaagcgatctgcccaccttggcttcccaaagtgctgggattacaggcatgggccactgcgcctggcctaatatactgctttctaagaaacgtactaaaatggtttctccgaagtaatttcttcattgtagttctatctcttattctgactttagtaatgagaagaattacatcattttagaggaaagagactgtattttgtgttctaaaccttagcaccagagaattgtaagatttcaatatatttttaataatgaatctctagactatttttctgaagagttatcgcttaactttagctaagagaaaattgtaaggtgagaagtcagggtgaagaatggataaaaggaaaatcatacattcagttattgtgatgaattaacaagttgggttgtatgttacatatccaaagtacctttctggatactcttttgaaaggtacctattcattgtgggaatagaaattttaaaaatgtctttatcatatgctacaatagcacctactttagtaatgggctaggcccagtttaattttgcttgagctatgacttaaaccttttagcaaacataagcactatcatggaggggctaagagtgtgcattctggaactatacagcctaatgtgagtttaaattctggtttcagcacttaccagctcagtgcctttgggcaagtgagttacttaatttctctgtggctcaggttcctccagtttagaatgggggtcataactttatagtgagtgttattgtgtggattaatctatttatagatttgaggaagcaagaaaatttaatcatggtatactacttaattaaggagtgaatgatataagatggaattaaccataatatcactgaatatggatgtatgcaaaaattctgtaagaaaggtataattctttatctatcttaatagggactgaatagataataa

SEQ ID NO: 121313 - DNA, 1010 bp, Homo sapiens
tgatgattgtgtttcaaaaaaatcaatctatggaaattgaacaaaatttagtttgtgctttgggagatgagaattcagttctagaaatgacagtaatgtttcaggaattttttttttttttttttttttgagactgagtttcactctcattgcctaggctggagtgcaatggcacgatctccggctcaccgcaaactccacctcctgggttcaagcaattctcctgcctcagcctcccgagcagctgggattacaggcatgtgccaccacacccagctaattttgtatttttagtagagacggggtttctccatgttggtcagggtggtctcgaactcctaacctcaggtgatctgcccgcctcggcctcccaaaatgctgggattacaggcgtgagccaccatgcctggctgtttcaggaaaattatagctttggagtagtacttcgtagttaagtagcacttcatactttcaaagactgctcatattcattatctcctgaacaaacaccctgtgtgttgggtatggcatatattattgatccagtttgacaaaactaaacctcagtgagtaggtgattggcttaagttcataaggtcagttagaagcagacctctctcatccttgcagtctgttgtctcctgtgtttatcctatgtttatttagtctttatctctgacaatgcttagagaattgggtgagaacttccagggagaagaatatagattccatttgactggaggaattattcagtatcccaatgtgactcattcccagggagtagctttacatctttgagagtctgctcacagcctgcattatctgtgttggccaccctaggctacctgtgtattggcaagtccactttggtctaatactatcaagcccatgctgctcctccacacaccctattcaattatgaattggtaaattagataatcaactctgatactgggtaataccactggctaatctacattgacccttgctacatgcagctcagtattact

SEQ ID NO: 121314 - DNA, 1084 bp, Homo sapiens
tatggccaggtgtggtggttcacgtctgtaatcccagcacactgggaggctgaggcgggcggatcacgaggtcaagagattgagaccatcccagccaacatggtgaaacccgtctctactaaaaatacaaaacttagctgggcatggtggcacgtgcctgtagtctcagctacttgggaggctgaggcaggagaatcgcttgaacccgggaggcagaggttgcagtgagccgagatcgcactgctgcactccagcctggtaacagagcgagactccatctcaaaaaaaaaaaaaaaagatttcatttattataggcttgctataataaattacagtaaggtattggaataattaatgcacaggggcacaagaatgtgcaaggtaggtagactgtattgaatgaacagtttagtctctataaacaactcatgaaaccaagattaacttggtaaagggattcatgtgttctgcttggagaaaaataagcatgtgttcataactcatgattcttttttgaggtcagtattttgactgaagcaagacctcttgccattctttctatgtctttcttgtatgtgatgacaacctgttgtcttaaataaaaaaaaccttaaattctttaatctccaaaccaaggaaacttaaagaaaacatttagatagtcacttacactttgaaaattttcatggacaactatggatcaaaggactgaaaagaaagccccttcaaagatggtctagtttattatttcacctctaaccaaagaaatccttaaattgctctggtaagatgggtatagcttcctttattttaaaggacacagccatagcttacctcagaattctgtttggaatttaacagccatctctgcctgaaacaactccttgatctttgccctaaatcccatgccttacaatttaagaccatttcttattgtggtatcctctgtggagaggatgaagcatagccacctgctaccgtgtcactctcagtctttgtgaatcaaagaatgttaaagcttgaggggatcttagagctcatctgacttaacagtttttgtaatgctagattcctctctgcttca

SEQ ID NO: 121315 - DNA, 1039 bp, Homo sapiens
tgattatagcttggagatggagtaaaaataaatcagttatggtgattcaggattacttgaatgactttatatgaagcactcaaggcatttctagtggcaatctaaataagaaataggcccatgagtgagaaagactgaaaacagaagtaactgcaaaggagatgagtcagaaagcgtgactgtgcagttttagctactttcagtcagaccatcctcttgaagtgttatgtgaaatgcaaatactttagcatccttagctgttttaacctatttacttattctggatttgtaagctatatgcaaatatacctataagaatttgtaatggggatcactaataaaaacttaataatatctagattttttattttactccttgttttagatgtttctaaaagtggataaactaaaaatttatcctgatttcctctcagtacatatgtatttggatttatactgtatattaagatatgtcactaggatgcttaggaattttttttaccatcttgaaacagaaaagataattagatccagatctccatttattccttagtattttcacattacaaagcattttgttttgtttctgaatcccaggatttttaaacatcatcatcatcatcataagaactcttgcattactgcatgtttacctcattgacaatacatgggcattgttctctgcactcttctctgtttttctctcattttatcttctcagcgattctctggagtcggtgctcactttccagggaggaaatgtgtcaaggtcatacagctggtagatcatggagttaacatttaaacctaggcactcttggcttgagccgtttttgagtaaggaatggagaactccccatgattacaattctagtgctagacatttatcctcatcagccttcctgaagtattttaattactttgagtctcatttttctaactgcatagatggtagatatggatgaaatctttgtgtttttaaactattacatcaattaaaacctatctttaaaatggtattgaaaaccataggtaaacc

SEQ ID NO: 121316 - DNA, 1031 bp, Homo sapiens
ctacactctacttcaggccaaaatggaaacgcccttcttcacagtctccctgatgcttcagtcaagcagtgtgcccacctgctttttttccctccttttttttttttttttggactggctttactcaattaagaacacttcttaatgtagaataactctgggccctgaaatactggggtgctttaaagaacacttgtggggaaaacttaacttgcacgttaagcctcctccatgctcactttgggagtgcacgtgatctcactgaatatagtgacttttggagctctttgtataactagccatggagaacttccagactaactcaatacaaatctggatttgcttggttgtgttttctgccacagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctgtaagtagagaactgtcttttataaaaatattaaattcactgtcaaatcatgtggttgttcttttagtttaaaaacattatcagattaactttgaataattaggttgttgttattcccaacaagtggcagcgtactcatatgagtttcagcaaggaatagggtttcatagaatgttctaggatggatagatagttgacaaaaaagcaagagttagtcactgtcaggcagctgatatgaaagctggtgaactcccagccctgctgaagctggagttctagaatgaggatggggacatagagtcaacaaatctaggtgtggtaatgagagaactgatgaagaggatgacaacaaaaccagtgtcaggataggagaagcagtgaaggaaggtggggctggagtcttgggcagtagcagtggctgaactcctcctggaggctcttgagccagtgaggcctgtgcgtccc

SEQ ID NO: 121317 - DNA, 1068 bp, Homo sapiens
tgtgtagtataccacagtgcttataaatagttattttaaaatagtacaagtaaatttgggtataaaagaaataactgaggcagtgctcagatctggagaaaaaatgttaaggtggaatgaagatgcctgaagtttaggaaagactgatttaagtggtttagaatttttggccgcatgcgatggcttacacctgtaatcccagcactttgggaagctgagctgggcagatcatgaggtcaggagtttgagaccagcctggccaacatggtgaaaccccatctgtactaaaaatacaaaaattagccgggcatggtggtgcacacctgtaatcccagctactcaggaggctgaggcaggagaatcgcttgaacccagcaggcagaggttgcagtgagctgagatcacaccactgcactccagcctgggtgacagagcaagattctgtctcaaaaaaatttttttatatcataaataattctgcattgaatatcttactgggcactcttggtagaatttctctagggtagatacagggatgtgaattcactgagttattgttttgcagaatggctgtgacagcatgttttaatctctgtcatttggttactttagcgaagttttatgcagtttttctccctaagtgtttctagaatttgtagtccactgaggactattggtaataataccagttaagcaaaatctggttgcttattactcataagagaatctacattcttaccaaagaaatgtactgaacttactccactattacagaagctactatatcatcaaatattttgttcattctaccagaacaccaaatttctgaattagaatgcagggctatgggagataatgccatctagtggtcaaactaaactctggttcctagagattcttagtcttcaaagtgtagaaaaattatcagagaagcttgttaaaaaatgagattgagaaggaaagacagagagagagagagagagaatgaatgtgtgtgtgtagagggtggagggggcgggtgggtggatggggaatgtccaggaagctgcataaaaagcagcctgtatg

SEQ ID NO: 121318 - DNA, 1056 bp, Homo sapiens
gtgagataatgcatgcatagtatttggcacataggaaatgcttgataagtagaaataattgttgtttatggagctgtaaagaattaaagagagttgaatgtagttaggagctgaacaatgctggaaaagtgttagataaatgggactcagattctgtttggctatgtaataagatgtgtcaatggagctctttttgtcttagttttgtttgaggccccaatagttgtagtcagaaaggctcacattgccagagagaggagtagagccctatgtaggaggtagctataaatttgattttgccaccagctctgtggtagactgtgttttgctcaccaatgtctgtgttctcttattcttggcacataactaattttttagcttcccttgcaacttggtgatgaccttgtaactgggttctagttaatgaaacgtaagaaatgatgtgtgccatttacaggtctgatgtactgaaaccatgcacacaatcctggccctagtttccataatccagcagagtggagaggatattgagaacctaaaaagccatagatggaaggtgcctggtgttctaaatgactctgtggagcagagcaccacccccacttgctgatctatgcgtgacatgagcgaggcataaacttttattgtgttaagctcctgaggttttggtgttgcttgctgtagccgttagtctatgctgatagttatagtcagccatcaccgattttaggtatatggataaaggctaaggtttcatctgtgagaggttaaagaagtgctgttcagtagaactttctgtgagaacacaaatgttttatctgtattatccaatagggtctctactagccacatatgatattgagtacttagaatatggctagcatgcttgagaagttgaaattttaatttaattttaattaattaaaatttaaataaaaatatgtggctggtagctactctgttagacaggtcaggattagagactggggaatgtcttagcagtgtgctgcgcccgaccccaagactccataataattccaaagggccagagactgt

SEQ ID NO: 121319 - DNA, 1097 bp, Homo sapiens
tgaggcaggagaatcacttgaacccgggaggtggaggttgcagtgagccaagatcatgccaccacattccagcttgggtgacaaagcaagactctgtctcaaaaaaaaaaagaaaaaaaaaagaatgtacacctgaacctgaaatgtcataaaaagagcaatgtagaaaacatatatataaaacaagatcccatttttgttgaattatttttataggagaagtcaagatgataggaactaacatcacagtgattactctagagggatgtatttgaagattcaaaacagggacattcacacttatttatagggttcaaaaaagggttgcaattttaggtggatttagtttctaatttgtttttttctgaaattttcacacaagtagatctttaaaaaggaaaaatcaaacccaaagcatattgagagtctattttgtgcccaaacataagtaggagcaatgaaggacacaaagatgaaaaagaagctgtccctccccttcatatccatgataagtcaaactgtggtaagtgctatttaaaaagccacattgaaataaacttcttttaaatcagtctactgggaaaagtcaacaggaataatatgattcaggttaaaaagttcatagctcttgcctaaataactgcaagaggggcaagagaaggtaacaaaaatctcttcaaagcttttagctactgatctggattcagtaacatcatcttaggaaaaggagtcaatacaaggtgacttcttatgcacagtttatgcagatatccatgtaatgcattgtcaaagacagagcagaaatgaacagtaaaaaatgctgtagccaccacaaaatggactagccacaagcatttctcacaaacctttgattaaccatctttgtttaaaacctgctcctgttggctttcccttctgctttttctctgtctttactcagcataaattatcagaagattttaggtcatgaaaatattttttctcctttcttgctaagtgtgtcttcagagtaagcagatttttgagagagaatgtgctgccagaaaaagcatttaagacttgaacacagaccaaatacacatttgatctatgcaagg

SEQ ID NO: 121320 - DNA, 1105 bp, Homo sapiens
gttgggtgataggtacttagggttctttttaaaatctttttatattttggaattttctgtaataaaaagttaacatatttaggaaattaaaaaatgaatacaataaattcattggagaaaggatagttaagtagatgatgttacccacttggcaggaaataaaattagttgtgtctctcacactatacttaaaaattaatttcagatggattaaaatgtacatatgattaattccagatggattataagtgtacatttacaggatttaaaaaaatagaaggtataggagaatgttttataattttgcagttgggaaaagctttctaggacaaacatttaaaagtcataaaggaaaagattggcagttttgaataaaagaattctaaacttatgtacaacaaaatgaaaagacagattgcaacctaggcaaaaatacttgctgcatatatagtaaattattttattcatattatataaaaaacttctcaaatcaataagaaatacatataagttgtacaaaaatgagcaaagcatgtgaacagacaattcagagaagaaaataattcggagaaaaaaatggcttataaaaatataaaaaataatttaaaaattcagacaattcagagaaaaaaatggcttataaaaatatacaaagatttttaactttactaataaataacgcaaattcaaactcactccgtcacccaggctggagtgcaggagtgtgcgatctcagctcactgcaacctctgtcgcccgggttaagcaattctcctgcctcagtctcccaagtagctgggattacaggtgcatgccaaaatgccttttgtccatcacataggcaacagatataaagatttatattatccagtgttgatggagataatagaattaaaaaggcactttcatagtgttgctagaaatgtaatttggtacatttttagagacaaagttggtacctgtagtatctctcaaactttttcctacggactggaaataccacttctaagtaaagaagatttagttgaagatattttgtttattccactgtttatactggaaaaaaattaaaatgtccgaattctagtcagtaggaaaatagtta

SEQ ID NO: 121321 - DNA, 2057 bp, Homo sapiens
gggacttgaaccctctgaagccacagcactctttggggacacagagccaaaccatatcagcccctgagcttccaaaataccctttgcctttctttcccaaacttctaccctcaactccaatcaaaatgccatttctttactgaggaatgcagctagatataattaggagattatcacatcaacctaatttatgccaggctataaatgactgacagtgaggcagcaggaagtgttttgattttgaattccacaatataagtgattgatttcgtgttcaaatttctgactgtgtatataaccttctctttcacattgtatattaatgacatcctaaacatgttttcatgcaagggttttggattttgtcatgcaatcgtgacaaaggaatattctgagagctgcctgcctgtaaccagtttcagcaacattgctgtctttgttcagcagcatttgtgcaattatttgaatattttattgctttttcatatctttcttatataaatgaatgaacactagaaaaattactgataatgctggtgatgggaaattaggtcttatatagcaattcacttcagataaagatataaaaaatcaggtgagccagaaagaagaaattcttagcttcaagtggatactctctgaattaaagcccgtctagaatctgttttattggtaggaaaagaagcaaaagcaaggaactgtatggaattctggaaatctatcattgaatattgtatacaaaaaggaagatataactaaagatttttaatcctatattttagtttttgggccctgaaatccagtttctcatgagattcctacacatttcatttttttgtgtgttttcaagaaaacattttacacacaagacaggctgctgataaaaggttaggaaaaatgcctgggtttccttcaagctgtcccttcttcgaagtcattaattcttgccttagatcttttcaacaactggaatctaggtaatagctttgctgcaactactttagtagatcccaaagttagggccctgaaaaaccaagatacggcataggcctgttggctaggcactgagtgctacaagatgaggccagaggtctgcaaaccatcatcaccttccttaccttttggtgtccttacccatacacaattaccagatcctggaggctagctcactttgtgccattagttctgaagggcttggtcttattaacccaactgagaggagcttctgtcagaaacttaaatggaatacaatcaagttgaataagacttgtctctacctttgaggagttctcttttcatttcctttatcttacagtgatgggtgatcagataagaaatgaatcattcattgaatttagtgttgatgctcttttcttctcttgatgcttcttttcttctcttctttggctatgcctgcatttatctgaaagttttctatacgttttatatagaattaaaggtaaattgggtttattaacattttatatatgttttgtatagaattaaagggtaaattgggggattaaaaatttagtgtggcagcctttgctgttattgtttttatttgtttgatttttgagaaggtaaaacatttacgtgattcaaaaatcaaagcatataaaagtatatcagtgagaattctttatctcattcttgttttttatttctggaagaggaaatctaagtaatgactattcttagtttctcttaaatcctttcattatttttccatacacaaggaaataaaaatatattttattttaccctttttatatggatagtagtatattgtatacactgttttgcatcttgttttattcactcaatgtatcttgaagagctttccatagagaaatacttctttttgtaggtgcatagtattctattgaacgcatgaacataatttagctaatcatccgcctattaatgtatttgggatttttctaatctttcattattacaatcaatgctgaaatgtaaaaccttagccttttacatgtgtgcaaatgttatctgtgggataaattcccagaaggagaattatggaatcaaatatt

SEQ ID NO: 121322 - DNA, 1044 bp, Homo sapiens
agtcttttccaatttcttggctttcatatgtatggaaattacttctaccagacgtttttaggcccaacttagtttttcaaaaatttcagactgggtgctgtggctcatacttgtaatcccagtgctttgggaggctgagacgggagggttgcttgaggacaggagttcaagaccagtctgggcaacatagtgaaacaaaaaataaaaaaattagctgggcatgatggtatgcacctgttgtcccagttactcaggaagctgagataaggaggatcacttgagcccaggagtttgaggctgcagtgagctatgatcatgccactgcattccagcataggcaacagagcaagaatctatctcaaaaaaatttttttttaaacatatatatatatatatatatatagagagagagagagagagagagagagaaagagagagagaggtgtaatttctagttttagaatatttttcgtcatccccaaaagatttctcatgcctgtttgcagtcaatctctgttccaatccctaaccccatgctgctttcagtatctatagatagtgcctctcctggacattgcatataagtagaatcatataatatgtagtctttcacatctggcttctttcatgtagcttaaggtttttgagatttgtccatgttgtagtatgtatcagtagtttgttcatttttattgctgaatagtatttcattctgtgaatataccatacttgatttatccatttaccattgatggacattggcgcttctccctaatgattagctattacaaatagcaccgctgtgaatatgtgcttaaaaccattgtgtggacatatattttcatttctcttgggcagatacctaggagtaaaattgctaggttgtatggtaagtttaatttttaaagaaattctccagttgtttttttaaatggctgtacaatttaatattctcatcagcagtgtatgtggggtccagtatcttgacatccttggcaatacttgttactgtcttttttactatagctattctattggatatgt

SEQ ID NO: 121323 - DNA, 1033 bp, Homo sapiens
attggccaggcacggtggctcatgcctataatgataacactttgggaggccgaggtagtaggatcatttgagcccaggagtttgagaccagcctgggcaacatgacaaatccctgtctctccaaaaatacaaaaattagccaagcttagtggcatgcactgtagtcccaactacttgggaggctaaggtgggatgattgattaagtctaagtgggtgaagttgtggtgaaccatgatagcaccattgcactgcagcctgggtgacagagtgagaccctgtcttaaaatgaataaataaatatttgtaaagaaacaccatacttacatgactcattcacgaagacagactatattctgggtcagaatacaagtcacaattaatttaaaggattgaaataatacagattatataggaatcagtaatatctccaagaaaatctcaaatatttataaattaaataacattcttctaaataattcatgtatcaataaggaaaccataaaggaaatttaaaaatattttaaactaaatgataatgaaaacacagtatctcaaaattgtggggtgcagccaaagcagtgctcagagggaaacatatagctttaactgcttatcttagaaaagaaggaaagtctaaaatcaattaacaaagcttcaaccttgagaagttggagagggtgttggggggaaaagcaaactaaacacaaaataagtagaaagaaggacataataaaggtaagagcaaacatggatataattgagaagagaaaaccaaattagactcttagatgaacaaagtttataaacttgtagctagactgatcaaatcactggtatgacaaatgaaagagagggtataactatggaacccacagacattagaagggtaagaaaactggttgcagtggctcatgcctctaatctcagcattttgggaggctgacgggggaggatcacttgagcccaggagttcaagaccagtcttggcaacacaatgagatcccaactctccaaaaagagaaaaaaaagaaa

SEQ ID NO: 121324 - DNA, 1077 bp, Homo sapiens
aatgagagccaaatgctgtgctttggtaatctgtttaactgattttgagaaatgtggtggtatatttgaataaagagcgtcagaaatggcaaatattggaccggatatggtagctcatgcctgtaatcccagcactttgggaggcagatgcgggagaattgcttgagctcaggaattcgagaccggcctgggcaatatagcaaaaccttgtctatacaaaaaataatttaaaaattttgtcgggcatggtgatgtgctcctatagtcctaactacttgggaggctgaggcggctgactgcttttaagcccaggagttcgaagctacagtgagccgtgatcataccactgcactctagcctgggcagcagagcaaggccctatctcttaaaaaaaaaaaaaaaaaaaaaaaaagagaaatggcaaatattagagtaaatataaagcacaaattataacattgtcctgtggggtgtataaaatatatagatgtttgacacctttagtgtaaagaatggcaggggagtaatggaattcctatacatttgcaaagtttctacattttatgtgaagtggcatattaacttaggtagaatgaaaagttaaggatgcatattttaactctcagagcaactaattaaaaaaaggaaacccaagagataaacccaactagaacttctaaaacatatccaaatgacctgaagaaggcaagaaaaagggaacacaggaacgaaaaaccaggagagacagattgaaaataaataataaaataatagacctaaatctaataatatcaataattacattaaatattaatgggccaaacactccaattatgagacatagatgaacagaatcaataaatagcagggcctaactatatgctatttacaagaaattcactttaagtataaagacatagactgaaagtgaatggatggagaaaatataaatgatgcaaacaataatcataagaagattagagtggctatattaatattaggtaaagtagataatcaaggcaaatggtattaacagagacaaagagggatgttccgcaatgatgaaaggaccaatca

SEQ ID NO: 121325 - DNA, 1050 bp, Homo sapiens
aagtatataataaacacattttttcagtttcttcctcatgaagctagaaataagtaatatagatgtttataataagttttggaaccataactgccaaccctttttattttcacatacttgcaaactttactagctttttagtagtcttctaaatgttcataaatagcatatgagaatgtgaaataattaatgcagctagcaaggcctgaacagtgtaacttcatttcagtaatagacagaaatatgtgttttatgtatgcatattaaacacttacacagtgtttttgttcttgttatgctaaacagctaatgaagagaagtgatttcacattgatgtagcaagacagtctagaaaccaagcgttcattctggtttctagaatcctgttatctaagaagtgtacttttcctgaggatttataatgctttatgctgtgactttaaataatggtaaactgttaccctagattcctgtggtgaaagtcaggctgtgacaatcctgattttaaggaaatttcagaaagtgatatgggtaattgaggtaccattagattataagaaagggtcttgggagtacttcagtagaatggagactattataatgccctttgagaatatccagagtgaatagtggtaaataatccctattcatgagctcagtggaataagggaagccttgtctgacataaggaaggagaagagtgtgttctatatctaccaatttttgagtaaatatctctatttcctgtttcaggcaaaggaaccaaaagagttaagcagttcccaaagactcacataacaagataaggactgagtaacacaagaattatctggctacgtattgtctgtcctctggtgttgaattgtgtcactcacagcccagagaataatatgcccaaaattttcactgaaagaaattgagtttttagttgacatttcttataatactgaactggcaaatcctttagtttttttccagtgattatgtaagttatcctaaatgaaacaatggtccacctaagccctgttgtcctcattatgttcctcaagt

SEQ ID NO: 121326 - DNA, 1579 bp, Homo sapiens
tcagatattttatgccaccctagatgttttattgggttctagttgcttaaaaactttaactgtattattgcaatatcattaaaatgttgcacaaagagtaattctactgtatatagccctggaaggtgagaactctattcagtttaggattcttgagaggataagtgaggtaatcagaggttccattcctggctttacattaactagctgtgtgatacatctcggtgcctcgatttacccatctgtaagatagggccattagtaccttgcagggttatgggagggtggaggaaattacaagaaattgtgtaaagaaaaatcccacttagttcataataagtattcagtatttggtagctatcattatattttgtaaaattgaattttaaaatgtataaaaataaacgataatgtttgcaaatttccaagtctttattaaattacttaattaaagtttatggaaaacatcaaaaaccgggactatcgtaaagcaacaatttttgaatatgagattaattcaatagaacagcccattcagatgtgatgagaagtaaataattgacagagtgcaaacaccaaaatataagattttgattttaaaaagagatacccagttccacacacataaatgatagaacaagaataataatcctgttttggattattatactagccatcagatatttcagctaaagcacaaacaaaaaatgagatacaactatgtcttgtttaattatctctcagttgaatatttttgttctgagcttgcatttggttaggaaagctgggggtagttgtttaatgccttaactcacttcataagattcctggtacagtttgacatctttgtgtggtatttgccttgtctactagactgtgagctccttgagggcaggaccatatctttcttgtttagggctgtatccccactatttggctcagtgccttgtatacagtgggttattaataaatatttattgaatgaatgaatgaaaaaaaaaatctcctagtgggtgctagttcctgaaactgggcaaatagaactcagagttgggcagaaaagaaaaatgcacattctcaggacatcgctcagaattcaacatttgctaaatctcaactcttactggatctttgcaggcttttaaaaattgccctggagtttgtgctaaaaatgtaagtcacaaattgaaacaaaatggattcggtttgaatttttttctgaaaaatttaaatgcaatattagtttaatttgttgatgggctacccatcagcaagctgttttgataaaccactcaaagaatgccatttataagtgaaaattatgggactgtgttgcaaaagaatgtcatgtttcatcactactttgcttacataaatgaaatattttcccttaaggaaaacatagggaatatttttcttttctcttttctatcaagatgccattttctgcaagattttctctttgagaaatacctctgaatttacttggttttaaacatattttaaaaaatagaatttgtgtagcataatgaatattcttgttgctttttagtagtagctgctgcaaaataattattca

SEQ ID NO: 121327 - DNA, 1049 bp, Homo sapiens
gccgtcgagtcgccctcgcctcgcccgcaccatgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcggtcttctcgggtcgttcaagaagccgaggtaagacacgccgcgacgggtttctgcgggctaccaggaacaattaagccgatttggagagtgaagcgcggctcgctcccttctcctcggctgcccctagccccatcattgcccactccccaggctgagtgcgtttctttaacgccccttgccctttttgccgtcacctccgccctccagtctcccaggtttgaataaccacggcgatgccgagggcagggaggggaggaaagaactcaaatttttagtcagtttgctaaagccttaagggtaatttgagcgtagtccggggctgcgccagcctcgccttcacgcatccttcgctggagcgtaggggtaagaaagtaaggcatggaaacttcggggctccccaactcccccagaactttcatgcaaacttctcgcggagaaatcacgtagagaccgatggccccaggactcctcctccctcccccaggatgtcccaccgaattccaggagtctgcgatgtgctttcccaaccctggtctcccaggtaagtcatgagtcactcggtaggtgaagaacaaggagttaaatgaagtctcatttatctcttttctccccagatgctgttttgagatcgcaccactttcgttctgaggtaatttatttagcgcgcacgctcaaggtcagaagaagttctctttcctgagtaccaatattaattatatgcgtgttaagaaaccagtaggacactgaatgacgaacatgctgtcccctagccgaaagtggcatgtttccttttaagtgatttcatattagtgcccagcgaacggttttagcaaatttcttgtgtagtggagctgttgtacaaga

SEQ ID NO: 121328 - DNA, 1095 bp, Homo sapiens
acaggtagcactacatcatgtgcatatggctaaaggtttcttgataccgcagcccactgcagtgagaaactattcaacaattatgcagaggttattgaagaaaatcctgagagtttgcaatgtgtggcacatcaggaaaggaagaattctccaccgcattgactcaacaatggcatggtggagtaattttaaacaacaaaactgaactaaccgtgtgcagacattgggggaaataactaacagaattttggaaggtcatctttatgcttctcattgactgaaatttgtaagtgagctgaaatagcctacgtatccttgaacagaaacatgtcaaagacacacagaatagtattcaaattgccccaaacgctatatttttttaacaacaaaaagcaactaaatagctattatggttttctgagctatgactttagcacaactgttatcatcctgcgtcttgctgcagccatttataagtttcaagtgcacacaagaacatcatttatctctcttggcaggcaaatgcttaactgccatgcaataggattatagatatttctttttagatgcattcatttctgttctttccatcagttgtcttaaagatactaataataaacaaaccaaatccttgaaagaatttagtatttagttccattgttattttctgatttgtttgttgctaatttatcattttttccaaataacagcatacatagtattaattgcttctgtctgtgtgtttatgtggtgcctaatgcattgcggaattcaataaatactaaatcagccaagcagtgctttttggaagttaatttagtagaaattataccttgccttcctggtaggtttttgctttaaaaaaagaataattgacattgtataaaagtcacacacaaaaaaaattgttaagtttgaggatagggatggagggggagagccatggcccaaatctttcatacaaaaaaatgaaaattcataatggaaaagtatgtataatttgttgactttttttatgagagtaagttatcattgtcacccaaaagaagacaaaatagttgggaaagatagctaagagagtttgataccacgtat

SEQ ID NO: 121329 - DNA, 1032 bp, Homo sapiens
ttaatatatgatattaggccaggcatggtggctcatacctgtaacaccaggacttgtgtcaaaaaactgtttagaaatattatttagcaaatagatatgttgatgttgttaggagctaggattttcagtgagagagaaaaatgcattataaaatcagaggatctcttgagcctagaagttcaaggctgcagtaagccttgatagcgccgctgcactccagtctctgtgacaaagcgagatcctgtcacacacacaaaaaaatttatatatatatatatatatatatatatgcgatattaacatagtgtataatgggatagatatttcaaaaagaaatgatctcatcttttcatattataattgattagattaatatttgagagttgaatcactcctgatttttatgcataagcattgattcttggatcagaattacatattacattttgtgaatttgcaaaattggtccaaaagttattaatgttgtagaatacatttacttaaagcaaaaagcataataatctcattttgctctcaactttcaagatgaatagaaagttccacattaattaaaaaatgtgaaatagaaaacacttcacatgacttatagtcctcctaaaatagaacttgtaattgattttactcctctctaggcttaactctgaacctgtggtttgttttttgtttgtttgtttgtttgttttttgagaccgagtcttgctctgtcacccaggctggagtgcaatggcatgatctcggctcactgcaacctccatcttccgggttcaggcaattctcctgcctcagcctccagagtagctggggttacaggcacttgccaccacgcctggctagtttttgtatatttagtagagatgaagtttcaccatgttgtccaggctggtctcgaactcctgacctaagatgatccgcctgcctcggcctcccaaagtgctaggattacaggcgtgagccactgcgcctggcctgtttttttataaatatgagggaaggcacataattattgggggg

SEQ ID NO: 121330 - DNA, 1040 bp, Homo sapiens
gaaaatgaaggaagtaaaaacagacagtaagttgaaatgctgcctaatggaccttagtaaaacccagtagttttccctctagaagtcagaacactttggtgagaaagccatgcatttgttttgctcagcagagtgctgtctgagggttggagtgctcagaatgcacccaatcatttacagccatttcaatcttgatttgtcttcctcgagaacatatataactaaaaataaataatataggcatctccttcctccgtgccctatcttgctatgcagctggactaaaactagtagtccgttttatagaaatcattaagccagccactggctatttagaattatattggcactagtttcccgccacttttgaatttatttagaggggagtcttcagttcatattctgacctgagtactataaggggtcttttatgtctatacatttcaaaactgatatatgtataaagcaatccaaaacttttgaaacctatgaaagagtacttaggttttgttgtagtgctgtacttgcctttcaaaattttaatagaattcataatagagaacttatatttaaatacaaaggcagatgagacacctgtattacattttgatattaatctagtttccttaggtttggtgactttgttttttttttttagaatttcagaggtggcttttgaattcctgcattaggtgtgtcattgatttgttaaaattaaacataaatgcattgagaatttatgttttgatttgcttccattaattacaaaactcccctttttctacgtcttaattccgagacactgtgtttttcataatttggatgttgcttaggacattatttttcaaactatggattataatccattaatgggttgtgaaatcagtttaatgtgctatgaccagcactttttttaaatgaaataaaatagagcagacagaatagaaactgagacagtgcattgcatgtagtaagggtaaatatgtttcttaaaattttgttttagttgcatgtgtgtgtgtattttctagatcaaaatg

SEQ ID NO: 121331 - DNA, 2108 bp, Homo sapiens
aatgtaggcttgagttcacctttggtttaaaggagtctttaaattttatgttgaatgtagaggatcacttccgtctttgcatcaagagtaaagaatgtacaatcattgaatatctgacatgatacaacttcttactcttgttcccaaataaaggttcagaggtttgacagttccacatggagaagtgaattatatgttgtaagtgtaattacaatactagaagaagcctattaaaaattttccctttacatttaagtggcaccacttacatgacaataatagcttaattatatttcaaaatatattcagagacagaatctttacttttctctggaatccaatcctatatgtggctcctccagtcagtaatgcttattcagtaaagatgaaaaagtttgattttttcagataaaaaatgagtattgtgatgttacttcttcgtttttacggtttggatttcatagctcttactaacctaattttcccacttttagtccacttggtggcccaggagttattctgtgatttgtagaatacagaatctgaaactaaacacagcatgctgaaggaaaggagtgatatagatatggaggggggtgcaaaaatgggccctctcatttaaattttattgaaatatacataaaagtgcacaattcataagtatacttgttggataaagttttgcaaagcctcatacatctatgtaaacagcgcctaaatcaagaaacagaatgctgccataacaaaaacttcttatttaggtctgttgttcttatttctgtttagtaatatgatcctttattcaactactgtttttatatctttctttgaaattgcagattttttatgtgatttacttctaaaaaactaatagctgatgatgtgatagttcacagtgctgttctagatatgaaggtatacaaactgctgagggaacctatcgtaattttgctaacaaaacaatacaagagattcaggtttcagccaagattattgatatagtgtagcatcattggaagtcagtgaaatcaggatataatttcctaaatagcttcagtaccacatagatcaagtattaatactttagctgcagaagggagtcaggcagaaaatagtattatttggctgggtgtcttggggctgtgattggtttaataaataaaaagtgttgaagctcataatatgcaaagccgtgagttaagttccttagagctacaaggattaatttgaaatacatcctacccttaagggtcagtattttagtgtgaatgatgagataggaggtgagaagtatgtaaatagtccttagaggtagtagaaagttctcttacagaaagtacatagtgctgttaaaaaaggacataagacttgcagtttatcatagtagtagttagtagtagtaataagtagtagttaggatttatatgtgtttaaaagggcattttgagtagaagaaacaaggaaaggcatcagaatgggaaagcagagaggattatgtgtagtcgtgaaagattttttgttgttttttaaggtgggaggaggcggcatgggccaggtagtatagatcttgaatgttggattaaatttgaactataaaacaggcacaattggaaactatttgaaatgttgcctgtcaggactgcacaagtaacctgtgtccctgacttctctatatggggggaaaaatgaattatttagggtttcagatttatgctcaaatccatattctttgttttagagaaaactttggttgtagtaaactacctttttagtagaccatattttggtgtattgatatctctttccaattagtaggaaattggtgttttggcttagagaatcagttttctcataacaggaatgaaagctttttatttcatgaaacatattttaaaacttagaatattggtttaactgttttcctaaactgttttgccatgcttctacatgtgcttctgcccctaaattgtgtggtattgggaatagaattctttaatttttaaattttatttttatttaattttttatttctatttcagagacagggtctcactcttgcccaggctggagtgcagtggtatgatcatagcttactgcagttttaaact

SEQ ID NO: 121332 - DNA, 1013 bp, Homo sapiens
ggatagaacaaatgcaaataaaaataccttgtaattacaggaccatacgcagttatagttgttaaagatataagtagtaattataaatattataccaaattattttttcttgatatttttattataaacataacttcttttgagaaattggtaatttatttttggtcagtgttacaaagtattcacagatggggtaatagaggtagtccattttctcttaaggaagaaaaaatgtgttatttcaggaactcaggtaataaacattgatttaaaaatagtatttatgttttgaactacctcacaattatagtgcctgtacagccagttgtgtttagagaaccaagtataccccactcagttttcccatctgttaaatgggataatactgataattcaatatctcaccttgtaaagtaatttgggggattaagtgaaatgtacattaaaagctttgcacaaggcatggtacagggctcaataaatgttattgattcttagtcaaataaatggagtactaaatgttttacttccgtaagctcattatcatggaagtttttccatattcactgaaaattagctagtgtacactatttgtgtataagtaatcttttcctttggggtacatgtctgtccttatttttccactcaatctctttgccattttagtgattttcaacatgattccccttctcattctactctgtcacttaaagctcagtaattatttgttgaatgtataaatattctaaatgacttctgttttttctcaattttggattttctgtgatactttttttttttttttttttttttaaagagatagggtctcagtcttgcttaggctggagtgcagtggcgtaatcatagctcactgcagccttgaactcctaggctcaagcaattctgctgcctcagcctcccaaatagctgggactacaggcacgcactactgtacccagctaatttattttatttttgtagagatgaggtctcactgttctgtccaggatggt

SEQ ID NO: 121333 - DNA, 1030 bp, Homo sapiens
gttgtgaggatgaaatgaggtaacaaattataacttcttataactacaaaccataaagtaggactatacaactgggaagttttgttattcgtggacagtgaatgacagaattttcagaggtgcctaaaatgactctaatgggggagttttagattttttttcttctcagtggaactttccttaagttctctttgccatcattagcttcttgcatatcttgagtagaacttaacatatcttgaatgggatatttttttcttttattcttatgagtggtctcacacaggaccaaacagcaggccagcatagcaccacgtgatctgagcttgtttttactctctcctttttcataaacagagtcccagattaatgccagtagttgattttgggtctttggggtagtgaagcttgtggatttgacttctctgattccttttgctgaccttgagtggattgtatctttcactgttaattataataatttaaaaattgagttctacttactggacatgaatctctgcacttgaaagttaacatattaaaagcatattttttttcttccttggttttcttgttcatgtggataacccagagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcat

SEQ ID NO: 121334 - DNA, 2976 bp, Homo sapiens
aactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaacttt

SEQ ID NO: 121335 - DNA, 1850 bp, Homo sapiens
caacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgactgcaaccgccacctcccgggttcaagcaattctgtctcagcctcccgagtagctgggattacaggcatgtgtcaccatgacctgctaattttgtatttttagtagagacggggtctctccatgttggtcaggctggtctcaaactcctgacctcaagtgatccgcccgccttggcctcccaaagtgctgggattataggcgtgagccaccgcgcctggctgtgaaattttttttttttttttttttatgtgaggcatattttgccacagtctcgcactgtttaggttctcttgtcttttggaatctatcattctgtatttaatgttagtggctagtccaataattgattgtctcatctgtatgcatcttatgcatgtgattcaatagactagatcgattctgtgtggtttatcatagtagatacacaaaccagtctttattttttacttaagaaaatatataagtggaagttatcagtaaactggtgattattgtattgaatgcaaatctttttattatttttccagatatattgagttttataaaccattaaaatattattttatgaaatttcccttcctggatgaacagaatattgttttattaaatcttctcttattagtggaatattttttacttctttgtcttttcatttacttgttttttgttataatgaaaactttactagtgtttggtaccattgagataacttattactggaaattttgtttgcttcctgtgggatatatctggaagtggtcatagtccaaccatgtccttttgatgttgttagcatatcagttattctatgtattgatcttttcttctcctgtattcaacacctctttctgaaaggatgtctgatcttcccataatcgctttgatgtagatgatatttttattctatcagtgtatactagacaggattttgatgtggctttgtatttgtatatttaaataccatgtctttaaagcattattagaagagatattctagtttcttctaatgtcccttttaaaaaaaatatagccagtccaatatctcaaactactttgatttttgaacttaaatcaacttttagtgctaccttgtttaatggtagtagtattttctcatttctacatgttcacacaagtttattatatatagtttatggtcatatgtatcttataaaaattttgaagcccatccccatggatttattataataca

SEQ ID NO: 121336 - DNA, 1344 bp, Homo sapiens
aagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaa

SEQ ID NO: 121337 - DNA, 1157 bp, Homo sapiens
tggtttcagaattataagaaatagtctttagggggaacagaaatgaaggagactaaatagatgatgataaattatctgtgaatatgtactggttcctacatattcaaagtgtgctaagtttgtacagccattacttgtaaggttctaggagttgtctctctaggggttggtttgtaccatagtccattatgtacatctagaacaattctttctttcccggaactgagcccaaggtgggctttctacagtgcacctctggctctggggcagctcaagcaatcagaaagaactgaggcactggtagaaaacaactctgaggatgaacaggataatgttcctgaagtggaatgtggtatcccttcatggttaaatggttgcatacttcagggtcacctatggaaaggtgtcctcagggtagctaaaagtggttaatttccttgtgttttgacttacagatcatttctaggtggacttggggaaaataaagttacttataaaaatattgcttcattggcatttggaggtgttgtattgaaggaggaagtgggttcctatcaccagaaccctctctaggtgtttcagataggaaactgggttgtagaccttgtcccagtaatatctccagcagctccaacacattttgtcaacttcgtattcgttttttaagtttttttccttgctgttggccacctttaccttcttttttttttttttccttctttttcccttattttttgagacagtctcactctggcgcccaagctggagtacagtggggtcatatcggctaactgcaacctccacctcccaggttcaagcgattctcctgcctcagcctcccaagtagctaggattacaggcgcatgccaccattcctggctaattttttgtatttttagtagagatggggttttgccatgttggccaggctggtctcgaactcctgacctcaagtgatctgcccactttggcctcccgaagtgctgggattgcaggcgtgagccaccgtaccaggccccattcccacttttacttttattttctctacagttcatccttttttttttttttccttctgtgccagaggtggaacagtggcactcagggttaaaaaactcccttttgctttgtcacacttcatattcagagttactgtg

SEQ ID NO: 121338 - DNA, 1032 bp, Homo sapiens
ttagtagatacaagatttcaccatgttggctaggttggtcttgaactcctgacctcaggtgatccacctgcctcggcctcccaaagtgctgggattgtggttgtgagccaccacgcctggccgtatattttaaaaatctcttaaggtccagttactgttatattttggtcctgtactgaaggaggatgtaagtcattttcctaaaatgatttttatagagatagatgttggcagtttactcaaaagagaatataggaaaatcttttttaacaggtttggtgggactagccttattcactgaataaagtactttacagaatggagtatatctatatgtgtgttttaagatttgttcatacaaagcagatgttctgtgtactttgtatttgtaaacaactaattgggggtgggaaggagattgctttgtaaaaagagggtttccttgttctaaagctttgctgctggagatggtaagatggtaaataaatattgtactgttatgctgcgtttatctcttctgctttatctgtatttgcatataaaattcttgagaaaaaccattgcttttcaaagtgttatttgggatacgggtttgagttatataagttgagtagaaggggcttctggtaaacagaactttggggggtggtgcaaacttcagaccaaactatgaattgaagctttaggatgggcaataataagcggactttgaaattgggtttttatgaagtaatccatttgttgcaggaattctgttcaaaccaaatgcgctagtcagataccgtgatgatgtgcaaagttaattcttttgcagttggttgttcctttgagctttctttgaacttggagtcccttacatataagatagaggtgatgaaagaaatagtctccagttggtactcctctggatcatcagtgccagctgatgttcagggagatattatgactgtaaataaacctgccttggattgttttgtgtatatcccctcaccttattctttaccttcttccctcctacaaattgcatctttt

SEQ ID NO: 121339 - DNA, 1033 bp, Homo sapiens
cttggactttttgctgtaactctaccaggatacattaaaagataaacgttgtttagaagtgttgctttacctgtgtatgcttaactttcatggagatgtttcgtcaggtgtaaccagtatcctcaatatggctatcatttctaggatacaaccgaaatttgctctgtgcatgttttacctaaaattttagataaaaatgtaaagaagtatatttgagaatgtaagaatttcatagtgactgaaccagaatctgcctttaggcttcttctggctttacatcctccttaattctatgcaattctgggtatggaagaaaactaatgcagaaattgatctgaagtattggcaaacagaagacctccaattttcccaatatttttcctaaggctttcctgtgcttctccccaacactgattggctagcattgatagcttattcactgtcggtatggaccctttaatattatgtgttttatttaaagacattagtccagggtgaccataggaaatacttcaaggaggataaccctgaagatcctatagctgctaatactcaaaatgaaacttaaaaaaaataatgatttttgccatggatcagagccaattcaattctagcttgagaagtgaattcaggtcatatctgaaagccttacctttgttagaaattaggtccaaagacctaagtgataattcaagttatgggctttgtgggagatggcaaatccagcctaaggaaaggagttctggaattttacaatttcacattaaattacacgtcagtatgtggcattaggggaatggtagaaattctcagtgctaagaattgagtggcccctttaaccagctaccttgacccccaaagccaagatttgtaatggaaaaatattgtatgggcagggtgctgtggcttacgccacagcactttggaaggctgaggctggcggatcactcgaggtcaggagtttgagaccagcctggccaacatggcgaaaccccatctctactaaaaatacaaaaattagccgggatggtga

SEQ ID NO: 121340 - DNA, 1051 bp, Homo sapiens
attggaacactgctacactcacttgtttacatattgtctgtggctgctctcctgctacaatggcacagttgagtagtggcagtaaagagtctatggcctgcaaagccataatgaaatattaactagcctttgtggaaaagtttgttaccccttggtctagatggcaacaaatgctttacactggcacatattaagtgctaatgagttatgttattaatattactcagtgaacaaatacttactaggctccttctgtatgtttcagattaaatatggaaaatttgaaacaatacataaaactttaaaaatgaaaataatcctttacatagaaattcctagaggtagccttaataacttttaatacatctattttcaggcttttttttcctctgcagatacagttgcacatggatttgaaattattctttgtttatattttgcctcatttgtttaatacagtttggcgacctacttgatatccaaagtatatttccacacctttgaaaaatttggttaatgtttttaatgacgtccatcaaatgtacataccataatttacttaaaccataccctgttgttaggggtgtaggttgtagtaaattttgtgcaataacactggtatacacatcttagagcgtgcatttttattttgatgtatttctttgtcatacatttctagatgtggagttctggggataaaaagtaatcagtattttctgatcactaatgtgtcaaaatccttttctcaaggaaaacagggtagtaatcttaattgagttttttcttaatgtcttcaggaaaaaattgattttcagcatgctcatgggttacaagaattggaatttattcgaggacattctgatacagaagcagcaagactgtgtgtggaccagtggctaaaaatgccaggtattctttagaaattacactaaggttacctagcttccccaaagccttaaggcagaaagtacgtctgttttatgctattgctaataagcatataagatattaaattttgtttcagtgatactaatatcacctcataatggcc

SEQ ID NO: 121341 - DNA, 1037 bp, Homo sapiens
accagcctgggcaacattgagagaccctgtctctacaaaaaataaaaatattagctgggcatggtggcatgtgcctataggcccacctgctcaaaatgaagggagtaggggcgtaaccttctaatgcatttggtctttaacattttttagctgttgagcttaaagaaaaggattttttttccctaaagggaaaaaagctacttggagctgggcatggtggcgtgctcctgtagtttgagcgacagcaggagaattgattgagcctgggaaatacagcaagatgcccatctcaaaaaaaaaagagaatgctacttggtgatattaagggcttttttttggtcataacttatttacttttaggttattatatcttttataagagaggttttaaacaattataattagcatcatccagttgatgctatgtcataattttcattgttttgtcctaattttgatcactagcccaaaggataagtatctgaaataataacctaagaattcatattctgatgatgcaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggtaagtaggatattcataatagtgaatgctgaagatctagtgagctaccaagtgatttcataaaatgaaagcgtaatgctcctttgccattatgattatatagctttatattccaaactcaaattattttgtgccattatgatataattttttcataattgatgaagtcagatttttctagtgggtgtagctttcagctttatgggtatagcttttaaatatttatttttccctgatacagcttataaagttctaaacagactttctccatcaaaatccagataggttagttttagagaaatccagcccataaatgtaaatttcaagagacaaggagcgtgtacagacatttggtctagcctgaa

SEQ ID NO: 121342 - DNA, 1025 bp, Homo sapiens
aagtgctgggattacaggcatgagccatcatgcccagccctactttttttattgtacaaatttgtatggtgtcttttaatgtaaccagaaatatggtaaaaaggaattgagcactttaacttatcagatatcttatttcccattccttttcccagtttgtagaatgtatttgcagctatgccatatatatatatatatatatatatatatatatatatatgtgtgtgtgtgtgtgtgtgtgtgtgtgtgtgtgtatatatatatataaaattttttttttttttttgagagagaggtggtctcaaattcctgggcaaagcagtcctcccacctcagcctccttaagtgctgggattacaggtgtgagccactgctcctggccaagtatgccatatttttgtaataagtatattctaataaaattttatgtagaatcacattttggttctgttgagcaaatcatttaaacaactttatgtgagttcatttataactcacaattaaactaaaaatgatttaatgagtttagggttcttcaagtaggagaaatatgtataaattggtggttactaaatgcctttattgctcttatcatttagaatcttcaaattggaatgaaaatgtcctcctcggtgttatttcttctgtgtggcactcatcaaattaaaacaggaggggagtgtggtggggagggagtagtgaaagcagcatataattcataaccaagattggaaagctgggtttaaatggaagtttgtcttttctatggaggggtacaacttgggaggaggggtaagttggttgacttatcagaacttcaattttctcatttctaaacaatgaaaatggtacctcatgggattattatgaggattaagtaggtaaacatatttagaacctcagtgtggttcctgacatgtgctcggtataaataaaaattttttatctctcttctggttgcatctcataagcactacacaaactatactgatggttctagtgttaatgatagtaaatatgaggca

SEQ ID NO: 121343 - DNA, 2298 bp, Homo sapiens
ataaagtgcagataatactcaagtattttgagatgatagaacatcattatgtcatttgcatctttattgaaaagtatcttttagtgcttatttatacgttggttattttataattcctgcaataaaatgcagcaatggtatatttagaaaatacttctgaaagactttctatttctttttatctaatttagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatataggtatggctttatagctctatgcaaatttcatatactgatattgaaacttacaatgtacccacctcgattcaattttgaagcaagaaacagggtaacttcttgatggtatgttaattattatggtatatacattttaggggtttgtattcctactactacatttatccactttctaaacttacgaggacagagtatatgttggctttaaataatatatattttagatatcattttattttacaaaaggtgtggagattttgaagatgaaggaagttgatagtttttctgaaagttagatttcaaagttatcctagtattaatatcatttagatttttcttgtaatatttgggttaactaaaaagataaatcacgtgaattctttttgtttctatttggccatattctttagtgtgagacattttaaaggtcatttcagcatttgtatatttttgttatgattaacttggaagaaaagctttaacatacaattaaaatagcaatt

SEQ ID NO: 121344 - DNA, 1050 bp, Homo sapiens
gggagggagaatgagagttggggcatgggggaaggtgaaagaagaatctgagagaaccaagaagatgtgtttatagggggaggtgtctctgtaccactggcacatatttctagcactgctttatggcagcaggattctaggttatcttatttctgctctctagggtgtttaatcctagaactagagggctactaataaatcagtccagactgggaaaagaaccaaattctggtggtgaaaatgttcttaataggtaaccttggaattttatatgggtggtattagtttttgcttatttaaccttaaaacttggttttctagttcttctagtacattaattttttaaaaaaattccttgtataagtgactttttaacaagctttagagttgttggaagaaaatgtttgcaagaaggatatataaccaaaattggtgaaatgttcagattatttttatctgatttaagtgtaaatggtgtcatgtacagatttggatttcacaaaaaggtttagatagaaatgagtaacattcaaggttagtatttttgcatattaggcttctaatactttttggacttgaaatcagaatgattttagcaaattcttactgaactcatgttgatatttctctcttctcagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaactttttcccacctcttagaatatagttcagtttaaaaggctcctcttaaaccttcctggatagaacataggaacataattggaatattgttcttttgtattatagttactctgctagaatcgttttctttacatgcctctgtggtaaatgttagctctatctggtgactcaaagtttatggatcttttggccgggcgcggtggctcacgtctgtaatcccagaactttggaaggctgag

SEQ ID NO: 121345 - DNA, 1016 bp, Homo sapiens
gtttacagagaatctgctattgtttgtgtttgataggaaatagcatgtaaagagaaagattgggattaaagatagaaacatactgacctggataagttagccagtataattgctttagtaagttgagctttggtgattgcccatcatttctgcattgaacggtggtgacatctgtaaaaaccacttatgcttacacttatagaataatgccattcaaagaatttttacacacattgcttttgattttgcctaatatccatgtgagttttaagatgagttgacagattcagggaagttggtccactttctcaagactttaaagcaacaagatgttgatgcttatgctaggatggagttcttccacattctgatctagtactttgcctctagaaaaatttttttctagtatgtgttttttcttgataaaatttttggcctttcctctcctgtttgattatcatttttgccttttctaaaattaataggaggaaacaccaattggaagcctccgctcaactgtaagatttataactacctgaacaggattggatgcttcttccttcatcctcgctgtagtaaaagaaaagatgctgctgattttgccatatgtatgcatgtgagtcattgttttattcaaaatctaatgtgaatctcagacccacttgcatttttttccccacttgaattgtaatgagacttatagatcattcttcagtacttcaggttctacctatgactattatgaaggcaggaccccatagcatatttttattgctttatcctcaacttctagcaaaccttcagctatccatagtagaccctcaactatttgtgggataaatgatcaagagctgatactgttttttgggtttgtttttgagacagtctcgctctgtcacccaggctggagtgcagtggcgcagtctcggctcactgcaacctcagccccctgggctgaaatggttcttgtgcctcagcctcccaagtagctgggactacaggagcataccaccatg

SEQ ID NO: 121346 - DNA, 1152 bp, Homo sapiens
aactaaatttttaatggcctgtgacattttgtcatttcatggagttgcctttctgtttaaagtcttatatgtatcacctcaagtcttttagcaaataagtgatacagatttttttttaaatgttgaaacaaatgattacctgtcagtgattttaaaagtttgttgactttctacattcctaagtggaattaacttgcaagttctaagttcatatataaaattcaattcaagatcatgtctagattttcatatttcaaaatactcaattttttagtagagaaactgccaagttatcctgtgtttttccattttgattttactttccttcttgaaaagaatacagtcgatgaaacttaaataaatacagcacatgttgagttttctgccctaagtgttaaaattctatgttttttaatgcagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagactttt

SEQ ID NO: 121347 - DNA, 1054 bp, Homo sapiens
ttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggatt

SEQ ID NO: 121348 - DNA, 1917 bp, Homo sapiens
ctacgttggatgaaccttgaagacattatgctaaatgaaataagtcagtcccaaaaagacactattattccatttatataaggtagagtagttaaaatcataagagacagaagatagaatggtggttgctaaggtctgcagggagggggaatggggagttagttactgtttaatgggtatgagtttcagttttaaagatgaaaagagttatggagatggacgggggtgattgttccacaacattacaaatgtatttaataccactgaaccgtatgcctaaaaatggttaagatgctaaattttgttggattttactacaattttagagaaactgtaaatacttgaaaatattactgattttactaacaagctggatgcaacaggtaactcaggcgtgtcagtggcaatcactcttttccctcaatttatacaggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataatt

SEQ ID NO: 121349 - DNA, 1005 bp, Homo sapiens
aaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtgtgagccactgcccccagccaagtattttttaaagttatctagatgatcccagtgtatagccaaaattgagaatcactagcataggatattggctttgacacttacctgattgtaaaatcacttgggatgtatatccatttgagttctccaggaagtaagtatcaagatggaactaaaagtgcaagagatttattggggaaaatgcctgagaaggataaagaggctgcaatgctagttttttatacttgtgaaaggataaagaaagatggggtggaaagagctccagactgcagtgcatttctgaaaaaatctcagctagtctgatggggagccccagaccaaagaggatccatgttgtgcataattgtcccaactcaagtggcactgcctgtttagtctttacccggggagaatgcggcctcaacaggagtggacagtgcagtggatcctgaaggtgaggtagcagagactgccaggtagcagctcatgaagggagagctaaacagcaccttttatgcttgttttataaaccagattccaaggcttcctgtgaaatttctgataaattatgcctgaggcagagacccagaactgtactttaacaagtacttttaggtgattcttatgatcactcaggtttgtaaagtaccag

SEQ ID NO: 121350 - DNA, 1015 bp, Homo sapiens
tcaagaaaataaggtaggtgtccgaagcggggcaagccctttgaggacactggaagtgtgataactctgtaggcgaaactcatgcggaccgtcattggccgatttctcttttctagagttcacgatctaggagatcctgctcgtctctgatctccccactgccctcccgggctcccttggaggcgcctggaaagctgagccgccgccagccacccgccagaacaggggcggggcagggccgcgggtccgcacagagcatgcgcagacgaagcacggcgcatgctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcggtgggtacctggaattgcctggtgggcgggaaagaggggtggagcgagggcggcgctgcgtccccagtctggccgaacgttcggctttttgcctgccccaagtcccgactggggaaggggcgacccgggctgggccagacaccagtaagggcgt

SEQ ID NO: 121351 - DNA, 1039 bp, Homo sapiens
aaaaggttttagtgactgattgtagggggaatggagagagaagagttataaatgacacccaggtttctagttaggaaaattagtggatggtggtaatattttgagatgtgatatgcaggaggagaagcaagtcttggaagacgtagagtttagttcttaacatgaatttgaggtgcctgtggagatgtctagtggacaattggatatacaggtctgaatatacaggaagacatgtggtgggagtagatttagcagaaggttggaatcatcaggagtaggtaagagcaccctagaaaaatatttgagtgagaagagatgacagtggaagttaagacatgaggaataccaatattgaaggtaaagtggaattggaggaatttgggaaggagaatggaaaggagctttctcagaagtaggagatgaaccaggatagtagtgtcatagaagccaaggagggctagagtttcaataataatgatcatgatattaataatgataatagggaataacagcagatatttatattaatagtatgtttgctatgtaccagattttgttctaagtgcattacatatattaacccatgtatgtaattcatacagcagtcttatgaggtgggtattattatcatccctattttacagatacagcctatttattcacagactgaataacttgcccaagctcataagatggtaaatggtggagccaagatttgaatctgggtattttgtttctgtagtggtgcttttaaccacaatagtttcagaagcttaagatagattatgtaagatgaattgtacagtgtccattggatttagcagctggatgggcccttatagataggggcagagaccagaacaatgacagtggttggagaaggaaggtggagcggtggatatagaagatgtacttttttaaaatgtgtagctgaaaagagaagagaaatagggcagaatataggggttgttttagggaaaagagaagatatacaagcacacacttgtacatatatgacaggagatacttaaacatgttt

SEQ ID NO: 121352 - DNA, 1032 bp, Homo sapiens
gggtctcatgccattacctaggctggagtacagtggtgtgatctcggctcactgcagcctcaacatccgtgggctcaggtgatcctcccacctcagcctcctgaggagctgggactataggcacatgctaccatgcctggctaatttttttgtagatatggggttttaccaacttgcccaggctggtctcaaacttctgggctcgagcaatctgcctgccttgacctcccaaggtgctgggattacgggcatgaaccacgacgcccagcccctattttctaacataaaatgaatattttgcagttacattaaatgcatgaagtattttatgttatttaaaaataatgcagctagtctcgaagcattcttgtatttaatctttttaatttttaacaccccctataccttgtacccaacccatccttagaagattgtgatatgtggtattgatattctccttaccgtgatagaggacttgcatgtttttaactgctgtccattggcatcttgctgatgtttgaatattgttttataaacatttcttagatttaataattactggatttttagtttgtactcataatttctgtcttcatttcagtgaagaacttagacgctggttcattcaacaagaaatggatctccttcgatttagatttagtattttacccaaggataaaattcaggatttcttaaaggatagccaattgcagtttgaggctgtaagtatatttttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatg

SEQ ID NO: 121353 - DNA, 1175 bp, Homo sapiens
ggcctgattatttttctttttatttaccactcctcttgagacaggtgtgtgcacatgcacacatacataaagaagatctacggttttggtggtatttatagcagggaaaagagatgatttatttgaactttttagtagattactatcggtagtcttaggaaaagtctattttggaatttcactgcctcttttttatttttttattttttggtgagaggttgctagagcagaggggctgtctccaagaccatgtcttcatcagaaactggggtttaatagacgttagaaatggtatatatttcttccaccatctcttaagctcttctgtttattacctgacttttgtttatcaaattccagagttgcttacttttgttttgttagctaataggggtgcttcgggtgggttaagagaagaaatacttttttcaaaagtcaccatcattctgtgtgagagagaatgtaattcctatagagaaaagtaattagttagcttggtgtgttgtaatggcagctttgctatttttttgtactctttctctttcttcgtttcacaaagaaggttgacaagctacttacctttctatgaatgcttttctttaaaactatataattgaatgcctagagaaatgaaccttggctttagcagtactgaatggcaaaagtggaaagaaactcatttttcccttccttccttccctacttctctttctccttccatgctttccttccttctttccctgtttcttaaaaaatgcgatttgaatctagtttgggtaaagttgacctgtggggagttgaatgagaaaactgaaattaagtatttttcttctgagtattgtgttaatttgctccaaatgacagaattagcctaaatgttgagaagtgctaagtttcagcaaatgaaattgagcttaatttgtatttctttatgtttactgtgtatgtggtaaaattagataattaataaaggtttaaagggattctaactgataaactcaccgtttcaccttcttaaacctaagaagcataatttgcctaaattatgcaaaatgctaattaaagggtttaatttgctaatcatatccatttgattagaggcagatgctgattatctgcacaattctaaatggacctttcaaagatggctttcattatttaaaatcaacttgtca

SEQ ID NO: 121354 - DNA, 1048 bp, Homo sapiens
agaaaacatagaaatggtccatcacccttgggtctactcatctactgaagaaccatgacacaattatatatgtaagcaattagtaataaaatatcatatgtttataagtataaaggagacatacaagaaaacattaaatgttcatctttccatacatgtctgtcttcatgttgcattagtttcaagtgaaatgtgtttttttatgttttattactatatactataccttttcatccaaagaagaaataagagattgtctcctttattggaagacatttttgctggatgtagaattctaggttggcatgtactttcttttagcacattaagatatatcactctgctgccttctggcttctcctcttgctgtggggaaatcagctgttagtctaactgtagctcatttgaaggtaagacagccaccctgctcttagtctccttttaagatattctatttaatttacttttgtttgatttaaatattctgtttgtctaggagtagaattctttttatttatcctgcttgagtttcaccagcgttcttgaatttgtagattggtgtcttatattaattctggaaaattctcagccattattgcttttaaacttccctctacctgttctttctcctctctgtctggtgtgttagtcaactgtattttaggtcttcttagtcattcacttttcatcctcaggttgtgtcttccttctttttgttctttctctgctgagttacagattattttttctgaactatttcccagtttgttatttctatattctgttttgtctgttctactcccattgaattttaaattttggctactgtaatttatttgttttttttttttcacatctgctatgttgctttttatggattcctattccttgcagatattttaatatttgcttttctttttcaaatttgttgtaggttgctttttaatctgtctgataattctaagagttaaaatctgtgtggtctgttcctgctatggtttgtgattgtctttcacccatgttgccttatttccttgcgtggttggtt

SEQ ID NO: 121355 - DNA, 1028 bp, Homo sapiens
cagtaaacatttcatcaggtattgtggtaagaactgggaatataggctgtgtgcggtagctcgcgcctgtgatcccagcactttgggaggccaaggcaggaggattgtttgagctaaggggtttgagaccagcctgggtaacataatgagacccggtctctacagaaaattaaaaatcagctgggcatggtggcgcgttagcacgcctgtaatcccaggctatttgggaggctgaggcaggagaattgcttgagcttgggagatcaaggctgtagtgagctgttccagcctgagcagcagagtgagaccatatctcaaaaaaaaaaaaaaaaaaaaaaaaagaactgggaatataatcgttatgacacatttacctgtgcttaggttcatatgttagtgagggagatataaatgcttatagtattgtacataaataatataaaaaaaaactgtatcttcaagcagacaggtatgtaccagcatggaggtgggagtaactatgcctaaggaaatctggtgcaactttgcagaggtaacctgttagttgcatagaaatttgccagtagaaacacagggtatagaaagacatttcagatgtgggaaatatgtgtaaagtcatagaagtgaaagaaagacatggtgcgctataggaagtgcagataggttggtataattggagggcaaagtattttaggggaagaaaattgaaactagaaagagtttaaaggcctgggataaaaaggaactttgatggacacaaagagcctgtgtagtggggataatggagtaagtgagcaggaaggacatggagatgtggttggggaaaatgtgtgagggtaggggtgatgcgttgcttgtgaattgtgctgtgatcgtgggagtgggctgcagaagtggagggtgagtgggtcagaggatgctgacgactgtgaaactagtgttgactggatcatccatatgggtgtagcagtccatttggacagtggcaagaaagtggatgttgtgatgtcgacaagatttggatttgg

SEQ ID NO: 121356 - DNA, 1100 bp, Homo sapiens
tgctgcatagacatgtagaaagatggaaagaatctgagtccttgttgctgtcgttgagttgctgaattaacctattctggaaccaccaaactttttattacatgggataatgaagttttaatttttaaaggcactaacttaggtactcatatttgagtggaattctctttctctagtagcagaaagcatcctggtacctagatcagtgtctgcgttagttagtattttcttttctagttgcaggtaacagcctatgctacattaaccaataaatagaatctgttagctcataaaagtgagaagtctagattatagtatggacttcagacatagcttgcccaatgtttcacccctttctctgaatatgtctttacccttatgtgtatgccttatcctcagtctggctttctgatggttgcaaaaatagttaccatgggatcaggctttatttctatatagcatactatctgaaagagtttctttgtccctgggcagaagtttgaaatcaaggtgtcggcatggccatgcttcctctgaaggtgctggggaaagatctattccacatctgtcttctggcttctggtagttctttgacttgtggcaacataactcaagtcttcacatggcattcaccctgcatgtcccaaattctgctttttctaaggatatcagtcatattggggtatcatttttctaaggatatcagtcacctctcaactccagtgtgacctcattgtaactaagtacatctgcaacaatcctatttctaaataaggtcacattctgaggtactgggggttagtacctcaacatatgattttcttgggacagagtttaacccatatcacatgtctatcactaaagcagctattgtggtttaagggatagcctagcctaagatcatgtgtctgcccctttagatggggtatcatgggagctgagagtcagtgtgttcctgaaaccacaatatcccaaacaaaaatggatgattgttaggaatggggagaggggagaatgaagatggggaggcagacaacaattgtctactacctagaaaagacactgaatatgaattaaatgtacaaagtttttcactttgt

SEQ ID NO: 121357 - DNA, 1027 bp, Homo sapiens
agctatagccagttcttttatttaatggtttatttttaaataactttttatttgttcatccatgcataggtttgggtactagagatactacttaacaaattagatgagatttcttctcttacaaagcttatattctagtgggagacagacaattactgaagaaataaacaataacaatattgtaaatgacatgaaggagccagctgaacaaatatagaggaaactgcattccaggcaggaaaagtcactaatgcaaaggcccccaaagggaggaatcttggcctttttttttagaatcaaaaaggccagtgtagctagagcatagtgagctacggtagagtgctaccatgtgaggctgcaatggctaggtgtagactctgtgagactttgaggtagagtcccagggtaaagagtttgatttttttttagcctaatgtagttgaaagacattggatgattttgaataagtgagtgatatgatctgatttatgttttaaatagatgactgtggctgctgcttgaaagccattttggaggataaaaaaggaatggaagcgggaggactagtctggaagttttcacattaatctagatagtggcttgaaatggattggttgtggtgatatgactgacagaagtcagtggatttcagttagtttttaaagtaatattgacatggtggattggttgtgagagaaagagaagaatcagcataatgatgatgatgatgagagcttaagcatagtgaaaatttaatatttgccaagtgctattctaaatgctttatatgaattaatgcatttagtctttatggtaaccctataaggcaggtaccattatcactctctgaggcttgtagtatctttatacaggtagtgaggagcagaagcaggatttgaatccatacagtctggcatcaaggtctatgttcttgaccattatattacactgcctagaattttggcttgaataatttattagggggtgatgcctttgccaagatgtagaagactccgagaaaaatatg

SEQ ID NO: 121358 - DNA, 1045 bp, Homo sapiens
tataaaaaactgtaggcttatagatattgtcttagtttgggctgctgtaacaaattatcacagactgggcaacatcaacaacagacttttgtcatcattttggaggctggtgggggcctgcttcctggtttgcagatggctgtcttctcattgtatcttcaaatggttgagagcagagaaagaagcagcaaactctcatgaccttattacctctcaaaggccaatggatatatttgcttgttctattattcatggtagtacttagcaaagtgttttctaagaggctgtctataaaacttaccaagcaggcctcttcattttgcccatgaacgtctagcctcagaaaggttgagcggcctgcaagaactcacattgctcattagtgaaagacctgggtcttttgctatatgtctctcgaaactcaagttcattgcctgttctactatagtttgttgcctctcctgctttctctgatttaccctcaagcaggtgtttccattgcatattttaaatacttcagcagctccagggtacagattgtgttatattcaacttagtgatctctgatacccagcacaatgccttatggagtagatgctcaggatctgatgaattaccttgtgagagctgcatgtttgcatactcttgatttgttgagaaaactaaagtaacttggggttgcacctcagtgtactgtttataaaagcaaagattaaactgtatacctgataatatgtgtgaagtgctgtacatgcagaatatttctgaaatcccaattgcaaatgtttatgaactcggaaaactcctgaagaactgttgcagttggctgcagtagttcaagctgttattcactggacagtttttctctgcagtatgtaagatgtgaattttatattttgcttcaaaatttatgatgcagcataaaccaggtttaaagtctagctaccttgcaaggagcagcttccttcttcatggttgaactctccagagtaatccttgggttgctatttttgtggtcacctttgtggatttttttctctttcct

SEQ ID NO: 121359 - DNA, 1021 bp, Homo sapiens
tgacaatattgtttaaattttttaaaatctgtgaatgtgtacttgattacattgattaaaacaatattaagtcaattttgcattcctgggataaacctactatgtcaaggtatattacctttttttatatattactgaatttttgctttactgccaatgagggatgttgatctagacttttcctttcatgtaagggctatctgattttggtatcaggtaatgctgaccttgttaatgagttgggaagtatattccttcttaagtatgcaatttatatagcagcatagtataaataatacaatttaataatgtaatatatagagttgtttaaattgccaacatttttctctattttaaagttttgtctaaaatagatcttaactaggtttgtcttataagctggtttaatattttataattaaaatatttttaatattaagattttttgagaacatagggaaaaagctctgtggttttaacaaatatataagtatgctaattttaaaacactaagcctttttgtagaaaatttggagagtacaagactgcatgaagacaaaatcattatgtagattttattgttgagataatatggaatttaacatttggaactcattttcttaacatgcacaagcattttctcaatattttaatttttattaacagcatgcttatgactgtgtaatctatcacatggatttagaatatttgtctataatataagtatatttgttttatttatctaattattgatattagacttttaccctgttagcaattttctacaatcacatataatgctgtgatgagcacttcctatgtaagcctctgtttttatttacgatttgtttctttaggtagatttataaattaaattattgggtcagagggtcgaaatgtcttgaagctcttgatacatttatggaacggcttttatctatactacttcagtttgtacttctccacatgatatacgagaagagctggttcaactcttcaattattcaggattttacagtta

SEQ ID NO: 121360 - DNA, 1793 bp, Homo sapiens
ggaggagatgaaaacttgaccaaaaatggatttctgtgagcaccacagaatttggtgaggtttagtaggactccggaggaataacattcgggaaggacaggatgtctgaactgtatgaccagtcctgtcctttttgctgttctctccctgagactcttttttcacctggatgattccttccccttttaacccccagccaaaactgtgcttacagtgatcaggcaacagcctgatcattccaaaggaaattttgaaactgaggagaaacaaatacttaaaagaagaaacatcataaaagtatggacttctgaaatatgggcttctgctcctaagatcctgttgaagggactgaagaatttattgagcctcagttctctttctgctagtacctgatgagctggtgtaacctgcctggctgaactttgcccccagtcttcatctcatgggtaccttcttatttattgccacattgaggccatctattgtcaaagataaacataaccagacatttgttaaagtggtacaaacagattttattcagtaagtactgatagtacgggaaagagctgagctcattccaatgtgcacaggtggtttgggcattttaaagggtgtttattcttttaatgcaccaatggggtatattatgttttttgagtgtagtcactgatcatttttaaatttggaatcctctacagctgatgcttgatttgccttgtcagcatttgccaaattacattcagaggctaggaaaattatgccatccccttttcgttgataaaattagttctacattcagcttgcaagttttaaataatttcttctcccatctcctctttttgttctgttaccgtcttctcttttcctgtttatctcttccttggattcattccctcctcttgtgttttaggatgaggaggctaatattagattttagggattttgcttagtttgccaacagtggtattgactgggttgtaatttttaaaaaccactgggacagcttggttttagatgaagaggatttcagtgagtaaaggtatgaataaaccacaccatatcttataaatcctcataaagtcgctaagtctctttcagaacataatgtgatttgtcagttgtcacactttgtgaactgcagatgccatcaatcatgagagagagaaattcctatttaaatgtttgattatttgtcttcagaaaatgtgattttcaactattttagtcacaaaccttataagcaataatgaattggactcccattggtagtcctgaacactggggagtgttcatgagtgaaatacagactgatttaacttagttggatgctgcttacctagctcttaaggctttaaaagttgtgcattaggctggaatgttgatatgcgaaggatttgtaaagaaatatatttctagttagtgcatttcatgtaaagatttaacccttttttgttgttgtgataaacagatttattttcccgaaaatggacattttctctatagattattttcttttatttaattaaattgcatatgccccaggagtctcatgggtatgtacacacttaataaatattattttgtagtttggttttgaaattggaacaaagtgcttactacttaagattctctctttcttgtcactgcagtgttaatagaacataattacataccttatataaaaacttggtgtattagtccattcttgcattgctataaggaaatactcgagactgggtaatttataaagaaaagaggtttaattggctcatggttccacaggctgtacagga

SEQ ID NO: 121361 - DNA, 1115 bp, Homo sapiens
acctcagccactatgctgattcctgaatactggagacaaaagggaaggcaagatgaaaagggaaggttatacttctttattaattcacatagattacccttggctctgcctgccacattttcatgagaatttcttttatttttcagattcctctctttatagtagcctgagaatctctaggtagttactcattcttagaattggtcctggttactattttcacagaagagaaacatgaaaatctgattaccaaaggggttgtgcttcctgcagttcagtgtagtctttgtccactagaaggaagaacattgttctcccagcagcctgacacaccacagtaatgtatgtgtatgctgccattgctggttcagcatttatttctgttggtggagtgaggctcagccatggtctttctagttctgtagttacagcttcttcagaatacacagacacacaaagccatttcttggtaattcactctgaggagtaaatacttcctcagagccaggggattggttgggaggagtttgcagttctagacagccagatagcattgtttctgaaaagacgtcttgtaaaactttagcattctggcccttgagcatagaacagtcctttctgttctcaaatctattgtcttaagccttttcctacctcaggatcatgagtaactgttttttttgttttttttttttttagaagtaatagaaaacttgcctcagaatagcttcaataagaaaggaaatgaatgtgctcagataactggcagaattcactgatagcatgggcataggcctggcacacgccacttctttttttttttttttgagacagtcttgctctgtcacccaggctggagtgtagtggcaccatcacggctcactgcaacctgtgctttttgggttcaagcagttctcttgcctcagcctccccagtagctgagattacaggcacccgccaccatgcctggggctgctttcctagatacacagaaaacaaggtggataggtgagaagcactagaaatatccattcagttattagtggggattaggttcagggctgttgtttaaggagcccttaaactttaaatttcaacacaggaatggaggtccc

SEQ ID NO: 121362 - DNA, 1077 bp, Homo sapiens
ttacttaaagtcagctgattgtaaattgttaatcatctctacaaaaccttcacagtgccacctcgattagtatttgaccaactaactaagcaccatcatgtagccaagctgacacataaaaattaagcacccctaggtgaaaaggtactgcctgcagcagaagagggtatgaggggcacagagccccctcctggtcatgaaacattgaggtcatgcttcacctagtcatgaagcattaaaggttgtggcagccttgttctccatgctttttcagtacatgtgatgttgtatggtgggggcaggagcatataagccagtgtgaatggtttttgttgcagtctccatacagaccaggggtctattttttttttttcaaacttgaaagaaaagtagaacattttacttatacttagagctacaagtggcttgttagatatcagagagtgtactgaattagaaaaaatgttctactgttggccagttgccaccaacagaaaagttaggaagatgtttaagttgatggagtgcttaatttagtgatagtttttggtgagcttttggaaagctttactaggatttaggaatatgcctgagtctcagtaagcttctccttagagaattgaagagtctctgcaattccacagaaggcagtacactcgaaaaccatcaaaaggatattattctgtaatgctcgtaagttctgtctttagccagttaaatatgatatctactggattttaaatgactatcattttaaagaatgtcttttaagagtttactgatttaaatcttttgataggcctgtcttatggctgtcatcctgatttaaataaaaaaaaagcttttcaattgaactttcaggttgaccactagttataacttctaaaatctctatggatttgatttactgcaaaagtaatatcattaattttataagactacttctaagctgtgttttccttgcttttggattttccctatgacaaatggagaaggactgttaaccaagttttattggggtaagatcaattttatgaagcctgatgacttcttattctaaattttacctgagcaatg

SEQ ID NO: 121363 - DNA, 1047 bp, Homo sapiens
aggatgtagtggctggtgtcaggcagtgatttccttatcatcaccgttgtgattatcttggcatacatatattgctgataattgatattctctatgaagagcctgtttaactcacgtctcatcccaagtgaagggccatcttgagcctgagtttccctctggaactctctttatgttgctgagaagcacagtgcctcctggcacattagctttcagtctgtgaaagcagatactttcaaatgggaaaatgccatgcaaggtgaactgttggtattttcacagcaggcaaattcttagcaccctcagtataaaaacactagtgaatcacatttatggttttgtaaccattacaatgagaacagacagtgacattcaaatctcagaaaattgaacccttgatattgattgttaatgtggaaaacttgaagaagcaggtagaacactgtgaccttacgatgtgaattctctaatcagaccatacagatcagtcaaatatttgacttattgatttttggagaaacaagctattttgtatgcaagatatgaaaatactagaagttttcgcccttgattcagaataagcaatgagagtcaaggtcttatgcagtaaatttgaagttatgttaagtagtatatactttcaatattttaacagaagggatcatcagttttctcatacatgtagctacatatttaaaacagtattatttgcatttatattttaatttctgttttatctcatattaatttattaatacagatgtaatgttattaagaaccaaacatactattctaaatatttaaaagatctccaccacacagaattataaacttctgcggcccacatttgaacatacttcttttctgcagtctcatctctgtaaactttgctcacttaaaaaactactcatttagagctttatctccaatttctagtactttggaggctaaaaatgcagttggctgagttaccctgacctgttaaagcagtctttccattttaacttaagttcaccttaagaaacatagattatctttggacaaatg

SEQ ID NO: 121364 - DNA, 1032 bp, Homo sapiens
acacattgtcctttaaaagcttactagttatagctagttttagttacagcctacatcttgtgtttttatttttatggttcaaatagtgcctgaattctagatctgcatgaaaaccatgctttcttctcagcgtttggcactttagttgtccctccctgccaactaccttctttacatatacacttcagaggttaaataagaggaagctagaatgagtctgaatagtagattctaaggcacaattacagtattaaaatctcattcatctctgctccagttttgaaagagcattggtgggaaattataattatagcaatagctgagttggctccttgtgacacagatttataatgttagatattagggatacttattttttttttccatccaaagtctaattttctgagtcacttggaattttagatcttgcctttctccagggaccatctggtttggaaaaggtacaaagattgtgagctgtggtatgggcatgtggaagagatactagcacaaggcactaaacaaatagaggagagagatggctaaggcagaaagagcaggagagccaaggggagggagttaataaggcaagaacaataaaaaagggtggttggtgaagaaggtgttgtggtgaaaaggaagaggagattgaggagagagaatgtagagaagaataaatggtgataaaaggatggagggagaatggattcaaaggcagaaaaattagtaataaaagagcagttaaaggagagtaggaggtagagagtagaggagggtgaggaaaggaaggttacaaagatggtgaggaaggaagaaagaaatggattgactccatatccagtgttctgctaacactggtggtagtcactgctgttagctacatggtctgtttatattgaaggtgaaatcacagcagtatagggcagatcaagtggcatttaatgcttcacagttcctggaggtgaatggatgaacaatgaatgatttgcatctttttacttttgtaaagagtcatgaagttaaacggaatta

SEQ ID NO: 121365 - DNA, 1089 bp, Homo sapiens
atatatacaaacataaaagacatggcatgtttccttaaagaacttaggatcctctagggatgttgaaatatgaaacaatctgtgtctgtgccctaagtgtgtcacgggcaaagtcaggttcagaggaaggagagaattgtttctgcttgtgatttgaggctaccagttttcctgactcctaggtcagtgttgttgttgttgtggttttgtttgtgtttttttaaaaaaatcattaccttacctctctgatgtcactttgggtgtcctagatacactctatattccacagatttattcccatgcccctaccccctcatgaacttaaacattaaacatgagtcattattggaattattgtagttttaactaataaatagtaaaattttattggactcttgaaggtcatgggtcatcatggacttaaaaattttagtgtcagtacccagttgtccagaatttagaattggtaaaatacattcagctaccaaaattgcgcagtaatatcatcctgtttaattcagctggaatttaagttaatggcagatttaatggatgggacactttgtagcttctgcagaccctgataagctttacataaataccaagttgcagctacttgagtgaactacagttccacaagagaaattcactttaggatattttgaaataccattcatctgcttcagttagatattttaggtaccatgtcattcttccctatttattaatgttatataatattataccatgtaaaaagtattaacaacgtaaccatcattgtatttgcattgtagcgtaatcagctgtgaaagatgaattttcagatgtatacttatagtactctttgctaaaaattctgtaggccaccctgactcattggttataatattgtgtagtataagtaatttcatgatgtgattatttttatatttatttatttatttttgagatggagttcactcttgtttcccaggctggagtgcaatggtgcgatctcggctcactgcaacctccgccttccgggttcaagtggttctcctgcctcagcctcccaagtagctgggattacaggcatgagccaccatgccc

SEQ ID NO: 121366 - DNA, 1055 bp, Homo sapiens
ctgatatcaaagagcattttacaaatatgatatattaaaatgattactcttaggaagtgtatccccaaacatgcttactttaccctgactcttgattttatgccttggtactttgagtagaatagggcaggtacagataatagtatgtcacagtggtctagaatctacacctttcctgcttgcagtatggtattagctagggtccattccatcacgaaagtggcagctcatcattttgggcagtcagaaaaataggcagttgttataatagctacattgttttttaaaaaacttatgcaagcaggtaagggttttttcacttttagaccagcatcttttctttaccgtagaatctaattattgtctctaatctaaaaggagatagaaaaatgtagtaacctaaaggaaacaaagaataagaaaaatatctactttttgtaagaatgggattttgcatataatttgatttactaggtgacctaagttaacagggaactgatttatatttttactggtattaatacattaaattcaggggtttctgtgttgttaaaggaattctgtgtcatttgaaacttctatgaatttagaaatgagaagacatcagtgatctaggtggctacttgtgatgattcctaattttgtaaggaaaataaaaaggagatggaaaaaggatttggaacaaccctgatgtgtttgttacaacatttcaaaatatgtctatttcattttccttccaacatcctcaataatgagttttgtctctaaatttgtgatgaattaaacatttgtgaaatgcatcctatgtaatgttggatcagaggctgaggtgaaatttccaattgacataaatgtgcttatcacagtgaagacattatacttttctattttcatttcataatcaatggtttctattgatttttgtctgttagcaacggaaattatttacttcttctgttttgttttaaatataattaggaaagttttataattaatcacaaggctctagttttaataggcaaaacatgtttatgtgtaactgaagttagtcacat

SEQ ID NO: 121367 - DNA, 1172 bp, Homo sapiens
caggcacgtgccaccacacttggctgatttttttatttttatttttagtggagatgaagtcttgctatattcccaggctggtctcaaactcctgagctgaagcagtcctcttgcctgggcctccctaagtgctgggattacagacttgagccactgcgcccagcccactctgaattgttttatagccattcccaaatgttaatgaaagtccaaattgggggaaaaagagttcctgcagaaaatgatagtgtatatttacatatacatgtcttttctgtgtctcttcactttggtaattaatataattgtggatctttgacactgattttagattacttaataaagaatgtatttaagtgtagtgcagaatagattatctttaatgtttgcaaaaagtggtacactgtttagtaatatttaggtaaaatggtaagattgccagtgtaatgggcaggttatatgtctggaaataggctcagcaggaagttaaaggaatcatggcctatactgctgacagaagataaacaacatgcactatgaaacccactaattcagtctgggccctcttttaaacatttactagaagcctgtagatacggtcggtaactccagtgtacatagtagaatttatgtgcatattcaggaatttctatgagaaacttccacataataagattttgcggaagattcatgcttacaataaacagtaaaggaacagttttggttctggaaaacctagataagcatttatttccttacattaaataagaaattgacaaatgtatgtttaggtaaatatggtatagatgtttaggagacaaaaatgatgaatgaaaatacaatcataataaggaattttagaacttcagttattgcctcacaaatttattaagtgaatgaaaaatctaggaatttaaatggtttttagagtctttgcataaaacaatttttggctaaaaaaatgtcatctctgtctctctgaacggtggtagtcacatgaaatgacacagtgaaaagatccagaattgtctcagccaactcccagcctcaattgtaccaccaaagacttacctcacatgggctgtaaggagtaaaaatgtagtaatatgttttctaaagtaataaaatggccaaatgtatggggctaactatactaaggaatagataaaacc

SEQ ID NO: 121368 - DNA, 1046 bp, Homo sapiens
taattaaacatatttatagtaaaagcaagaacatgttctagagtcaaatgtaaattttgtatacacttttaagataactatatgacattaaaggaagttgatggttagggcataaaggtcacctgttgttcaccctccttgaatgttccaggtacctttggctgaacagtttgagaggccttgaggagcctcagagataatatccaagggagaaaagtcagtgatccatgtacatttatcactgcatatctcttaataccttttttccccttgctcaagcgattgttttacatttctaagtgatgtagagcatcagtaaggtgcttaggttagcctttgaataacaagcttcttttcacaccataggtttcatgatcaaaaattagcactgggatgtctgcttgcactattcccaggtttgcttcctcggttcttcatatcatccagacccctgaactggaaatatcttgttaactctgcactgtttaatattctttggaaattaaactacttgggcatgtttagagctcaaatggaatctatgcgttttgcttgacaaggtcgttggttgctttttagagcttacatattgaaaatcatgtttgcagccagctgatagagaaatttccgtgtatcaaagcattgttgtgatgaaaccacctctgttgtgaagatcacctgaaataatgtgtgtgagagccctgtggaaaccaaaaagtgctgtgggcatttgaacactagactgttatgattagtgatgaacagcatctcagcctgccaagggagaacatgaaactggagaacaaatttggttccaggagcaaggggaaatgtaatgtggaatctcacagtttggggtttgtaattgggatccgttgctattataagaaaatgtagttcaaaagacacaggattttctgttaaaatcaatgaagttaaaagagcagctgcttgtaaaagttaattttatttgacttggtcccagtaataaaagtgatagttctgttgaacaacctgttctctctaaagctatatctttttgttgc

SEQ ID NO: 121369 - DNA, 1003 bp, Homo sapiens
tgtgcctattgtttcagtaatgccgcctaaaaggaaaattttaagaaaatgtctgatgaaagactgatgtaataactttaccctcggagccagagggaattactacatgattttaattaggggtgtggttaattttcattttgaaaatttcactctgaccttggtataaattagggaaggggcaagaatggcagcagaaacaacagtggagatgtattaatagtttagggaaaaggaaatgaagactgaaattaagatgaaggggtagatgtgaaaatctttcctatgtggacttaacagatgtctagaatattttgctgttactgaggtgtttttcgtttgcctctattagaaagcatactatatagattgacagaagtgactgaaaaagcccactctgtctgctctgttttcagagcactgacttttgaaatgtctagataaatcatttaaatcgttttagaacacagctttggttctgagacatgaaatcttttgaacaatgaaaatggcactttgtaacaggatttgacattaacagataaaggatgtattaaagtattaaagtgttttgtttatagaatttgataaccttgataacatcttatatgttacatatatgttacttagtatttttttaatacttagtacttagtattttaatacttagtatttttcagggatactgaaagtctgttgattgtgctaaaattgcagcagattaattgtctctattgtattttaaattagtaactgtcgacatgttgactcttgtacaaaattgggaaagcttctccattattattagaatatggcactttggtcaactttttttcaaaaatataaaagatatttttagatgatagttttatttgcataatataaaaattagatttgatgaattaaatgttttccatttttaggaaattgtaattaatgtatgaaaaaaattaaaaagagagcatacactatataaacccaaaagatatctttcagtttgttg

SEQ ID NO: 121370 - DNA, 1047 bp, Homo sapiens
cattcactcattaattacttagtgcccgttatgtgcttagaatttaaagaaaacacacaatctctgttttcagggagttgggtttgatttcatttgagagataggcacttgaacaagttataaaatttgtatcattttctatcagaattaaatacaatgtacataattttgttaattgaactgtctccctcgtggaattatctcctcaagtaatcgggccataacttaattgttttggtttccgtgcattctagcacagtggctcacagtgggagctcagattggactgaaatttattctttttttgttgttttattcttagtcagctttctcaggctgaatggactgaactgtaatctcacttgagggataatattgtcattaactaagaaggagaataaagaaaggaagacaaggcaattagggaatgaatatgattgcttagatggtaatttcagtagtttcagacattttaagcttgagatacccgtggggacctatgtgggggatgtttagtaagcagttcaatacagacccacagttgaagagtgaggtttacatcagggagacatttgctaatcatcactgtgcaggtcttggttaaaataaagggaatggttgagatcacccaggaagagagtatagagagacaagaaaagggtgaagggttctgaatcgaacccacagaatatcagtgtttaaatgacttgtgatgggcagtgtgggagttgggatatgagaaaccggtaaaaatatcagggaggagccttgaaccaaaaaggatagtggtatgatgggtgctaatggtatggatacaagtccaagtcttatgaggatttgaggaataaataagaaatgaggctgtggagatatagggaataggctactcttggtagagcttaattctgaggacatgtaaggaaaaaggactgcatctgtgagcttcatggttgaagaaagtgttttattttttccttaagattggtaagatgagcatatttacaggttaaggcagaaatgagtagtatgggagtaagacggactaat

SEQ ID NO: 121371 - DNA, 1079 bp, Homo sapiens
ttttattttatgctagtttaaaaaatatgataaactataacctgccagatagaaaggagtaaatggtgttaacctctttaggcttaagaatactgggaaatgcttgacaaagaatggaaatatgttttatatgttattgtcttatgaacgtcagaaactctgtctgctggtggggagggagggcagagaaataccccctgaggatgagggaggaattctttccactctggcttaggattttgctgtaagccacatttgcatcctgtctattatggcttcttacaaatgagagaagaatggacagttgcaattaggtattgaggttgaggttggccaagcagccccaaagcctcgcagataaacatgtcacagctttctttgtccccagagaaacaattcaggttaccgccaagctaatcagaattcaagattgcttccctaatagtataaatggcaaactatgacttaaatataaaaacttgattcccaagtaaaatgttgtaaaaacaagcacaagcacttcctttagttggcctaattgcagcctgtattttgtttatgactggcagagattgatcttagtgcagcaaatagaagtcagggcaagtcatctggctattctataggtatacctagtcctccagagaactatttgattgttttatgtcattgtgtcctcactatacaataatgctatccagtagaatcataatgagagcaacaaatgtaagccacatgtataattatatataatttttaattactcagtgaaattaattttgataacataccttatttaactcttattcaaaatatcttttatttatttatttttttaagagatggggtctcactcttttgcccaggctcagctacttgaactcctaggctcaagtaatctttcttccttagcttcctgagtagctgtgactacagatatgtgccaccacacccagctcaaaatattttaatatgtaatcactatgaaaaattgtgaatgaaatattttacattttatgtactaagtctttgaaatccagtgtgtactttgtacttgttgaacatctcaatttagttta

SEQ ID NO: 121372 - DNA, 1032 bp, Homo sapiens
gaatttggatatatgctatctctttgtattatttcttgtaactgtatgggagtctatagttaacttcaaagaaaaagtttaattaaattaaaaaacaggtaaaataaattttaatagtatgttatttaatccaaagtatctaaaatattatattaacttgtaaccaataaaaaatgttaataagaaacatcttatacagataagcgtcatctgtaaccacagtaataaagcagcactttcttatggtgtttgtttttttattccaattaaattgaattagcaaccataacaaatattacagggtacctgataagtcttccacttaacttaaaactctactgttttttcttgtagctttctaccaaatccttcccactttacatgcatcagttacataaagccttgcgggaaaatcaccatctttgtcatggaggccgaatgcagtatgtcctatttctgaagggcattggtttaactttggaacagacattgcagttctggaagcaagaatttatcaaaggaaagatggatccagacaaggtaattttgaaaaaaaaaatcagagtggtacctgatattttaatttggtctgaaaatgaaacggtctatttttttttaaaatatgctccctgcaatgtagttgaaaattctaaaaggataaatgtgttgacaattcagtttagataaaaagaaacttgcatattaatctaatacaaaagattgggaaaggaatgttttcctttgtaggtatactgccagtagtaattataagactgaaattgctttcagagttatatatctgtaggaatatatgtgtgtctatacatatgcacataatgttttgagcactgggagatatcatgaacaaataaaatgaaacaatttaaaatattttctattatgttatgcagaatcttttagaaacttttggttttttttttcgagacagggttgcccaggctgggctggagtgcaatggtgcaatcatggctcactgcagcctcgacctttgggctcaagtgatcctcccac

SEQ ID NO: 121373 - DNA, 1014 bp, Homo sapiens
gggtactaagcttagtacgtgggtgatgaaatatctatacaccaaactgctatgatgtgagtttacctatataacaaacctgcacatatcccccaaacttaaaagttaaaaaaaaaaaaagaaaaagatatgacttttgacctcagggaacatagtctatactagactgttataacttgtattttaatataactattgaattgccttgcaaataataataacctctttggagacagataccacattttgttaggtttaaattcaagtaagtattggatatttagaaatatttcacaaaacttaataaataaatagacattagtctcctgagagggcagttctcttgttttggaaggcactgtggtgtggcggggagaatgtagactttggaatcaaaccagagcccagacctatttgccagttatttgccatgtgactttggttaagtcagcctctctggacttagttttctcatctttcaaataaggataatgatgggattgagatgaagattacatatgataacaacccttagtattgtgcttattagcacagtgtctgatacatagcaaatgatcaataaaatgccctcccctaagttcttatttaatatgatgttgaaagtagtaagcatagtaggaggacaagctcaagagtaagatatatctacctaggagactcagagagggcttcatggacaaattgatatttgaattgaaccctgaaggatggtacgatttggacatacagaattgggatgcatgaatattttatgatccatgaagtattcatataaaggttgttggtaacataataaaggaccttttaaaccatggtttggctaaacacatagaaccattactcaagtggagagtcttacactgaacctttgtaaaagctgagagcatgttattaagtttcagttaaagtattcctgctggatgctgagaaattacaggttggttttattgctgtcttctgatctttatctttcttaatatatatatagaagtt

SEQ ID NO: 121374 - DNA, 1042 bp, Homo sapiens
tgatgtaaaaccattctgtttttcacttttactacagtgttcaatacattacatgagatatttaatgcttttataaggtaagctttgtgttggattagtttgcccaactgtaggcaaatgtaagtgttctgagcatgtttaaagtaagctgtgatttttggtaggctgggtgtattaaaattcatttttgacatgatattttcaacttatgatgggtttatcaggacataaccccaccataagttggggaaggtctccacttttctttagagtcttaaagctcttccccaagtgcagtaggaaaagcgatcataagtattgccttatattcactaggacataaaatacgttattgtgtagtatgtgagaaagcaaaatgccctttgccttttcccccccgtttttcattacctacttgctagagttatagatagtatcacttgattgaaattgtgtttataatcacatcttagtcatgttgggggagattttttatagacatgttttaaaagatccttttagcaggctatttttcatcatttaaagagcaagagaaatcatatttttccagaagtactgcagtgaaatctgcctataactataattctgcattatgttttcatagttgacatcttaaaatgtgaatgaaggtatgtatatgcatttggtttgattttagactgtttgttcataggcatttcttctctgatttgttatacaatattatgaaaagctttttgctatatatttcctgagctgtcaaaaagtatctgactttttgagtatgactgaaaaaaatacttcaaaaggacaattgtgttcaataaatatatagtccatattatttaaaaatttgcccagtatttgaaaatgctttgtatttgaccacataaatcagagtgggtatgcccagtccaattttctaggtggataggtaggaaaatatgtttttccctgaccaataatgtcatctattatgtcacccaaatgcaatgaataacttggttttgttttactgtaaagatcctaaaccttcttttat

SEQ ID NO: 121375 - DNA, 1025 bp, Homo sapiens
tctctgggcctgttttccccccaactaaaggaaagaaagagtgcctgctttttggtgacgatcaagacttaagtacattttctataagtgtaagttctttctgaacttcagattgctattccaccaaagttaggatgagctatattggttatgagggagtacagtgatgattatttgggtctgttaagatttaacttggttcatttcatcattctggtcaagatacttacttttcctaaggtctgtcttatgctctcatttttatatgggaataataatctctattttttgggttcttgtgaggagcagggataatgtctgtcaagtgcctgacacactgctgagcacatataggcactctaagttgtagctgttgttaatttactttaaaaaaattattgatagttaacaaatactattttatgcatgttaatttgaaaggaagtaaatgagcccttttgatagcaggaaaagttgcagatattaacagtaagtggcatttgtgaagagcataattttccaataattttttaagtaattggattagttaaaaattaattgttgcaaaattaagtaaacaatattgatttttcttaaaaccaaaacactgataactacaaaaagtaaggaagttctaagtctagatttgcttatggtctttcttttctccctgaatgccatcatctatgttcattactcagacttttttgaaaatagaatttgaacataaacttgtagaagtataattaaatgagaaaaatatatattgaggtttataatctgcctgtgaattctaaggtgaattcatcaaccttcagtttttatttcagttcttacccttttcttttcttttctttttgagatggagtcttgctctgttgccaggctggagtgtagtggcacgatcttggctcactacaacctctgcttcccaagttcaggctattctgccttagcctcctgagtagctgggactacaggcacgtgccaccatgcccagctaatttttgtatttttagtagaga

SEQ ID NO: 121376 - DNA, 1066 bp, Homo sapiens
ttatagcactttacttcttttatgacacattatcatgctattttctattaatcacgcattcacataggtgattagttcctccaggaccataaactccttgaggtaagatctgtctattggatctttgcacccacctcagtaccagcatgcatgaagaaaaaaatgtgaagtactccttggtctactatagcattaggaaggctatcaacccattattctgctccattaaatgttttccaatgcctgatggttagtgactttttaaatttagtttttaattttttttagagtcagaatattgctctgttgccctgactgcaatgccacgatcatagctcactgcctcaggctcctgagtagctgagacgacaggtgcatgccaccacacacagctaatatttaatttttttgtagagatgggttttggaatcagacttgtctgtacatgtctaccatttaataactgtcgtacatcacattgcttcattctttgaacttcagttttctcaagtgtagcatcatagaggagttgtgattatctaaatgattaaatgggattacacttttaaaagctgctacaaaatgcctggcacttggtcacttttcattatatgctggttccttttgttctcctgtctgacccaattcaaagtcccttctgtcccattagcttgttttatgaacatggaggcaaggattctgggtaggaggcagttgtagtacttcattcattaagcatttgctgactactttgtatagtggaaatctagaggaagggattattattattattattattattattattattattattatattttgagactgggtctcactatgttgcccaggctgaagtacagtggcacaatcatggctcacggcagcctcaaccccccagcccaagtgataattctgcctcaggctcctgagtagctgagacgacaggtgcatgccaccacacccagctaatatttaatttttttgtagagatgggtctcactgtgttgcccaggctggtcttgaactcctgggctcaagcgatcctcttgtctaagcctcctga

SEQ ID NO: 121377 - DNA, 1045 bp, Homo sapiens
gcagataaacaagtaagtgtagtgaaataaaactatggcaggataagagagaagaatgagacttgtggaggtgactctattaatttaaataaggttgtttggtgtgttttgagaaaccctagtcctgagagatctatgagaaatggattctggggacaaattagtttgagaaacgttaccctattaagttctgccataaagaaacttatgtaattgtggattaaagccagttaaacaagttattagacaagaaaacccccgatcatcactaggattttgtgagctaaagttccaaagagcacattgcaggagaagctggaccagagtatgaggatccagtggccaggtaggacagggtaggagcctttgaatcatgatgaaaagtttgtgccccagccatgccaggattagatttggcttttagaaaaggtactcttgtggcaatgtggcagctatcttgagtgaagaaagtataaatcaagaagctttccaataaaaaagagaatgatgaaggcttcaaaaatggagagaaaagggtagattttaatgacatttggaggtagaattgacttagataactttgtttatagataataaagagtcagaaaaattcttgacatataatgttttaaagaaatgaaagtacatcttcaagagagggaaacttggccctgatctgccagtcagtgtaggtcacagcaagtcagcagcaggctaagctgtgctgagtgtgtgagaaatgggagcaaagtcatatgttcaaaaatgtgcaagacttggcatctccaccacagttttctttcacctttgaaatatgggaaggttagaaatggagtggaaaaatatcagcccagtctagttttgaaagattgagtttttttaggaagaagcaagcttgttatcatttttaaataagacaaaacatgaccttgaattagattagccacatatctaattggtgagtacagcatacctagctgtacagcgctctgctcaccaaagccaaagatgggcaggtggctgaattctgctgccaggtaatcat

SEQ ID NO: 121378 - DNA, 1103 bp, Homo sapiens
taaacagtatacttgattgcttcatgcaccaaccattagattactagatttctatctacagtttttggagagatgttgcaatatgatgttctgacaataactgtcaaagtcatcataccaggatccattttcatcttgctgttgaggtaaagttacaaaaatgtacagttggtaggtcagaaagatcactatctcttgtcatctgtggtttaatgctgacctaaaccactactgtataatgtcagaattatcacagtgtccaggctgcagaagtacaacatgctacatgatttattgcatttcctgtctggaatgaagattatgaaaaggccaacagctgtgagctacagtggtttagaagaaaacttaatttctaatttttatttgtctttttcctcattcattttagattttggatttagtaaaggggacacattaccaggtagcctgtcaaaaatactttgagatgatacacaatgtaagtatttttttaactttatatcctaattatttgtcttttgttactgtgtcacattcagggtttttagttgcagcaatggaaaccactctagctattttcagcagaaaaggggattgcatggtattaagtaacttacagcatttattgaacgaccagacaactaagcttggatgctgcagaaccaggaatattttgtaactaggagaagctacctcatgagaaaatctttactacagctgtcacccaccactccatatctagggatgagcccaagggtcaataaagtttttctgtaaagagccagagtgtaaaaattgtaggcttcatggtccatatggtctgcgtcacagctactcaactctactgttgtagtgcaaaagcagctgtagaaaatatgcaaatgaacaggtatgactgttgatccaatagaactctattgataaaattaggtagtagacccagtttgacccacaggccttgatttgccaacctctagactagatctggaatctttgccacagctgcctagaagaaccaaggcttttgccatcttccatgcagaaaatctgatccttgtacttgtggctgccacctgatgttactgtaatccacttcccaagtc

SEQ ID NO: 121379 - DNA, 1063 bp, Homo sapiens
agtattattcttatttaaaagctttttttaaaacaaaactcaaggagtaaacatcaagaaaatagcaacaacaaaatctcattagttttatcacactaggaatctcgccagataagccatgtttggcaacaccaggtttatatgagtcactctctcggagactgcattctttaatttggttgctccgcttgagagttttaatttcctattgttctttaatcatttgtggatgcttttaattaagaggcctcagaattttcacaagtgaagtctattatccaacctctttttataaaaataagatatgaaaattagatttaaacattgagtttgtggcataatcaccaaaaagtaaggagtggtttttatttctcaaatctgcttttgtaatatctctcctattgattattccctcaagtattgccactattgccaatttttaaaacttgttttagattaatgaagattttggaaagacatatatctaaatcccctcacatataaaaatagtcaacttaaaccacacttaaatcaacaaaataaaaaggctgtttgtattcactagatctctcactgtggacttttagatgtgaatatcctccttcatttatattttttctaatttaatttaaaaatagaatctatttttattgtcaggtttctgccatcctacccctcccccaaataaaatcctatgtttattttcccgaggcctctgtgatcaaacttacttaaatggaagttttgaaaataaaccagttaattgataccatttgcagcagcactatgatagttccatatggcttttttggtaataccagctgcctcattataagctgtcattgcaaaacctcttgattaaaacccaaatatcccataggtaaaacaatattgctttcattccttcaaaatctacatttgcagtggcagaaatatgagacccatgtttgtgtgaaggtcattgtgtgcagaatgtgctgattccaagcaaatgtttgagagagatttatttagtagatgttaaaagctggcctgcttgaaacctgttttcctctgtattttt

SEQ ID NO: 121380 - DNA, 1033 bp, Homo sapiens
tgtgcaatttagaaaaagcagggaaaggggaatagaaaatgttcgagtcaggggggagagttgctgttttataaaaagtgctccttgaagacattattacaaaggtgtattttaaatataaataaagtcaggaagggaaccatgtgattccatgaggtaagaccttttgaagcagaggaaatagtaagtgcaaaggtcctgaagtgggggagtgcttggcacttttgaggactagcaatgaggtcaacatggctgaggcagagccagcagagagtaggcaaatatgatagcaggtgaggtcaggatagtgctgggagggaactgttgattttactctgactcaggtaggaagtcattggacagatctgagcagaggaatgccgtgatctgatttacatttttgaacaatcattctgataacaggaatagatagaagcagggaggcccattgtggaggctattacaatattcccaatgagagatgattgccccatggactaggatttttgcaatagaaattctgagaaagggtgagattctggatgtattttggaagaagagtcaataagatttggtgctgaggttgaatatgggatgtgagtgaaaaagaagactcatgggtgaccaagatttctgacatgaataataaaaaatggagatgctattacttaggtggggaagatctaagtaatggcaacctgtaggaacaggatgaggagggagtaaagagtttcttttgagatatgttaaggctgagatttctgtgagacttacaagtagaattctttagtaggcagtgagatatatggacttgaaattcatggttgagatccagaccagaggcttgaattttggagtcatcaacatgcagacacttttcaaaagtatgagactgggtgagatctcttaggaagttaatttgaatagattaaagaagaaagaggactgagggccttgtcctgaggccctccaacatttagagtgcaaagaaatgagggagaaactgcaaaggagacctaaggagtggtcttag

SEQ ID NO: 121381 - DNA, 1031 bp, Homo sapiens
gagatcagtttaggtggagagatagcaagcaagtttcataagttattattacttccaaagtctagcaggaaaaaggaacaacatcagaaataattgatagggaagggatgagagagataaaaagagatggactgggaaaaatttaatgactctttgtggctttacatctgtcacagtttttgtgctacattaaagtttcattattttcacattttgtgttttcatattttttcatctccttctttctgctaaatttaccaagtaatacaatgtagataatggagagctatttctacaaatgtcattgaatctgttactggaaatgaataaagtgtttcactgatgcatttccttcaaaatgcattttcaattagcaggagaggatttgtgtacaaaatatactctttacaaaattacataaaaataacttaatatgaaaaaaatggaaacctaaagtgatgaatatgtgtatctttgtctctgtttaatttcactggatcaaatgattgtgtcaacctgcatttacaaactttattttcttgtgatatttggaatttacctagaaatacactctacctcagctccttgacctttcacttgacatggcatgcattttaattatgatttcaattattttctccaacagattaaagatatgttttgtatgaatatttgagggcatttgttgaatgattttcataaccatgtatttgcataattatcttggagtgaatcttcattctgagttaagaaagaacagtgatcctgttctgtttccatgactgaatcatcatgtaacctcttgcaagaacttgcatttttggtgccttagttgactcaagtagaagtgaatgggttttaatagcttgcctgaggcatgtttgtctcataaatgtgtggaggcacgctgtaacttaagatgctgttacttcaaacaagcactgagcttctacataactgttgcaggaaaagcaggagggaagggatccacgtcttcattcaccatttctttctttttatgtttttatttt

SEQ ID NO: 121382 - DNA, 1039 bp, Homo sapiens
acatatgaaaaaagcctggaatcgagttaaaaaaaagtatatatatatatatatgtatatatatatacatatatatatgtatatatatacatatatatgtatatatatatacatatatacatatatatatatatatatacatatatatatatatatatataaaacctccatttctctcaatataacctttggagcatttccttctatctgcatttctagatgggggagtgttatacatcttagtgttggacatgcaacattgcgacctgcttgttcacttacataagcacttttctacaggtatttcaagctctaggattttgaatgtggaatgaaatagaggtaaggtagtcaatttcataaatggtgtttcataaaatgtgggctacaggctacctgcatcagaattaaaagacttgttgaaaagacagtttcctgaaaccacttccccaaaatactatcttgccttgacttgtaccccaagtacctgaatataacatggcaattatgatactcaagcaattatttactaaactgaactgcaggagctagtatggtcacagacgattggccagaggtagtgattattaagagtgtgctgccagtcagtaacccaagtagaagagaaatgcaaaagtatctaacaaataccaattatggaagggcagtgacttttcagtttagtaacaatagaattagctcataacattaagcagaaaaaatcattttaaagtctttattaaatatattctgacctctaaaatgtaattgattgatttacattcattgctctgaagtaacatacctatatatgttagtaacttacagattattgaagaaatatagttaaaaataaaatattctcccaatccggaaaccctctccatgaaggaagtagagaaagaaaacacttttattattgaatgatcactaaaccaaaatatgatgcagatcacaggtaatccactaggagattacaaagacagaaagaaaactccctgttttatatagctaagcagatacatcctgttacgtacat

SEQ ID NO: 121383 - DNA, 3142 bp, Homo sapiens
gccccacctcgggctcgtgataatgggaacaagtctagtcttgtcctttctctgggccagtcgtcgagaaatggcctggttcggagcgtcttggaaactgacagggctactgttagttacactgacgcgaaggacttcccgtccgggcaccagcatacatttcccctgccaattttggaagggccctggatggcgccttttaatcggggactgtttagaactatccctgagctctgtggtgtaatatgttgttgcctcctgttggtttgtggcagcagtagccaaccagagacggaattctgagggttttttatcttctgtccgcggagccccctaccagtccacgagtattaagttatttacactacgattggaactgttgacctgcccgacatctagatcctgaggcagtgcttcctgttactcagtcagttgaaaactagaaaactaaatcattcccaagagtgagcagcattttacacatgctttcttaggtgccctaagacctaaatagatgtggaacagactatacaacgaattgtttgtgacaaaggagttacacacattaattggcttgactctgcagtataataatgatttaagcttctgcacagagattactctttcctcctctcccttcttgtatatgattgtgattataatgcaactgataggtgggagggaaaaaatccccattatggatagtttttcctgtgggtaggagattgggaatggaggagtgtcttgggcggaacagaaatctatcggtggccaccactgctttaacagacgagtccccccatccactaggtggctccactcagtaaaaataaccatttcaggaagggaattcttaatatagttctttctctgcttcctgatgaaagtgcttacttacatgaagggatatggccagactaggttgtagccgacaggagttttagctattaaatatggaaatagtggtgtgaaatactgcctcaaattagcttttaattgaaaaaaaggtaatacctagaaattagaatactgtgatgagtcattataaagcttttaaagatcattgtatgtcattgggaaagtgtcagaatacactttttattctacggaggttgtatttagaatttggggtgaaagtataatgaaattattttcagattactacaatctgtattcactgtaactgtgatggctttgtaatttagacacttaattttttaacccagctgaccaactaggtgaagtaacctctgagggcttgtttgaacaaacttgtgataatgaaagttaccttttttatgggaccttttgataaatgattgttaatgctagttgtatgttttaccagaaaagtagactgggtttttgacttgatgttttctgcagtaatcatcataagaattattcttcaaaatttagcaaagttctagaaactataactagcatgggactatttaaaggtgtaaaatggaaatgggagcagatcgtttgaattttaattttaagacttcaaatgcttaaatttaagcatggaaactaatggaaccttttgttaaaacactttggtaatgagagtacacatgaagtgcttgaggcagtgactatgaattactgctcttgttaacctgttattaatactttccttagtgccctctttactcccgagtacacaagtaccttataaactatttggaagaagactgattattaacatcagtgtcttccatgtacatattttaaaaatatgctgtgactattggtttaatgtttgatattggcataaaaatggtttagttcttaagggggaacttagagaaaatataaatacattcatatttgtttatatttattggttacagtagttaccttgcttttgagacctgccacttccaccttcaacatccctttgtccgccttctctgagttggatttcagttttgagttgtatatgtgaaattttggttttaaaatacaaaagaacattattaaaattatgaatattttctttacagttataaatgagagttgtttcctttttagattcataagcatacattcttatgatatttcacataacaagttgattttcagagactcattttcctcgtcttcagtttaatgggaatgataacagattgttaaggataaagtgagattctaaatataggacttaaatcagtctaagaaaaggatataaaagcataaagttggaaaagaacttagatgtttcagtttatgagttaagtaaattatgcaagactaataacttcagagttatctggagtttgtattaatgtgtaaaaatgtttttgttagttggaaaaatcaacataaagtgtatgtaattacaatgtaaagaaaacaactatcgaaagggataattattagaatcatataattatatattatatatagatagtatatatacagagaatataactagatagaatatatatgaatatatatatgaatttcacaaaaatgtaacaatgggtttggtttttttttctgaggaatcttggtaatagatcatggatttcagtttaatctatctgactgcttgttttatgctgattgatttaatctgtactcaccccttgagttttgcaattcaagtaaaagtcgatgaagcggctcaggccctgctttagaaaaatagttgtgtacttaaatagtgtaaaaccctaatgtatttcttttgaattggaaaataacttattctctctttctgtctttttcttttaaacagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattc

SEQ ID NO: 121384 - DNA, 1856 bp, Homo sapiens
tggcgcctgtggaccatttggaccgcgggctggggagggagtcgcagcgacgcggtcgccaggcggagggtcgggaccacggcctctctcccgaccactggtacccagccgtctgctgcgagggcgccccgccgccgctgaggcgcgggcgcgcaggcccgaggcacggcgggcgctgcctggaaggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacgtacgtgttaatggtgctaaataactgatcacctgacacggggggcgggggcggtgcggagagtagaaaggaagagaatgttgatatcgcgcacggagtcctgtgtccctcctttccctcaggatgtgttgccgggttaggtgacctttttccatctttgggcttttaaatgccaattcctagagactagattggggtggttattagtgctttccagtagtcacgcgtagaatatgttcatggattaatgttaagtggcaacactgctttaatattctagtcctaatctgcattacatgtagcgatatttaatttaaaaagaataatcgattattgaggcttctctaaatactaactttactatcttattttaagctaaatttaaaaaccaatgcagtaaactctgtagggagtacttaaacagtacgttgttgtatttagttactattttggggtcgaacttgtcttccctttgacaaaatgattgttaaaggcctaacaaaactacgcctccattattcatttttcgattcctgaatgaagtgtttggaactgtgaaaatatttgtagaaaaagatgtatgtttgtgttagagcgacatgttgagtcaaagcaccagaaacttttctattgtagcatacttatgtttttgaatttatagctcccttccacagcacaaaaaggtgttgtgtaaagattattgttattttaaatagtaattttaaagtttagttatcacttagaccttttccccactaatttttctcttcattcatctgtttactggctatatattaccataatgattctttccttcatcatcgtcattatcactgttattattattttacaatacatacttcattttctggtgatagtagcagagtttagtggcagacttttaggagtgatgattcctctgattgagccacacaatcagtcccgaaacgggctacttttatgtaaaaagattacaactttagattttaagctttttcagatagctgtactcggtaatttgtcaaaatgataaaaatgagccagtgatgggaccaaagtttgcctcttatttacattttttataggttcatttattgaagaatagaaaaatatagtttattttactgcttttgcatacacgtgaattatgcattctctcttgttgggatagacttcagataactttatcatgttgatcttatggtatacttatatgttgcataatcagaaaagtcacctctgagaagtggtctatgtaaatgtaggtaaaaaattggtttggtcagatgcacatttcaagatagaaaaatcgaaaggaatttgtctttaatcatttcaaactatgttattaaaatttaaattttattgagtattggaa

SEQ ID NO: 121385 - DNA, 2755 bp, Homo sapiens
aagtggctgctggatttttttcttttctggaaaagtacatcttgggctctgtttctcttatttcttcttggagcactctctcagaattctggagtatcttttcagaaggatagacactttttcaactataaaaattgcttggcaaactgttagacatttatgatactgttgcatttttgagaacacagtcaaaaaatattctttaattgttgccctttgattacacatggaaagatattgagagtattgatgtgattaaacatacatgagaccctgaggctgtttctattctcagtaaagatattatagtctgggaaacaagattcattgacatctgatgttaatcagtgtattagagttaaaggggaaaatatcaagagttttatgaggaattgctatatgtgtggacttgacaattattgtcctgcataatgtgcttaatttagaccatttttaatggtattttaaaattttatgactattatacagtgaagagtggatatagagaaatagttcagtaaaaattttaagatatttccagaagttttaacctgttggcataatctaactttattagacagtttcgaagagcgtggtagattatacagaaaggctgaactttaacattttaattcgtttgtaatttgcatgagctgggcacatgaaagcataaagttttagactgaaaataaatggaaaagtttgtagctgataaattgcttttcctccaatgatgttcatatgcattgaggcttacattttgtttttttttaaatgtgtagagggtggctaagtgcatattcctgttttattttggaagaaggatgagtcacttttgtttctagcattttttaagatttcattaatgatatattaaaagcataaaaattaatgtgtagagtgcattatagagtgtaaaagtgtaggctcaggaatcacactgaatgggttcaaatgtaggaatattgggtatgtgaccttgggcaaattatgtaattatctaggtctcagtttgctctaaagagaaaggactaataattgcacctaccttatagggtcgctgtgaggaactaatgagataatgcatacgatacacagggcctggcatatagtgtgtgccaattacacgttagcttgggttgttactccctaggccatagttttaatgatgagctaggtccactactttggtggtttattcaaattcctaatgcttataatgtcagttatgatataatgccaatatagttgtaaactttgaagttaactctttcttgttactgttggctactgtaattctgtgtttgccagtttcaacatcttcagatcctttcctagggacttaggtctgctttggtcttagttgtctttgtgcagcagacactttgatatcttctttttaccagatacatttagaaaagttatgatccttgctttctataatgatgtcttgccaatagattctaactaacgaaactgaaccagatttgaagtgggggtgtagagtagatgactaggttgaattgctttgtagaatgatactttgtagtattgtgtcataccacatggcctaaccacttattaatttttgactctgtcctcgaaggatggataacccatgattcatctttagtgttgttatatcatagtagttaagaactgaccttagtgtaatgcagagtggatctgagtcctggctctgtcacttatttattttgtaatattgggtgtaactttgctaaactttagcccctctcttgtaaattggggatgatagtacctgcctaatggtttggttgtgaggattaaatggcatgatgcatttaatttgtttagcacaatgccttgcacacagtaaatatccagtgagtttaaccttacaaacacatagggcagttgtaagcacattgactcttaaatgaaattttctgggttcagattttagctctgttcttcctgtaggagatagcttaaacaaacaaacaaacaaaaccaaacaacttttagttccatcacctactatggcaaattatttaaactctttgatcctaatttcattttatttcaatttttatataatcaggataataatataaggttgttttgaggattaaatgaattaaaaaatgtagagcagaatttcttaaacttgactgttgacatttttggctggataattttttgtgtgtgtgtggggctgtcctagtgcattatagtatgtttactagatgcaaatagtaccctttccagttgtgatggccaaaaatgtctctagacatggcaaatgttctctgcatgggcatactcacctctgattgagaattatagatacaaagcatgtagaacaatgcctgtcttgaagtttgagcacaagaagttttgttttatcattactggtggtagtttgttcttctactgctactgcctattaggaatttgtttttggtaagcatgcctgatgaaattgcttattttaaacgatggtatgggggctgaaggcatcaagtgtgctccacttttaagacctttgtacttctgggtctttgtctggattgctctttggcatttatgcattgatcactacctcacttgagattttggttcaaatgttacgctgtgaggccttcacttactatcatacatagaccaatcccccatcaccaccaccatcactattgccttgtataacttttcttgagcgatattagtctcctgataaatttttgctcccctcacaccacccccctacacacac

SEQ ID NO: 121386 - DNA, 1209 bp, Homo sapiens
cggattacaggcatgcaccaccacactcagctaatcttttttgtttttagtagagacggggtttcgtcatattggtcaggctggtctcgaactcctaacctcaggtgatctgcccgcctcgtcctcccaaagtgctgggattacaggtgtgagccatggcgcccggcctaaagtgaaatttttttttgctgttgacactttctaaatctcatctttttgcgttctattaatacttgaaacacttgaaaagcaattaggctattttgttagtataaactaaacctgacttcagtataattctctgagaattacagatgaaacatattttaaagcaggaaatatcttcggactcagattaaattttatttgacaaattagtaccaattatttttagttgtattctgagtctttataaatggtccatcaggaccaaactcagccattcataattaagacatgctgttccctttgcctagaatatcctctggaccattaggatccagcttacacatcatcacctgcctagcctttgttagcttccagagtttcaccttcctctgtgaagcccttcaatacggcatttagcattttgttgtgatgtttatatgtgttgtatttgcttatatgtttatgtcattttgaattgtgagtttttcgactttcagatgggttcatttcactagacttaaaatgctttgtagtagatgcttaacacatgtatgagtaaatgaataattttgaattatgcagattattcacttatatacttagctgcatatattctgttgtctgtaaaaatgaatttacccagaaacaatttctgactttaacatgtatattcccaaattaccaatacggatttaattggatatacacgtatcatcagccatttaaaatacaccctatataggcttattatgttttaattatttagaatgccagtagatgggcttcctatgttttattaaatttagaatgccaaatataggaaagcatttaagtaaaattttagtgtaagaaacaggaatttgtttaaattagacaatttgtttaattaacaaagatactaaattggctcctaattttcccccttaattagatctgattatctgttagccacattactaggtatcccagaatattcttagattagtttttttaagactttattttgtaataattttatatttatagaaaagttgcaaaggg

SEQ ID NO: 121387 - DNA, 1056 bp, Homo sapiens
tatatactcttatctagtttccctgattattaacatctgacataaagctagtgcctttatcagaacagagattattattattggtgtattaccaatgataatggtaaattacagactttattctgattttaccggtttttttttgctactgtcccttttctgttccatgatctaatccagggtaccacattgtgtttaatagattagtgtatccattacaagtgagtaaatatttctacatttggctaatttgtttgcctgtttagcattagagctattttatttttgagactgatcactttgtatctgaaactgatttttaaaaatgaattatacctccagtaaatgttactttcaagggagttcttttggatggctacatgctgttcatttttggcattttctctttggaattatctccagagccagttggaaccacgtaagaaaaattattctgactcatttataacaattttccttaaaacgtgtcccatgaaacactaggattgtgatttgtcctgtggaaattgtcttctttggactcacaaatgtgatacgctttattactatgttcttagaagattcccattttcattagcttactaaacatgtctcacacaatggtagctgcttagtaaacatttgatgaataaataaacggtattgttaaagaaacataacttcagtctatctccacttgtgactgtggaaacctttttccggataatgcctgtttaaatctggggaagcatacttcataagtcataatagttttgacttaaaaacagtactggaaaacttgacccattttatttacaatatgctttatttaaaaaaaatcgatcttcaagaaatatattacaggctctgaagccactttcagtaaaggagttttaggatggtttcactaatagcagtattattgaaaacaaaaaaaattgctcctttagatgactagttagaatggcctggtcttcagtatagctatgggatcttgagctttgtgaccataacttctgaatgttgtgaatgttcccatcacttgaaagctcacag

SEQ ID NO: 121388 - DNA, 4316 bp, Homo sapiens
tgctttttttttaaaaaaaattgaggtataataaatgcattcattaaaaatgaacagattcgtgaaaccattatcacaaccaagatttaggacatttccgtcatctctcaggtatgcacctgcccttttgcagttcatcctttccctattcgtggccccaggcagtcactaatttgttggattttttttttttttttgggcacaggttctggctcttttgccaggctggagtgcagtgggttgatttcgctgcaacctccacttcccgggcttaagtgatcctcccaactcagccgcccgagtgactgggtctacaggcacacgtcaccacacctggctaatttttgtatttttttttgtagagacggggtttcgccttgttgcctaggctggtctccaactcctgggctctagtgatctgcccacttcccgaagtgctaggaatacaggcatgagccactgggcctggcaggaaaattgtttttaaagagcccttaatgagtcagatcatcccagcccttagctcagtgtgaaagggtaacacttactaatgggtatgggctgtggagcttgaaacccaggctagaattttggctctgttttgtgactttggggaagacatttaaattattcaagtgcatttttttaaataatgcgaggatgttaatagaccctgtttattattggggcttaaattatataaatgttggttaaatgttttgtacagtatgacatatataactagtgaatgttagcatgtatctgaaattcttccctcatttttatagggggagagaattcaagactagtttgaggaaattttgttaaatttggagctaatctcaaaaatcttggaattaaggagcccaggatgttataggttaatcactgggactttttgttaaattaatattaacttttttcggttgactttccaccccctaaaatatgttgattcagttttctctcaaactgatttaacttaattgttttaacttttcataattgaggctcctgtagagctttgaaatgactttgctgagcaatgtaggtacaattcaaatgggagactaacttgatacttgtatagaccacacataactaaaataaatctaaatacatgatgtagattgtctttgtgtcatttatcttgtttttatcctataagggggccttgaaaaaaggtgtgtttgtgcacatctttgtgtgtgtgtgtagtcttttaagttttgatttgttgggttaatagtttctttttcattttccacctcttcccccacaataaaagccctttgtctatatatatattacctttctttaaataattttaatactttgtaaataaaacaagcctactttatggttttaataggtatgggataaaaatttaaaatatttgattttagctcttttatgtggacttattgtaaaagcagtgtctgatgcttaatttgtgaaaaggttgtggttaaaaacaatagtttttatgctttaagccatgtaattcttttgtatgtgtcaagttaatggactatatacatagtttttttttcctaaaaataatgaactgagtaaacatttagtaggatttctggtaaaatgatatactacatgcatgatgaagaaacattatttagtaaagattcgttctacatttccaaatgtatattctaaaaacaagtgaggattttttttttaaacaacaattcagaaataccttaagtgtgttcttagactcaaaactattaaaataatttggtattaggtgattttcaattgatagctttatttcttatggtattttttttgtctttctatagggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacaggtaattcttacttttttttttttttttttttttagtctgcaatttaaaataaaaaaattttcagcagctttttcttttttctttttttcttttttttttttttaatgaggagggtagtaaatttagggttatttcctttgaatttagagcttcttttccaggcatcagaattaaaatttaaactaaattttcttccaaggagtgtggagttatcctcaaggatattatggatataggtagggtgaccatataatttattatccagtatgggacacttactagaattacagagagtactttaataattacatcatgacaacaggtgtaaattgggactctttagtaaatagggattgcccggcaaattgagacatgtggtcaccttaggcctgctggagtcgggggatggctgaattgacctttctcagcatacctcccagcccctgaaatatttacattgtttgctcccatttcacctcctttggtattttgtacatgtatcttaaaaccagagaaagaactctatacctctgctgccctggacagtaaacactagccacatgtcatttgcaatgagtctggtcgcttgcaatgagtctggtcctaattgagatgtgctataaaatgcacattagattttgaagactcagtatgaaaaaaagttaaaaaatatttcttcaatttttttatgttgcttatgtgctgaggtgatattttggatatttgtggttaaaatttatgtcacttgttttgttttttttgcctttttaaaagtgactacttgaaaattcaaaattacatatgtgtcttatatttctgttggacagaaaagggtctgtagttgaagtaactgaaagactgaagatagtaattttctgtaaggctaaactatccttaataagaaattactttgtcatgttaatgtataaaaaacagtttttcttttataaagcagagaaaatattactgtaaacgttgtggcaattactaatagctattctgtgagtaaaattataggtaaaggtaaaatcagcctcccatggaacagtaaggttttccctcaccattccctagagtaaatagttctcaggtttatgtgatgttggtttgtttttcattgactagactttttctcctgtacagtttgttcagcatatttttcattttttaaaacattttctatgtatattttaaatttaatacggcaatacttaaagttgggaataggtggtctgctgttggcccttaagtttgccaggttactctgcctgaggacctcaacactggctactaggaagcttcattttaacaacttaaaactgaggtcttttgaattgcttgctaatagtgtatctctgaattatttatattatgttgtgttattacttaggtttacattgttctgttgttgtattctaaatgttttaaagcttttaaaattttgttttatgtatgcattgttcaagttttttactttggtgcttgtgtcagtatagtagctctaattatctttatttttaagcatttttgacagtgtttggttgtatgctgactgtttcctagtttagtccaaattcaggaagaacatttatttaatattaacatggttgttgctggaactccagttaccttcaagggtggttatattggatgtggaactgacacatgtgtcatcttgttagactattttacttataaaattccacccctatagtaatacctgtattcctacttcctgtccttttttaaaaattgatttctgttgataatgaaaagtttttattaatgtgaaaaatctcttcagttttgttgtacatttcttttgctaatagaagacttagagcacctttatgaagtacatagaaattttttgagatacgatttattattcgtttgtgattctgttatcttttaaatgaacttttaaatttaggaacttaaattacttcctaaattttctgatattaaaatttggttactagaattatttatctttgattctgtagcagaatgtttgtattggtatatgtatagtgtatatgtttttaagatatgtaaggaaatatgtgggggaaacttaataaggcttttctgtttaggattgtttaaatttcattgtgccatctagcaggggatttatcttgatttcttcaaagttcttttccttttgggatatttgggtcagtaaaaggcccacacattttctgaaagcaaaatggaaaacatt

SEQ ID NO: 121389 - DNA, 1051 bp, Homo sapiens
agattgattgattgattttaaggagttggcttatgtgattgtggagactggctggcaagcccaaaatctgcagggtaggctggcaggctggagacctagggaagagttgatgttgcagtttgagtccaaaggcattttggaagcagaatttctcttattcaggggacctccatttttgtctctgaagacctttacctaattgattgtggctgacccatattgtggagagtaatcttttttactcaagtcttttggtttaaatgttaattatttaaaaaatactttcacagcagcatttagacttgtgtttgaccagatattggggaatcatggcctagccaagttgacgtataaagtgaacaatctctcaccacaaaaaagttgatgtgagttaatgcatgttaattaatttgatttagccattccacaatgtatacatatatcaaaatatgttgtacaccataaacatatattattgtcaactaaataattaaaaaatcaaattaaccatcacagtaaggtcccaaaaactcagaagatgataaattattctttgaactgctattttatatatgttgtcatgaaactagtgttaatcttaggatttttgagaaagtgatttcaagatgagtattgtaggcagatgcagcttaaaaagaaagcacccagctcttttctcttaagggattttatatataaaggaagttgaaaaaatagttaaaatgtgtggatgttaatgtaccaaatactgtgcaaaactactttgctagctctatcttactaaatcttcacgaaaaccttaagagctgtagatactacaggttgagtatcccttacctgaaatgcttaggaccagaagtgtttcagattttggattttattttttggtatttgcattatacttactcgttcagcaagccagcctaatctgaaaatcccaactccaaaatgctccaatgagcatatccttttgaatgtcattttggtgttcaaaaagttttgtattttgtattttgatttttgggttagggatactcaacctgtactatta

SEQ ID NO: 121390 - DNA, 3356 bp, Homo sapiens
tcagggtcataattgcagcaagcagcattgaaggatgacattacatttgctctctcacccctacctcttaactcgacaatcagcaggcttgcttactgctcactataaaaggcaatgccttttcaacaatgttgctctcctgtatttcaacccactgtgtttgtaggcatctgtataggcatatctgtgttgtccctgtggaacttgaggagacagggttatcttgtcatcatgctgcttgctgtgccatgggtgacagagttctttgtcttttacccagtacccttgtgtcttctgtcagtaaacatgaatcagtaatgggctagttcattagtttgtgagtagggtaaaaaatcccagaccctttacagttcttgcagttctcaacattactgtgtttaatcccaggaattattcatggaggtttagccatactttaattattaaagatatttaaataatttacctccaggaaggcagggattgcagctatgtatgttattcataccggcactagaatagtaggcatttagtaaattttgactggaaaaacgcacaagaaaaaagtgggaccagataatgagactagaagttaagaaaataaaatgtttgatgcaggtggggtacaactttgcctatcagatttatagcaattactattgaagaggaaacattccaaggtgaagaatacaatgtcctgaatgtaaaaacaaatttagtatctaggaaaaggaaaataatttttgacactaaaactggaaagaaatttcaaccagtgtgatataaaaaaatctttaacataatttcaatgaacatagggctttttcttatatccctcaatatatattccagtatgagcagtattacaggggctaacatcatggtctgactgatccaatcccaggtagattttaagttatctttcaaacagcctaccttggatatcagttctcactagattttttaatatattgataagaagatgagttatatgatactatctgagaactgttgagaatgtaattagccttttgttttcttttgccctatacataagttttattgatcaccagagctgggtatgagattgcataaatttaggctctgataggagtgtttcttagaataggaggctgttctgctgtccttgttgtagagcaggggtccccagactgtgggccatggactagtaccagtttggggcctgttaggaacccagctgcacagcaacaggtgagctgcgggccagtgagcattaccgcttgagttccacctcctgtcagatcagcggtggcattagattttcataggagcgcgaaccctattgtgaactctgcatgtgagggatctaggttgtgctctgcttatgagaatctgatgtgtgatgatctgaggtggaacaattttatcacaaaaccaccccctcatccgtggaaaaattgtcttccatgaaactggtcccgggtgccaaaaaggttgggggccactgctgtagaggacagggccaaaattttcctcaaaaagttattttggggtcctctttaatgccttaaatagacaggagaagctccacagcttcagacacaaaggaagatcattttggtataatttttgttttatagcccacatttaaagtaagaactagctgagtaaaattcatcaattttattttctttagttctagtgatttttctcgctgttttcttctagtcatgacaggattgcagaatcccttgttgccatttttactatagttgctgcctggattcttttggaactctgtagacctgtgtcttctccccttgtactcttttcccttccatatttattgcttagttggaggatcttctcaaaagatttctgatctggatctactggtattggcactattttctgccatctcttcctccctaaaatactgtctttccctaattttggtctttggtcataggtttttttatcatgtctttaagtgaatcgtgaatgacaaattagttatcaaatatgtgcttacataacaagaacgataaattgtcatggaatgattacatggaagtttcctgaagtatgagaatatccaaaatggtgacattgtttaaagcataattgatgtcatttctattttcctgctaaagctaattttctataaacagagtctgagattaggatgagagcattttactggttgacaactccagttggtaccaatctcagaagatacagtgtgaatagtccccttaagttgagtggacaacagcctggatagtttaaggaagtgaataaaaaaataattttgatataaagaatatcaaggatccttgagcaaatgttttcttaaccttagttttgacctccttttcctttgtctaattagcctcataattactaatttttttctgtcaggaagcaaagtaaataataaaatctctaaggtctttgctatcttttgaggacactgatcaaaaagaaattctgatgaaagatagagagctgcatcttgattcttacgggatctcaagatgagactggctaatttatagtggcccagaagtgtgattacttgtttcaaggccctatccttggttcgccttcactatcctagaaataggatagcttctgtacccgccagctacagaagctgaatttcataattccttggcagtggcagatccttgtttttttagagaagtaggaaagctggctacctagatttctccaaatcatagacctagacctccttagcctccctggctgtccatttctcatttcctcagcctcctgtctgaccccagaaacactttctgtactccagactttatattattttcctagtctctgttgccatcatggatttgcttcccataggttgtaatttactgagtcatcatcttgactcagaatttttggccttggttttagttaggattacactcagctaacagtgatagaaaactccagataacagtggtataaagaaagaaattgcagtagctcagaaggaagtgactgagagctagtatggagtcgcacagtgccagggacccaagctccttctaccttgcgctattatgtgtgatgactaatttcacctttattgcataatttgagatggccccttcagctattagatattgattccactcaataaaaaaggggagggaaaggtaatatctccttcatttaaaattgtatcttgaaagttgtatgttcatttctactcacatcccattggccacaccttagtaacctcatctatcagtaaggtagattgaaaagtgtcattttttttatgggtaaccatgtacccagctaaaaaataggaattccagtaaatgagggagaatggctgaatggtt

SEQ ID NO: 121391 - DNA, 1067 bp, Homo sapiens
gccttggcctctcaaagtgctgggattgcagaggcggggtctccttatgttgcccaggctggtctcgaacccctgggctcaagcaatcctcctaccttggccttcgaaagtgctgggattacagatatgagtaccatactcagccttcccaaatatttttgatatgctgttggttttattcacatatgaagaacccatggatttggagggttgactgtatatccttttaaaagacactttaaatatgttttggaacaaagtagactgtaaatgagatatatgctatttagatacctggttaaggatacttgttattttaagctttaaaaaaatttttaatttaattttgtattttgaaaatttaaaacatactgaaaaacaaagtacagtatactcacatttagtcatcaccaatattcaacagctgttaatattttgctatatttgttgtattaatttatcagtttaccagttcatccatccagtctacccatttagttgaactttatcatgtatcttcccaaaaaggacttatatataacaataccataactacacctaagaaacaatttccaggtatcatctaatatcctgtccatgttcaaattagtcatttgtccccaagctattattttcacccggtttgttcaactcaggttgtaatcaaggacctagtttggcatttagttgtatttccgaagtctctgcactcctttttccattgatacattttgaacaggtaagaccaaatgtctcttagcaacatcctgagttttagattttttaaactggattttctgcaagttggaaattaggtttaaaaacttgattagagtcaaacatatttggcattcggaaaacttcataggtgaagctgtataatgtcacatcttagaatgtttatcatctgactcttgatgttaaattggattactgggttaaggtagtgagagcaaaatctcttcttcctaaatacttgagatggcaagtaatctgcacagcgatgcagccttggcaatatgaaaatatttatttcctcatcagcctttttcctaatggttttatgc

SEQ ID NO: 121392 - DNA, 1931 bp, Homo sapiens
agttggaaagttaactgaaatgaacttgatgtaagggattacccattctaaactgttcataagaggccagagaaacttatggaagataacaggaagcatttactgacttctaaacctacattatagaatggagcaagatacattttactgctgtttcaaggctgaatacatataataataatttttttctcattaagttatgacctttacctaggtatgtttatcagaattgtgttttccaagttgtagtaattctcttatgtgttccaaatttattacagagttgacatttttttttctattaaggttcatatctttaatctctttaatatacttgatgaaagttccttttatagaaccgtttttatactcttaaaaggagactgtgattcttaggcatacaccctgaaaaatgctactaattggatctttttgagtgagcagctttttttgtagttatttggttattccatgtttggatgcttccttctcatctgtgctttctaaactgtcatcctaattctgacttctgcatgggttagtcaacactatgtgatggagtagaggtgttttttgtttttttgtttttttgcttttttgagatggagtctcgctcttaacgcccaggctggactgcagtggcgctatctcggctcactgaaagctctgcctcctgggttcacgccattgtcctgcctcaacctcccaagtagctgggactacaggtgcctgccaccgtgcctggctaattttttgtatttttagtagagatggggtttcaccacgttagccaggatggtctcgttagccaggatggtctcgatctcctgaccttgtgatccgcccaactcggcctcccaaagtgctgggattacaggcatgagccaccgtgcccggcggaggtgttttattctatttcttttgattgctgaggataacttcctgatttgagtctagttgaacatggaggttctcatctgttgagatagagccatgatatttttgtatgcactcatgcatttgttcatttaagctatgttttaagactgaatattttatgttccagctgctgttctagcactagtgatacatcagaaaacaaaagaataacaaattcctgctcttgtggagttttaattctatttagtggagcatatagtagcataatagtcttttcctgggctactacaaattagggctgtaaattgtttaactcagtttcctggcctcttttactgaaaaaaatatgtgattctctaagaactcttttggtggtcctgtttgtgtctgtttttttcatatatttgagtaaatggaactgaaatgttacagaatgaagtgcctagttgggaattgacttattagaatgtgaaactcaatgaataataatgagatccatattataagatggtcgagctgcttttttttttttaaacctattcctgttttacagtaacgtgattttcattaaataacattccagggatcagcagtttacaacaatcgtatgtaaggtataatgattttctttgagataaaagtgattggtactgtactgtttgtttaacaaatatttattgcatacctatcatatgccagactgtttccagtgctggaggatagagtggtgtttgagacaaagtccttgccctcatggagccggcaagtattaggttagtgcaaaattgattgtggctttggccattactctcaatgggaagaaacacgattacttttgtgtcagcctagtaaattgtaaggtgatagaaaatgtctaattgctttttggtggcagaggtcatggtttatttgacttgggctagttagggaaggcctctctcaaacattgagagtagctgcatgctgaggtactcgtagtggccagccttttgaaaatcctaggcaagtaaagtacattccaagcagagaaa

SEQ ID NO: 121393 - DNA, 2050 bp, Homo sapiens
aaaaaggagattcagaaagtggagaggaatcagctgtgtcagatgctgctaggaaatggaataatttaaaacctgataattgacctttggatttggcttgcgaaatcctgttgattctgctttgtaatacagctctaaaattcattacatgacttcactccctgtcaacaaacactattcatcaggctttccttctggtctgtttttctattttggatggttctttttttctcctgtttacattgtagaatacatgctcattatagaaaacttggaaaagtcagagaaagtataatgaaggttaaaaaacaacagcaatggcaaaattccttacaactaaatcactgattgaacagtctgttgtgtttttcctattaatgtttcttatgcatctttgtaatgcatatactatatatatatgcttttctacagaattaatgaaaagtagtcttaaaatttatgtatttaaaggagcatagtagacctgtaatctaatgtcaaaacttttttgaggctgggtgcagtggttcacacctgtaatcccagcactttgggaggccaaggcagacggatcacctgaggtcaggagttcgagaccagcctggccaacatggctaaaccccgtctctactaaaaatacaaaaattagctgggcatgatggcacacacctgtattcccagctacttgggaggctgaggcaggagaatcacttgaacctgggaggtggaggttgcagtgagccaagatcgcaccactgcactccagcttgggcaagagtgagactccgtctcaaaaaaaaaaagaaaaaaaaacaaaaaacaacaaaaaacaacagcaacaaaaacctgaggatgtatgtgaatgtgtggcaaccaatattccatcatggtggaatagcctaactggagttcctacctgtctttacacaaattatatcttaaattaatcctgattaatttttctaaagcatattctcctccaaacttttagcgcatagcataatggttaaaagcgtgggctctatttttacttttataatacatgcttatagcaggaaatttggaaaataggaaaaaggtatattcttatctgtttatggataagaattactgtgtatgattactggtataattttcatctgttttctgccaatcttttttttttttctatctaaatgtacatatgcatgcattttatttgtgtgtttgtttctaacaaggatcacactgttttctggtcagcattttcttcataatccattctttcctctctttaaatttattttgatcaaagcatatgagcagtttcatgattctgtttgttgtcaaattgctcttcaaaaagattgtgtcatttaaaggtaaacttatgaagaattttgttctctttaaattttaggatagaccactatcttgttgagctcttttaaatgaagttctacttggacacaaagatgaggactagataactccttgaggttccttctaacccctaggatgaagataataactaacatttgtatagtgctctaaagtttacagagtgagttctcatacatcatctcacttgatcctcacaacagccctgtgaggtaggtaggacaggtattgttattctcattttagaggtaaagaaactgatagagaggttaagtgacttgataaaggtgtttttttttttttttaaacgttctagtaaggatttgaatccagacttgctggtctaaataatcacgttctttttggcaagatttcatacaactgcacatttagaattactgatacatgttggctaagtggcatttgttctacacagaaataaacctaatgacaatatgagtacggtgttactatttctttgactgttcctgagtctttttacattctttctccaccccacaaattaaatacatgagtctgtctctcttttgactaggagaaggtaatgtaattatatagctatattaaacatctactattttctccagcatttgggggaaggggaagttacattatgtttttcatttttttcctctctctgtttttttcc

SEQ ID NO: 121394 - DNA, 1108 bp, Homo sapiens
aagtacatctgcattgcttgctttcatacatgtagcataaagtctgtagtagagtattgggatcccagttagaagtagaatttttgattctagcatgaacctagaatctttcagggtatggaactcctgtactaccttaaccaaaattgtgatacttgagtactccaggtatagtcacctatgtctttcacaaggggtcagcaagtaataaatggaagtgatatttgaggctaaatcaggaaagagtataatatagctaatactctctttgactaattactttacaaggtggaagtttataaaactgacttgatttgggagtttggtagtggcaatttcacatgttagaaaatttcacattccagattttcaagagtatgtagtgttacattaagactatctcacagtattttctgtactgcctttaattgcctaacattcccaatatttttaaaagttaatttttttgtcgtttttttctagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaaggtaatcctttgagagaggtctagctagaaaattagaggtatagggacagatgtgttaggttataaacctgctgagcagaaatcatattttcttgatgttttgctaatccattcgttttgatggcaatcagttttgagatcatatcaatttgttgtataagttttcagtacccaccaccccacactacccatttctccttccccaggggaaaccactagtaactctgagctggtttaatttttttttttttttttttttttggtatttacctttatagctctaggtaacatgcatatgttgctgttttttgattattctgatttattattcatccatctattgacttcccactgtggatggttttcttcctgctacttgtccccatcatataattttgttagatcaatggtaattatgttagtatgagtaatatgctattagagatgatacatttaataaacta

SEQ ID NO: 121395 - DNA, 3069 bp, Homo sapiens
taatggtaaaggaagctcattttacttacgtcactcctaggttactttttatggaaaagagatttgatgaaaacatttcttttaataaggtataatattagtctgaattttttagaggcttttccccctgctagaattcagagaactttgataaatataaaatttgacatatgttaaattatatatatgtgtatatatatcatgtcaccattatgagtactgttcaatacatttttgttgagcaaattatagctcagaataaagaagtgatatattctaaattgtattgaaataaaagcacatgacaaaatagctaagtatttttatttattttttccccctgtgatagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtgtgtgtgtatgtgtgtatgagtgatgtgtacattgaaaataaattgcttttttgggggtgggattaatgtgagaattgttttaaagacattatttgatacacagagacctgtgcaaaaacaaaaagcttcatcagtcttggataaatgatagaaagatggatctactgaatttacaaatatatcatcctagaacatttaaaaaagcatagtctggccaacagctgacatacatggaaatattttgtcattgtcacaggttagacagtgtaatttagccactgcatctgcaaaaaagccaaacacttcctggtaattggaaaattgttatactgctttgggtctgtaagttatatattaattcatttggtgtgagaagaactagtaataaagtatgaaggtcataatggaaattctatttttcttttgaagtttttttttttcttaaaatgaaacatattaaagaacaccatttcataactatcaaactttatcttgcagtgaaatttgacagctaaacaattgttagattacccaggtcaacatgaaatagagtgaaaaacgtatttctttttttgaatgttttaaataattttttgtgaattctagtctttttaaaatttgagatgattttagcactgactttcatcattctttctagtattcagtgatttgtagttttatgacactgcacccctcaatccccaatgtgttttttgttagctttttaagaaaaggaaagcaagagatgaagtggagtttgcagctaccagattattctgttcaagtgttcatattgctgttggaacttctttcaatgctgatatgataaaagaacattataatttgtatattatattcttcttatccttattcatgaaagtgtgctagagtgatttttcccagcactatcttagtacataaaaatgaagctctt

SEQ ID NO: 121396 - DNA, 1060 bp, Homo sapiens
ttaggtttggatttggaacaatagcattatttgtactgtaggtttttaagtcatgtctcactgaaactatcccagacttgctttgaagaaatcttaatatacctttgattgtggaagtaaagggaaatcattagctttccttcagcatttcagaaacattcatgttagacagttgctttcaagaaatagcagttagcccattgttaggaaagctacaatgctcattacaaataatcatttttaatattttagctttgcaactcgaagtgggagaacttttaaacacctgcatttcaagctttattccacttttgctagaatatctgtatcattatgggcccatcaaaaatctcaaacctgtaggaattatttctgtcttctaaacgtgtgttaacattgttcgaaagttttcttgcttgtcaaccccaaatattctatattatttttttaaaccaaattaatccctagggaaatgaggacttaacctgctaaagctagcacaggtattaccagcaaggataaagaatgataagttatagatgtgatgaagtcaagtctcaaggcatagtagtggttttatacacaataggcacatgaggaagaagaaaaggaagtgctgttattgaggaatgaggtatttggcaagactttaaaaacactgtaaggattggaactcactcttgtagtttttacagttttaacattaaaacagtacctctggtatattttgaattgaccatatcacccagtgtgttaccttcaatatcctctctcttggattacagctttttgaaaggagcttggtactattggtggtgccactattatcaaaatcagtagcacggtctttagattgttaaagtacatacctaaatccttctaagtctttcagctgtatcataaattgctagcctgaagatgaaaaaaggacaaagttaaggatggttgtctgaaagcattgcagctttcctaaccatgggttaaaaagcaggtaaattaaattgctgtgtatatatctcatttgctattattttcaaaagtagttatagatactcctttt

SEQ ID NO: 121397 - DNA, 1050 bp, Homo sapiens
tggttttttcttttatttaaaacgatttgttggataaacaattcttcccaattttatatgtgatgtcacgtctgtggtgaggtaggtagctgtaactttgatggattgtccgtgatgaaattattaccaagatcttaccacccttctcagtggataaatttattgttagtctatactttgttattgtttatagtattcaagactgacaaaggccagttgtcttttcttcctgatggtttattgtcccctccctcccccagcattttctcattcataccagaggagaaatatttgaggtcttaaaggtatcattttaatagaatattattttctttgaaaacttgctgtatgttgaacttatggaacggatagagatggaaaacatgcaaagtttcagaaaatcagatattgaaaatttaatttagcctcatttttgacatagattttcttgttaaaaaaagggataaaagttttttggtgttctgttttccaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggtgagctcttcattaatgcattattttgtttatttaagagctttttgtatggactgactgcaataattttgaaatttctctttagaagttttaatgttcttttacattttcaaatttagttttccatgaaagtgaataggtttttatttaaaattttttgtcagtcttggtgaaatcagatggtgacttttagaatatgcaggccttatctcttacagtcttttttgccatttctagcccctagtttggt

SEQ ID NO: 121398 - DNA, 1052 bp, Homo sapiens
tgggtgaaggataaaagttggctttgagcagggttgtggttttgccaacacacatgtttaaaagagagagaataaagatattaagtatacgaggggctggtaatggtattagactgtctaatctaagtttataatgtatgaaaagtgaatacatgaagatggtaaaaatcatagatttaagaattgttggcatgaggagattctagaataaatgtgctggtataataagtcagagcagtgggatgtttgacattgagattttggagatgcttgggaattagtaatgatagaataaaaataatttgaaaagcttaacattcaaattagtaaaaccagaagagattcatcaattttgtggtattaggttatctgctcctaataagttcagatcaaaatttctgaaaactttttaaaagttaattaatatatatgtgtggaaaaataactagctctaaaagccattgtctaaattgaggaaagagtaggaccagtttttagtcactattcattttaattaggatttcagtgtcaggaatatttcaatatggattgtgggttctgatcttatttctaaatagtgacttttaatcagttttgtttgtaaacttattcattaaaaaggaaagatatttttaaaagcaatgtaatgagtttcgatatttattcaaattaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagaggtaacatatatttttattatagaagtatcaataattatgctttatacatttgaaaaataattgaattgttctaattttaagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaa

SEQ ID NO: 121399 - DNA, 2915 bp, Homo sapiens
atgttcatattcacagaaatattgtatatttaattacgtgtctcagacctaactggaatgttatgtaatatagagtgtgtgcaccatatttcatgtttaaatttaaaaattctgaaactcacagatagcaagaatttttgtttggagattgtgaacttaaaggtatttaaagtacctttaaaaattaagtatgttacttagagccattgtgacagtgagatagccatgttatccaatttttgtattacaatggcatcagaatgttagccccttattctagaaaatactggttgtagttcatattaactctacatgatttatctgattcttttgttcataatatttagttacatctcaggcactaaacctccatatagacctatgccagatctagtttgaagctcatctagaggccttgatttgacatatcatacttcttcatacattcctttaccttcaccgtatgtaatttctcctcctcttatattttgaaaataatatcacctcctcttccttccctccatatctcaaatatgcacatgccactcttctgctttgaaactggctgcgagtaacatctgtatcagaaaatgccagcttgttctttcttaaggccatgtacctgatttttctttaaaggatgatttgtacttaacaaaggcagtaccatctatgccttccttacctgttctattcctggctacctttatactactacttgttatacttgcttaattttgatgttttgttgctaagcttgttcaaccgaattttcagggtcactaagcaggcttagttaggagacagctaacaaaggactaccagatcggtcatttgaataaactactattgtgggggatgttagaacattgaattaggaatttaagagcaaaatagttcctatttccctgtggcagctgctaaaaagtactaaatcagcaaacagatttcaaatacaaatagtatgtttcaccactttgcaaattactttggacttcatttgcctcctgatataaatgtacatgtgaacttctcatggttgaggtacggggtctaattcttataaccgcagtacttaaaactgtctctggcatataaaagtactcagaatatgtttgttatatgagacattaccttaagattaaaagtcatctgtggtgatttgtttatttttaggtaagctcttattatttaaggtgtacacttggaaatacatattttaaatttaatatttttaaaaaagtattttctgttagaccatagaaatgattgagaaagagcagagagaagtggaacgacggccaatcaccaaaataactcataaaggtgaaatagaaattgagagtgatgccccaatgaaagaacaggaagcagccatggagattcaggtaaggatagatatgccatgttttatagctcaaaacatgaagattcagaaaaggtttatttgcctaatgtttttaaagtagagaaaagaattttaaaatatgcatccatttaaaagtagcctattttattggtttagtggttttttgagtgttgagtaatgtctctcaaattgcattataggtacctgttgaacagttattacagtgtagattcctggagtgctctgacttagtgaatttctttttattttttggtgggatagagtcttgctttgttgcccaggctggagtgcagtggagcaatctcggctcactgcaacctccgcctcccaggttcaagcgatgctgccacctcagcctcccaagtagttgggattacaggcatgcgccaatacacccagctaatttttgtatttttagtagagacagagtttcaccatgttggccaggctggtcttaaactcctgacctcaagtgatctgcccacctcggcctcccaaagtgtggggatcacaggtgtgagccaccgtgcctggcctgacttagtgaattttttagtaggcttagaaatttgtaagtgtttcttaggcagagtgtcatttgataggtggcatagcttttcttattttcaaaagtcagtgaagaaataatttgaaatcttactagaaggcttgaagaatggggaatgttttaatttttgctcttttaagtcacagttaaaagctagcattcattttcttaagaaatagtaaaaaaaaaccaaaaaacaaaaatcaaaaacttatctatggaacaactgcattttaggaaaatataaatggaaaatataaattgattttgataattgaggccaaattttatcagctaaaactaatttttactttgacttacgttaggaaccagccgccaataagtcattggagaagccagaaggatctgaaaaacaaaaagaggaggttgactctatgtctaaagataccactagtcaacacagacagcatctttttgatctcaactgcaaaatctgcataggtaattggaagtttttcttcgtaaaattttgcattcattatgaaagaaggatacttagatactagtatatgtaatttaagtaggttttgttttcccaatattggtggtgaggcactcactcacagtctttaagctttcgtgtgactggttttctgggttgaggtatagtttgatactgtggtatagtctactgtctagacctaattatactatatatgatttgaacttaaaaactgttcttgctggagtcaaatgacaagaatttaaccattagaatgaacatcaaacattgtgggcagttgtgatgatactgtcatttactaaagtaaaggagtaaaatagcatttatattttattatatataacataagacaaatcagaaactgaaattacttttttgtaaaaaagctttttatttttaagagcacttttaggttcatagcaaaattgggaggaagttacagagatttctcacatacctgctgcctccctacg

SEQ ID NO: 121400 - DNA, 2062 bp, Homo sapiens
ctcctgtcagatgcagtggcgttaggttctcataggggtgcaaaccctattgtgaactgcacatgtgaaggatctaggttgcgtgctccttatgagaatctaactattaatgcttgatgatctgaggtgtaatggtttcatcctgaaaccatctctcccctcatcccaccgtccatgggaaaattgtcttccatgaaattggttgctggtgataaaaaggttggggactgctaatcttgtccatatttactcatgatatgttttacatgtaggaaataattataaagagattttaaggggaaattaactttattacaggtagaaccatgcatgatttgctttgaattgcatttcagataagcttaggtccctgtatatagaagagggctggcagtggggagaacactagtgaattttctgctgattcttaaatgtggttgtgatacaactaaatgatgacagttagatataaccccaggaaatgtatggttactcagcaattgaatcatagaacctgaataactttagaaagtgaaaatgggttaagttataaaagttgtagttaacagttggtttcttttgatgtattctgggcttaggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacggtaattttctctgttgtaaattctgtaatactcattatagatctttgccagattatacttgcaagtcttcaaaaacagaaaagtgacattttgggaacctctcatttgagaaaataactgtactttcctgtactttgagataaaacaagacttcgaaaataaatatatttggagtgttttcagtgagagattggagcgtgtggggaaacagctttaaaattctctttaattatgctggtcccaaaagtcagggatagattattaaagacgaaatgtttgcacttttctcaatcttagttctcctaagccagccaagagggaagattttgtaaaacattactatgtaaatatgaatgtaattttataaaatgaaagtgtgaactctttgtcaatagcctcatattttggccttcttcacatgctaaaatacgagtaactgatgactaggtaggacattgatttattcatcagcttgtctttaggctttttaatgtcattttctagtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggtactgtgaacttttctgcttttctgtgcatgaattgataatgtgtgtttctgaaagtaattgacagggaaataagacagagttagtaatagaaatatttattaacaatgatttttaaacagtccaagtaatataattatgaattaacaaatggatctttagaattgtaaaataaactattctctgaaagttttaaactcctatgtcctgcacttttcccaagatgtactgcctcactgtgtcagataattcaaaatcaatgagagtctacatggatatccaagtttttctttgaatacacacttaaataaaagatttacatacttttggtctttaatgttaacacattaagaattttttgttaaacagatcttctgatttccccactgcttatgtttccccatcttcatgactactgttcttacctgcctatttctgtgaatgtggtttatgtagactgggagttgaagctttacagctagttgaaaaccagtgagactagtgactgtagttgctgcaagtgatacccttggttggttctacacctgagggaaatagaaagaaactattatgtggtatttatggaaaataagcagcagtaacattataatattg

SEQ ID NO: 121401 - DNA, 2784 bp, Homo sapiens
caggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtag

SEQ ID NO: 121402 - DNA, 1100 bp, Homo sapiens
taaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgatatatctggttgagggaatatcagactccagatttcttttgcaagatgaaagtaaaaacgagtgggttaatgaatgaaaacaagcttttaggtcagtttttgatcacctcttcgctaatagttttttctacatatctaaaattctttaatcagttctgatcgaatcttgatacatgtttttaaaataggcaaggcccatatagctttctattagggatgagcatctccaggggttagaggcagatcttgtaaccgctgattgactgaaacattttatggagaatagggaaggtatggtcatattagctatttgaggttttccttttgaggaaaaaaagggaaaatgagcagatttttcaatgagtagtagatccaaagccattctcagtcccaggtacaaccagccttacacaaactagtgaattacatgaatttcatctttcagtttctcctgttttaagaaaaaacctgctctttaaaaaaagttttacacttaaaaaaacttagaatcatcttaagacagtgaatgcatac

SEQ ID NO: 121403 - DNA, 1068 bp, Homo sapiens
cctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgt

SEQ ID NO: 121404 - DNA, 1797 bp, Homo sapiens
ttactgatgacacatttgtaggtgatgtatttgttaagtaattcttacaaaatacatgtaccactctttaccccagttaaataatctctttttggctaggctacattgtaggaaaggaatgtgaaaatctattgacctttgatttaatcaaatttaagcaaagtatattctatcttcaatatttgatattatgatatataaaatactaataaataattatttaataccattttaaataaactaccatataatgacatagagcttgaggttaatcattacatatagctgtactaatcatatctcattttattccagagtgttattttatatgataacatgaaattccagcttttaaaattgggttttaaaaattccacttatattttatattacttggtgttttccatttcctattaaaaaaggttgtctcttaagtcagcagaggaataaatacaagattactctcctttgactcccattttattcactaataaatactgactcagaaggcctgccttgagtagaaatatcttcaacatgtattgtaccatagaagtggcacaaatttgaagagtcttcacacttagtagatgtgattccagattgttttgtgtaatactgatggtgatggcaaagatatatcaaatgttgaatattgtgagtgtgtccactggtattatgacataatatttggtatttagtattgaaaaacaatagactctcaggagtgggatgcctactttgagataggatttatgctagaaccttctttaataatatattcatgtactgaaaaatttcatagccagaaaagaacggcaagaaaactattgctgtttttagtgacaccaacaattacagatgttatcttgaatatatcatacaaagtaaattatttgactaatgcttcattaaagtattacatttgagtacatttttaaaatttcttgtttaagatcatatttgacatatttgggggtatcatgtgattatagaaactcagttatttccctaatttttatatgaaattgtgaaagccaactaagttaacaaaatgaagccttttttttttttccaaataaaaatgtcttatttcaggcagctttttaaaaacctcttaacatataatggctataacttaaaaaaaaaaactcaaataacattatggtttaccagtttttaggtacaagtcaggagaaagactggtatttattaacaaagtcatctttaattgtcctgaggtctttactatagtttataggactcttttgctgaagataattctggactatatagctgagatataaaatgtggaataaaaatatcttatttcttaccacttcatttataataaatgattaaaacagttttggcagaaaaattctacaccaggatatctaaatcacataataagccttaatggaatctttgtttcttactgacatcaatggtgctacttatgtgaaaggaaattgggatctctgtatagattccaggaaatctgaacacacacactcatttgtctttctactctgcctttgctaatccttgatattctactccccaaaggaagtctcaccataggcctgtgtagactttagttcatgcctgcgtgtgtatgtgttgtcatttttagggacatatttgcaatctaatgtgatttgagtctatgtcagtttaattgtccccatttctttttacctttgttctgtttgccctcagataactttaggagtcatcattcacctttctctttacactcttcatcttccttttttttttttttttttttttcgt

SEQ ID NO: 121405 - DNA, 1036 bp, Homo sapiens
actaaaatgagaagagcctctgctctaagcctttgcctgtctatgatgactgtgaggcatgagcaaggaataaaacttccttttttgagacgctgagaagttaggggttggtggtgtcactacagcctaatctatcctattctgacatatctataatgtccagttgaggtggattggggaacagttgtggtgtgctaaaacgtgattagttacattggtgatgtgttctgtaatccagatgtaataaggtgatgggcatgtcagtaaatgatattttgggggaagaatgtatgcacatattccacattgtactctgaggtagctgcatatattactagcaaagcactctagaacccattttaggtatgatttatcaaaaatgatcttgttttagcctacttaaaattaataaatactaaaataagtacagtaattgtatatttttataggagactattctttcaacatttaaagatactcgagtttttctttattttaaaactacattagagagaaggttctgtggtcctttgttgaaccatgattgttacagaactaagagaaaaacatttattctagcatggtggttttgctgaaaggtaagaacttgtcctgttctctttttgtccttcctttccttcctgcctatcttccttccttttcttctcttgtattctttcgtcttttctctcttctatttctctcacagcccctccctccctctctccctctcttcctcctttgttattttactccttttttttgatacataggctataatttataaatgttggtctataggttggacattgaaataatttgcacggaatctgttattaatatacatgtaagtgtttggtaaacaaatatttctacaataggtcatgaggaacttgtaatcacttagtaagcactgcttcattaatcttaacaattttcttgtgaggttaattgtgtaacaataattaacatcccctttgagtaggtgggcttttgtcacactgagaagtattcttatctcccctcagaggcggga

SEQ ID NO: 121406 - DNA, 1032 bp, Homo sapiens
aagttaagacatgtctattctcctttagtcctcatttcaaatatcaaccactgtttacagtatcaccactttttccttttaaaatggactaatcagttttatttagagattgtttgacaaagggtgattgccccaaatgatggtttcctgaagaccaggatataccaaccaagaaaaggcaagtatattttgtccacctaagtaacttcttcttctgtgtatttttctgcaaatatggatgttcctttggactagtcctttctcaatcatattgaagtttaaatatatttactttaattggtaaaatcaacttaaaaatctctattctgattttttcctaaggattggtatgcatgttaaaagtaaccaaagtataatttatgtcttggcctgtattgaatgcctttttcctcctgagcagagtcaattgaaaaatatcttgcttgctgcctccatttttaacatttattcttaggcttaatgtaggaaactagcaataaaatataaatccatattctattttttaaaagatcatactgttttattttcaattttatgaaacttttacttttagatattacaaacaagagaattagaaatgtgacgttagacttttaactctctgtagtcctttgtatttaggagagaatttggattagaaaaccaccttctggaggagattttgacattactgtgtgagcaaattcaggcaagtcacataatctcttagagagaacttcagtttgctcagttataaagatcaaaataatcatctgtaacacactggattatatggaaagtgtaatatacacgaaatctatttagaaaagtgaaaaccagcatgcaaaaatgttgttgtaattattattattgccaacataaacttgtaaatttgttcacatttattagtttagttcattggcctgtatgtatgtgaaataatggtccagtcctttgatgataaatatcacaaattgttggatagatttgctgggtttgacattttaaattaagactctgatattctgttag

SEQ ID NO: 121407 - DNA, 1044 bp, Homo sapiens
acagttgtttcaagaaatttttactgagaaaatatttaataaaatttaacttaatgaatggataaggcccttttatattccaagaaatatcttcatatttacctttggtagcaaagatcacagggctgcctggtatacaggagtgcgcaatatctgggttgagcttaccttgaaatgagattactgtctactgcagagtttgatagttaagattatgtgtcaagttggctagtacatggtacccaggttttggtcaaacactagtctagatgttgctgggaaggtatttttttaaatgtaattaatatttaagttagtagactttcattaaagcagattactctccataatatgggtaggcatcatccagtcagttgaagccttctgagaaaagactaaggtctcctcgcaaaaaagtacttctgcttccagattgtctttgaactggagctgcaatatcaactcttccctgcatcttcagaccacaggaatgccctgcagattttacacttgctagcctccacaattatgtgagccaaaattccttaaactgaatctctctctctctctctctcagtaggtgtgtgtgtatacgtatgtgtttgtttgcatctgtctgtgtgtatgtttgtgtatgttaggtgcaataataattaaatgacaagaacgattaaagtcaccttcaagggttcgaatgggtataaaaataactgaaaataagtagagattcttatccttggtagataagttccctcatttccctttctgactaatagacagcatagaaggaagagagggaagtaacctaccaagttcaagaatctttatttactactagttatttacttctcatacaaaccctgggaagtaagtttaattactattgccatttaacaggagaaaaactcactcccagaaaagataatatgtacagcagtgtgtggtatgaagcaatgctgaaaactcagtgttatcagtctccataacctctgttattctcagattatcttgctacctgctgtttgtgagaggaattgtttgact

SEQ ID NO: 121408 - DNA, 1074 bp, Homo sapiens
gagatgataaaacaatttccctggcttttttttcagggcttttttccagacccttattttttgttacccattagtgaacttgggaaggtttttatttctaaatttagtgcctaattctcctgaagcaggtttcacatttggatatttcattaagattgtcctgggacaaatctttgtccttcaaatgcagagggaatagggactatttacttcctattctgctatctctatgtgcctttgagtgagaacaattactggaagagttgccaaaattatagtaaatttaaggaaatttaaaataattagatttcttatactataaaataagggacagccttcaaagtccaaagccaaagtcatttctaaagatctctattatttagaagttccctggaaagcatctcacacctatttttagaatcataggatatgatgaccttaagacactatactagaggcaatttatctgaggctgtctgagtggttggcatcttatacagttagagagagaaaggattttctgatgttaatagtgtgctttctttgattgatttttgtttggaatgctgtcaaaatattttaggtaataacatgaattagttgcaacgtaacatgattttaaaagctaaaaaaattttagacggcatgaaacattgtaagacaatagaagggaatttttttgccacaaatagtgataaaaatattatacattaaaaatgcaaccacttttacacaaacatgcataaataaatgtactagatgtcacaggggaaattcaaatgaaaatcttatttttctatttttgagatgtttaccacttattaggcgtgacaaagcaaatacaaaggaaatgttagaagaactagaatttaatcacagcttgaaagagctataaatacggtactactcttggtttatcatgcaaagggaaaatcgatttcaagtccaggtgacctatgagctataccttgaaggacattttgtatttcaacatgtttagatgtgctgaaactcttccagaaagaggtgcagtctatagagatgcaaagaacaaaaggaagaagagaacggcat

SEQ ID NO: 121409 - DNA, 1041 bp, Homo sapiens
attattattctgacatggaggaaaatgttccttatgagctccttctaggacatttacatttataatataataagaataatttttttcacattatatgacaaatttatataattttttctaatgattaccagtaattaaatgtcagtttctaacttggctccaaatagttaaattttaaactattttaacaatcataaagtgttcaggtcctttagtcaaggacaattaaccatttatttttatattacaggaggtcaacatgaagcaaatttagacaaattgtagttaactttgcataagcattttctttaaagaaaatctgtaaactccagactactttgattaatttaaaaacctttcgtcctcctgtaaattgattccattgtgcaaatgtcttgtactgtggtacttcttactcttagagaattgtcacctgtgctattcagtcagctcagtcagtgagaataaaaagacctcagagaaccacaaagaattctaagaagatgctctctctctctcaggaactgtgtgttggatggatcaaaccttgaaatcaaaatgttcaactttgagtttatgttaaaaagaaagcttcccatattaatgtctagaaataagttttacactgttctctcttggaagggcattatttttgcattttgttgacaaaagcaaatttcataaataactgtttcatttcaattaaccagtttctttgggatttattttaagatggacttcttaaagtaaggcttttgatatttttaaacttagaaatttgtatatatggcctgctttgatcatcattgttgatcaatgcttataatactagtctaagtggcaaatgaatttttctcttcgagcatgtaaactcatttatatacttgttcttttaaaaaaaatacatggaatgcctttttgtgctggatttctttgttctctcttctattgcaggaggttaagcttttcatagtaacatttttagtgttgactcatactacttatcttaataatttcaatcagtctaatggagtgacctag

SEQ ID NO: 121410 - DNA, 1084 bp, Homo sapiens
tgaaataggagctaggtttgctttctagtatgcctttggaaattgtccctaccttgactttctgcataaatggtcctctgccaacatccgtgttttgttttgtttttctttgttggtttttggctgaagaatcagctagcccaacaaagctaattacattttaacttcagcaaaactgaggttgacttgactgctgggtctgctgttagcccatcccttcaaaagcatgcttgatggtccatttctctttcattctgtatagataagattgattcattcatactcatggcttcaatcatcactcagtttatatctgcacagtcatcacattactcaaataaacatgtttcttactccttagcaagataatcataattagcatgaaaatttatcaacatacctaagctctatgtcagtgacaatatcttacctaatgaggtaagactgggaggtgttacttttagcagaatgtacttcattatgaaggcataggtttaatgggaatgtatcttaaggattctgtctgttcttgccttgaaatattaggctatggaaacaaaagataactccagggtaaatatttttaaaaagtaagaattaaatctccaaaaataatgactgagggcaaaatattattaataaatttattgaatttcaaagtgcactaaaatttttatgaaacaggagttggacagaggcttaatttatgcgtataacatcattttgcaacttatctgagttcagcagagataaaattcctttcataaataaagaggcggcaatttttggtgactgaaaaaaaggcaaagggcacagctatattagcaattttggtcttgatcgacaccacaggcattcagtagctactatttcaaattcattttaaactcttttttgcattttaatagttttgcttctaacactagaatgcaaatgtgaatttttgcctctagcgtgttttattgctaccttgtcaaaatcactagaaatctatattattctaacactacattacatttttcagaaatcagaaggagaaataatgtatgagtaaagtcagagggtatgaaaagatgttttgtga

SEQ ID NO: 121411 - DNA, 1028 bp, Homo sapiens
ccatcaatgatagactggataaataaaatatggcacatatacaccatagaatactatgcagccataaaaaagatgagttcatgtcctttgtggggacatggatgaagctggaaaccatcattctcagtagactaacacaggaacagaaaaccaaacaccgcttgttctcactcataagtcggagttgaacaatgagaacacatggacacagggaggggaacattacacactggagcctgttggaggttggggggttaggggagggataacattaggagaaatacctaatgtaggtgatgggttgatgggtgcagcaaagcaccatgccacgtgtatacctatgtaagaagtctgcaccttctgcacacatatcccaaaacttaaagtacacacacacaaaataaataagtctttattctgattaaaaatttgagattctttaagttaaaagttttaatcttttttatttcttcctaaacgaagttctgagagaaaaattgaaattatttttattaacttttttcaaaaaataatagatatcaatcaggtaagaactcatatctaaactctgtctcctcttagtcaaaatgggataagttgaggatttaacactgatgaattttccaaattgttcatgacttcctgttgaaattaactgaagctcaattatttaaaacatggcatggcatattgttatgcttccaatattttgaattactctggctatcttcattttcaactgacaaccactgtcttttattatcttaatagaaagagaaaaagaaatctgtgtactttgttttctggtgttttatacacaaacctcagtaattggattctgatactccattctcagttttatcccagggctcttattgattatttggccagtgagataggcactctggaaggaatacattaagggaacaacaacacagtctgataagtggttgccaaaatcactggtgttgcaattttggtaatgtacatctctgtcttgagatataaggttgggaatatgcagaccc

SEQ ID NO: 121412 - DNA, 1067 bp, Homo sapiens
tcgcttgaggccgggagtttgagaccatcctgggcagcacagtgagaccacatctcttaaaaaaaaaaaaaaaaagtcttgtatctttaagtgacaaattacatacttaagtgacaagtatccttaaaacaacttatgtctttaccttctgagtttccttagcaatatctttctctaacttatcagtagggttttattcagaaaaaaatgttaaaattatcagtataatcattctaaaggtaatattcatttatgtcctctcacacctgtgcccatatgcacgtaattacagagtgattcatgaccatgcaagtgaatattagaaaatgttgcttttaaaacaagtataaaagtgtgtgttcatacaatataggtatatgctacataagtataataactatatgcattatagaagtgtgaagaaaattagtggaacgtttcttttattgctttttatttttgctctttttcttgttgtttctgtggaacttgactgtttaggaaaattcaatttcctcctgggaaaaaaaaattcggtgctggttattgcagagacactgcagattgtcttaatcggcaaactagaacttcacttctaactgtgtaattttaactttcaatggtttgctgactttgaaggaggaaactatgcctcatttgccatatatgtaaaagtgtgaccacatcttcaccctctaaaaagatcttcttgaagataaattaaaatataatccacaagagatgttgatgagcaaggtaaaggtattattcaaattatgtatttgaaattatattatgtttaaataaagtaaattaaaaatcagttcaatgtgacaatatagaacattttggccaagccaaaaatataataatggttgtaggcaaatctaagttgtggcttggcaagcatgaaaagacaagttctagggatgaaatcagagtccaaaatctatgaaggttaatgcaggattgaacaagtggtcagccagggcagtgtcagtataacctgtagtttatccagagaaaaaatctttgttaagaaaaaaattggtaaaaagatggagatt

SEQ ID NO: 121413 - DNA, 1049 bp, Homo sapiens
catgttggccaggctggtctcaaactcctggtctcaaatgatccacccgctttgggctctcagagtgctgggattacaggcatcagccaccgtgaccagccgaggtggatgattcttaaagcaaatacagaacatctgaatggacatgtactttctagatgtcgtgggagaagtgtcatatgatagagagatatagatagatacatatacacttatatacacacaattaatacatttttaaatatatgaaaatgtgatcaaaccagaaaataccctaaagatttagtgaggtagagaacacagagtttttagttgtagtagatgaagacaagactataatgccacattagaattatttaaccagaacttttatgattctcagaatttgaacagggtcacagaggtgcaaagagaaaggcatgagtaaaagcctaagtttgtggtatgtaatgtgttcttaggagacactgagtcgatgagtagattaacctgattactgcagaggcctaatataagaagtgtatatgtgggtgtgacccatttataaagagcttgaaatgccaggctaagatagtttgaaatttatcctgtaggtggtagagaggtgatggataatagaaatatttacattattcattgtgattaaggatagtttaatatatctttttttttatttctgagttaacatttttaaaggaaacccacttttgaatatgtgtatttcagggagcttaagtacttttttacattagataattatatgacttgccaattgtaacagaagaatttaagtgttttaataatactttatagataatagtaacactctcttagttatgtatccattgtgccttgctaatgttaccatttcctgtggggatgactgtactagacagtgatatatataaaatgtgaggacttattctcacaacagtttgatttattaggtgattaactgtgaatgttgcttctactaatgtacaaagattgctactgtaagttcttttttttttctttttcttatactttaaattctggggtacatgtgc

SEQ ID NO: 121414 - DNA, 1023 bp, Homo sapiens
gaaagacattcagaaagtattattaaataatattaagatgtttaaatctaacacaattcttaaaaataaatgtgcttctataaacctgagaaaggtataatgttgatttgtctctgtttatttaaaaagtatgtcatagtcttagtaaagacacttatcatttttttctttgcttcataattatttgactactcatttcacctcctcgactagactcttaatttccatagtaagagggttcatgctcatttctgagtttcccacattaatttgcctctagacccaaagtctaaaattaaagatatagtgaaatattttcccagtaaatcatatcaacaaagatgatacgttactgccttaattataacagcatgcattttcatttttcaatgtatcttttttatctaattttttcattgcatcattgttattagattggttggagtatgatactagaaagatcaattaagggttcaaattctatgtgggacttttacttgtctttctcatggccacaaattcactctccactttggccatatttgcagctgtgcaatattggttaaaaataaaagagagtgggtggacagaagtagaaatattatatgaattcatttatatctctggaaaataagtttggagaacactatctgttctgtctgaatcagaagcatgcttgttctaaaggaacagcacaacatttacttctgcctgcctggaaatctgaaatttctgttgatgatcctcccattttgacatgttagcatctgcccactgtgtacttttctgtgtgctattaccagcagtgtgctcagaaatatgatcagcccatttaagacaaggttgttgcaggaagactttttaaaagacctgttcctttcaaaggttcatgattttaaaccaaaataaccacatccattctttataggaaagatcatatgtatacaattgacaatgtcaagataccttaatgtttcttgatttcatttcatacatgtaactgttcatggtgaattattttaa

SEQ ID NO: 121415 - DNA, 1126 bp, Homo sapiens
ttcattttttttttaatatgtcatattaattggcagtttttaacactacattaaggtgattgaaagagtgggctttggagagagacctaagtttcagtaccatctctgacacttactagccatatgatcttagtcattagctttggttaataatcttttagagaaagtattaatcatcaattttatgaaagaacctatctcaccatagtcttttatttgctttcacagatcagtgtactgttacccggacatacctattccttcacaagttctggttcttcagtgctgcttactattttggtaactgggcctttcttggggtaagtgcagatatcccacgcgtgatttgaccttcctttataaattatagttaaatgtgtaaactctttttatcttactaggccatttgtatcatagtactgtcattgaattttaaagcattactttccagatgattttaaatttgaaaaataacacatggcttatttaaatttacaggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgccttaggttctccagagtgatgtggaattttaaagtgtctctctctgattgcctccaaataatatttacaatatagctgatgaatgttactcccatatgcaaattgttttcagttttctgcataaaatctttagcaccactcaagtagatttcatgaaaagat

SEQ ID NO: 121416 - DNA, 1051 bp, Homo sapiens
atcaagtcttttatctcatagataaatgcaattttagtttaatttgctttagtatttttcttaagataatggtattaaaaattttggtaatagtttggtacttgttagttttttgaggatttttttttaagcacagtagcctaatctaaatcaaggttgatactgtaaacatttgccggatgagaataatgaagtttttagcttattttatatgactgttagagtgcttatagtttatatgttaaatttaatttcatctttttttttcaggttttccctcttgattatattcttataacaattattattatgtactttatttttacttcaatggcaggaattcgaaatattggcatatggttcttttggattagagtaagtatatattacagtattatttttttctcatcattttgtgtgtgatctccataattacaaattatcttagatttagaatatagtagctgtatctttataccacaagtgagagaaatactagccttttcacttcatgttgacataaaagtactttttatctagagcagtggttcttaaatgggggtgattttgccccccggaaacatttggcaatatctagagatatttttagttgttataattggggaatgctagtggcatgtagtgggtaggggccagagattctattaaaaatcctgtagtgcatagggcagacttacctagcctaaaatgtcaatagttccatggttgagaaaccctggtccaaaagttatattatttcttagtagaaacacattcgaatataatagatacactgaagctcaaaagatagccctccctattagtaaagattaccatatcattggttattttcttcaaatgcttattttgagataaattaacaattttaaaatgaagctgtatcaggtagacactacttccagctgtgggtaaaagagaactcagttaaatagtggcttgaactaataaaagatttcttgctatggaaaaaaagaatctagtattgcttcagtagctcaaaaagtcagatccaatatctctgtaattcttt

SEQ ID NO: 121417 - DNA, 1591 bp, Homo sapiens
cctaccattcatgatttcataacattcattgatctatttatatcaattccagttaaaggaggagcccaacacacttaactgtgcttactgggactcttctttttggatctggtcttgacaactctttagcccagttgtccccgcaacttggggaagatttcggggaaaaagagcttaggtttttgctaacatagatttcaactcttttatattctgaaacttttcattagagactcagttataatatttttcttcctctttttctaccatctttaatataaagttcatacaattgggagaaatatgttccactacttacagtgcttaggacattttttccacagaaacattgttttacctgacaattttttcagtgttgttagtactctgtttcaggaatagtatcacttgtataggcttttatggattgtaatataatttaaccactatatatatcatttatatatattattacttctatgggaaaatgttctaaattttctattttaactaacagggtaatataacctgcatttcatggttttggggtgtgtgtgtgtgtgtgtgtctgtgtgttagtcataatgtacttttcagtctcatttcagtgtaatagaataaagactttgtatttggtctaacaaagagtttcatttgtttacttattagtgaagacttttcaaatgctttgtctcttttatgtacatgttctcaatcaaatagtctcataatgaaaattcaggtataaatgcctggaattgtatactaagttaaaatgtatcttagattgtttttgttagatcattgtcatattctagcaactcatattgaatataatgattttgtgcttttaatatcaacttttagaactatattttaatgaatatatttttgcttttagatcgtctggggaatatttttcatcttagttgcattgctgtttgtaatttctctcttcttgtcaaagtaagtacagtagacacattttctaaagcacttatacaaattctatgataatatacattttgttgctgaatgccattagtgtaggctgttcatcttaagtagcttttttacttgaagtgttctatagcattaactcaaagaatggctaaaacgtccaataatagagtgtttctttattctccatcaattgaacaatagctgtgagatatttaagtgaggtttaatttgttatccattgttttctttgactcaggtgtatttgcatgcttaaattatattttttctaaatttgctgaaaatttgatagtataacataaatttcattctttgtaattttttttagtttagataaagctcttcattcagctggaatagattctggtttcataatttttggagctaacctgagtaatccactgaatatgcttttgcctttactacaaacagtaagtaaaatatcaatcattttatactgtagctgctagagtataaaatgctagagtctagcaaacattctgacatcctgttgcacataaaattattatgctaaaaacctatgaatagtttgacatatgcttatattattttctagttttactttttatttgcctgtaatttacacact

SEQ ID NO: 121418 - DNA, 1019 bp, Homo sapiens
ggtggtgtgtcattggcagcagtagaaaatttacacacttttaaatatgaaaagccacaatttagaatgaagatataataactgtggttatctatgtaccagttagcacagcagccacctttatgaaagcaaaaactatgggagattccagaaggtagagattgaaatataatagtaataggagaataacagcattctcagggtaaaacatttcaagtggatgaaatagagtaagaatatagaagacctaataatcagtaaggtataacttacaacttttaaactttacatctagataatagaaaataaccttttctccaaatgtacagggaacacaaaagttgatcgtattattaattgtatcctgaagaaagtatcaggaagtttcaaacagtagatatattacaaacaatttttctctgattgcagtgcgttaaaactagaaattgtaacaaaatcaatagattaacatacttttcacttgaaaattaaccttatattcagcaacttttgagtgaaaagaaaggggaaataaattacagaatttctaaaagttaatgataattgaaacatattagagtctgtgggatacctttaaaatagagatcagtccctgatgtgattctgtcctgtgcggctgttctcttgagctgtggttgtttatctccatctgccttctctcccacctaagtgtgtgctgccacctgatggaagatttgatggacatggacataaacccccggaggccctggaactatctatttggttgtgaactacaggctgacaaagattatcactttaaggtggataatgatgaaaatgagcactagttatctttaagaacggtcagtttaggggctgatggaaaagatgaattacacatcgttgaagcagaggcagtgtattacaaaggcagtccaattaaagtaacactggcaactttgaaaatgtctgtacagccaacaattttccttaggggctttgaaataacaccaccagtggtcttacggttgaagtgt

SEQ ID NO: 121419 - DNA, 1038 bp, Homo sapiens
gttttctttatgtttttggtttcttaactgtaattcagatgtttcttaaattttgatgaatattaatttatatgtctatttttggttcatatttttgtgtcctcagaaatgtttgtctatcctaaggtaagaaacattttcttctagaaattttgtagatttacatcttatgcttgggatcatgaccccatttaagttacttttgtgctatggtatgacttaagggttaaggttcattttattttctatgtggatatccaattgttccagcataatttttttttcaagactatcctttgctcattggctttccttggaagttttgtcaaataaattgattgtagtgtaagtgtgggtctatttctggaatctccattctactcattgatctatatatgtctttatgctaatacttggttaatagagctttataatctgccatgaagttaggtagtataaattattcagttttattttcctttttcaaaatcattttggctttgccaaatcctttgcattttcatataaatttaagaatcaatttataattccacaaaacatccactaggatatctattgggattactttcactcttatagataaatttgggggagaattgatatattctatccatgaacatgatatctatttatttacatcttaaatttctctcaggaatgttttgtagtgttcaaagtagaggtcttaaaaatatcttgataaatttacctctaagtattttttatagtcttgcaaattatgttgtttaatttcagtttttaatatttgttgttagtatgtagaaatttgtctttgtatcttactcttatatcctgcaacctggttaaattattagttctagtaccttcattgtagcttccttaggaggttttcttttatacatgatcatatcagctgctaaaagacagttttacttcttccttataagatttgtaattgcttttattttttacttttctaatttcactggctgaaacctccagtacagttattctttttgttagtaaatgtgtcat

SEQ ID NO: 121420 - DNA, 1889 bp, Homo sapiens
atattctgataattttactaaagatgcctactggagaattaactatgctttaggtggattggtttttacaagggcctaactattgaaaagatttaaaaaatctcatgttttgcaaagatacttaagatgtagtatacctgttttctttaaattttaaggttgtttttcaaccttagtttcaatattgagtgtaagcatgtatctgatgtgaaggtactgttaaagtgttgcaagaatattttatattttaaagggcttgctaaatgttatacttttttctccttggcatctagcaaattaaaacggcactcaagtatactttgggatttgttgtgatttgtgcactgcttcttttagttgggtaagtcttgattttttttttttaaaccatgaaatggaaatagaattatttgaaaaaaaaaataaaaggatcattcagaaaaatctaggaaagaaaaaaatgtaagaaaaaagaacaatccactctctaaatctccaaggaacaatagccacaatttaacagttttgtctatgttgtttcatctagacatttttatgtgcttgaatgcaagcagagttcacctcccttcttgcatgcattctacatgctttttacacaaatgtgattatgttttatataattcttggtaatctgcctgttaacatattgtgggcatctctgcaggatagtaagtgtagctccatcaattttgactatattgcgtttccttctaaggatacaaaaatatatttaactgatcttctagtgatgactgcttagacatttataatgtttccccattataaataacactttgatgaaaattcttgtctgtgcatcttttcagatttgaccctatcagtcttttaaatctttgtcaatgaattccctttcttaattcttcttgtttttatactaatatcagtaagattttgcttatttgtttgtacttctaaaatttatccttgttaatggaagacatttatctttgttaaaaataggtcattagtctcattttttatgttaggaaatatattaggagttaataaattttttaaagtttctgtttataatttagtctcacaattttcaataaataactttccataaataaaaaaattacttattacatgtaacttgtaatgggaataaaattgttgagtaatgggaataaaattcttgaactttttgtagttccaggagttcttaggatgcatgtgttttatagtcaagtcatattttcagttctttttacctgccttgatgtgtcatgaaaaagagtacttttgtaagcactttttttagtggtttttctatgtattttagctctggagtatatttctaaagtatttttttggctttttaaagaaagccaaatctacttatgttaatttcccttgttaacatcgaggtcccttgtatgcaaacctgaattatctggagcgggaatcagcaaacttttcttaaagcatagatagtaagtattttagatttattgtctgtatggtctttgtgtctctcttgtagctcagaagtaatcatagacaatacataaacaaagaacatgactgtgttctaggaaaactttatttataaacacaggcagccaatagtttgccaactcctattttagaacatgagtgagaatcatcaataaaactacaaatctttgcaacagtgagaataagaaaatagtgaattaaagactattagcatttcagccatctaggacagtgttcttctcattatcatacgtaaatatttgaatgaggcgtgcatttaggttaactgattgacaaaaggtcttgaaatatttttgaaggtggcatattcagagtttcttttaagtgatatgcttttgctaataaaactagataattttatggca

SEQ ID NO: 121421 - DNA, 1226 bp, Homo sapiens
gatcttctacacaggtggggatatgtggggacggccatgtcgccaggaacatgtggggcaagggcaagaagaagagtgctggtattgccaggtttgggtggacccagtttctaatggcttgcatttgcatatcaaaggttgcctaaacttttctggagatgctttaaaagatgaaaacttcctaaggaccgttttcctctctatctgcctacaataatttcttaataactcctacaatataaagctacatataaacttttaattttgaaaccacatatgagatttctgttttctacaacaggaataaataatatgtattcattttcaaaatcctgaaacttcttgaacctactttgcttcatttagattcactttgtaacacttctttgtagcagttcagtcaagttactttaaatctcacctctccttttatcattaccaatttcccactcctgtttttttgattttaaatttcaattttctaaaaattttttctaagtattgccattagtagactgcagtctctggggaatttgtactatcaactttactctccacagagtcattttaatcccagacttatggttgcttggctcctcctccttccctccctcaaacatcattctcagtattagattataaaagctttataataatacaaaagctaaatgtttccagaattttctctttgaataaacatgaaacttgtgttttataaaaaaaagtgtaattgttgagttaggagaaggatgtcatttttttcagcaataaagattctgagtaagatttcagtaggacattaaatgggaaactgaaaaaaatctacaaaagtttctatggatgggatatgttttcgagttccattgaattgttttttttttttttttgagactgagtctcgccctgttgcccaggctggagtgcagtggcacagtctcggctcactgcagcctccgcctcatgggttcaagcgattctcctgcctcagcctcccgagtagctgggattacaggcacacaccatcacgcccagctaatttttgtatttttagcagagacagggtttcaccatgttggccaggctggtctttaactcctgacctagtgatccgcccatcctggccttccgaagtgctgggattacaggcgtgaggcaccgtgccctgccccattgaattttaattcagctgctttgctcctttgcctttatcctaatctaaaatctgt

SEQ ID NO: 121422 - DNA, 1104 bp, Homo sapiens
ggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactg

SEQ ID NO: 121423 - DNA, 1052 bp, Homo sapiens
aaagcagtccacaaacaaattcttccttatgttgtctgtgtcaggtaggaattaagttttctgtttctgttttaagaagggaaataccaaggcaaaaaaaaaagtgtagttccttattcaaagtgatttaaagtaaaactaggaggctctggtgtcatcaaaccacacttctttgagaagaactagcaattgtgtatggtaagaggtgatgcactcatcagcttttaagattttttaaaaatgatttttcaaatgcaaataaagaaactgctgcttctcaaggaagcttgcacttccttcaaataaaaagccaggtctttttatttttaggtaaacattcattttaaaaaagtaaatgcctacaaattcttgctggtatttttagtgagttggttcctgtgctcttataaattaaatagggatttgtggtggacagcaggcagaagactagaatttctagtcagaatatatgaactcttatgatgactcatgacattagtttgtagaacccacttaacctgtgtatctcagtatctccagctgtaaagtaattaatagcaaagcaagccctaatcatttaaacatgcttagggccaccgcagacaaaaattgctatataaatacttagtttttatctctttaattttagactgtgtagtaagagtataattgactgcttaaatcccaaatcaaacatttcttttttaaatttcagacttctgtgaaaagtctagtagaatgctggtgaactgtggactagcactctattagacttttctaatgtactagatagatgtaccaaataaaatgacctggctttgaaagaagtgcaagcttccttgagaagcagcagttctaatgtactagagttttctaattagtacattaactaatgttcacacattagttaatgttcatacacagtgaaacagacactgcagcattcagtttgtaaaacagatattccttttgtttgccacgagttgacactgaaaggaaatgtaagagttacacctatatctttagttaatccttaattttctgttttatat

SEQ ID NO: 121424 - DNA, 1117 bp, Homo sapiens
ttctgttaggcagaggggaggtagtggaaaacagatttgtcagcatcattatgtatatatatgtacatgtatgtttctatttaggggataatcaatacaaaagaggtagattaaaggaaattaggcagcaacaatagaacaaaaagcacaacaggatacaagagtaagagtggaagaaactgcaaacaggccttgaacttatactgataaaggaattttatcaccaaaatttgttcatgcatatttctgctttcagtatatcagtgtaataattcctttctccaagttggttgagtttcaattgaagacaagtaataatagttactatttatggaatctttaatgctaatttatttttccttaaatattaagttgagtactatgtgccagacaataggaatatagcagtgaacaaagtagtcagaatgtcctgccttcgtggaactttcattttagtggaggagaaacattaaagactaataagtaaaatatttagtatgttaggtggggataggtgctgaggaaaaaataaaggactaaagagatatggtatgccaggaataaagaattaatatttttgatagtgcagccagaaaaggcctaattgagaagctggtatttgagtcaaggccagagggaactgaaggagtgagtcctgtggatatctggagagaagaatgttccagggaacaacgagtgcagaggccctgagacaggaatatatttcatgcgttcaaagagtagaaaggaaataagtatgatgggagtgaggagaatcgtaggagatgaagtcagagaagattcagattacatcatataattttataagccattttaaggcagtaagattggaagccacagagggtttggaacagaggagagagacaaaagctggttttttgaaaatagcctgaagagggggaatatattagttagggtatagagtaggtatagctgctgtaacaaagagttacgagacatgaaagtctgagcagtctaggtagggaagacattcggtaatccagaatttgtccatttttttgctttaccgttcttgaggacttggtcctaatctatgtgatcaaaactagggacactgtcaagttggtattccagc

SEQ ID NO: 121425 - DNA, 1066 bp, Homo sapiens
cctcatttacctttcagattaagatgtcatgcagtaattttacaatgctcataatgtacttatttattttctaatcatagaaataagtaaactttcagaaatgttccaatactgcagtataaattgataatgacactatagtaatataatcaaacatacagtattttaaagtacaagtgttaatttgcttgtgttatattttacttttatctgtcaattacatatcttatctgttttaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaaggtaaacatctcttcatatttatttatgtaaatattttttgtaatgcctcaagatgttatttctaactttctataaaatttcaaaaagtatctcatagtgtaatttcttttcagattgaagaaacccttgaggaaatgaattttctattatccttggatctacacttcacagatggagattattcgtaagtagctaatcaattaaaaaacctttaggcacttatgactgttatttgttattattagattgcccattttcctcttaaaattcatcctatccctatcttgtcttgaactacttgtgttttctggggaaacttcatgagaatgattaggccagctctattgtgcccatgccgaatccatgagctccagataacaaaaccagacaagttaaagaaatatggaacaatttttcctagctcctagaaattgcactgttaatgtaataccactaccgtgaggcatttaaatgtaaatgagctcttttccactgtatcactggctaatctttcttgatggcatcagttatgctttctttaggtaggactttgttgatattctgagagttatcaagactgacgatgtgcacttgacagttgttctagttcattaatttccagagcccttgaggaagttttaggattggctacctccaacttacccacatacctggacatgcagtcat

SEQ ID NO: 121426 - DNA, 1023 bp, Homo sapiens
aaatctaatgatatactaaatatctacaataagatatgttttactttttaaaataagcaatggcctgcttatttttgagtagcacttaataaaattttgtagagtaaaagtaatttgaaatatcctttgggatttattataatagtatttgacctatgttgtactgcagccttgtaataaacagtattctctatggggtaaaattttaagatgagattaattcctgaagtatcaaaaaggattcattttatagggatattagtgaaaaaatagttcatatcatggactgatagaaaacaataataggtgggatctgattattttctcaattggtatgtttcatattgcttctaatgcaactttgatgctttaaaaattactcttattcgaaatttttaaaaagtaattaagtaaatagtttttatagtttcaactactttataatatattggcgtttactaaatgtttcatacttacatgctaagtgttcctttttacagggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataaggtaaatttgactaatatttttgtattaagccattcttacactgcaataaagaaatacctgagactggtcaatttataaataaaagaggtttaattgggtcatggttcttcaggctgtacaggaagcatgatgctggcatctgcttaacttctggggaggcctcaggaaacttataatcatggcagaaatcaaagggggagcaggcatctcacatggccagagcaggagcaaaagagtcaggaggagttgctacacacttttaaataactagatctcatgagaactcactcactatcatgaggacagtatcaagaggaatggtactaaaccattcgtgagaaatctgtcc

SEQ ID NO: 121427 - DNA, 1091 bp, Homo sapiens
tagaaggccactacctcaaatgtaaatttttaaaaatcttcttttgaaaatgaatcatttacagaatagagctaatttaggctatcacttatcctcaattaatggaaagttatgtttcaaatatctttattggtggtttggaaatcaaaaacaaattttagttagttttaatgaccagaccacaaaactattatactaacatattaatgaaggacagtatcatgtgcctgaaaaacagtgtgatgaaaagtagtgatgtaaagcttaaaatccatgtgtaatgtcatttctacaaaaaaacccaaaaacatgtgttaatagctttgatgtggaatactacagtagtttcaaggaggcattatcttatgttcaagagtgcacatttggaaccatttctgtcacttacttactttgagcctacaaacacaaagtggtttccattcacatggtaagaagattgaagggaatcagatgtggtacatgtgtcaggaagcaaaggtgagattatccaaaagaaaaagggtgtaaaggatctctaggaacaatacttcttaacagtgtacttcccttgggcttttaatgagcacctcctgtgtcagttactgtgctaggtgctgaggaaagaataggtccctgcctttaaagaactttgacttctcctgttccctctcctctcacagcaacagtattaagaaatcagctcagcattgggatgggaaggagaaattcacccagcaaaatggggcttcaatatatgagatgggcttataaattacctgtataaggaagatatccatctgcatgtaatattaaagtagatttaacatgtaatatttacaaagaaaaacatatgaaccacattttaacttagaaaaaaatcctctctaaaaggtagtatgtttattggtaaaatttataattagtaattaaataaaaacatttctccttttaaaggcaaatatttatttcaaatagcttagaccagcagtccccaacttttttggcaccagggaccagtttcttggaagacaatttttccacggattgggggaagtgattgttttgggatgaaactattccacctcagatca

SEQ ID NO: 121428 - DNA, 2189 bp, Homo sapiens
agtaccagtccacagtctgggtgttggggttagacagtgttagcaattattattaattagtctagcttcagcatgatcatgtattcataagattttcaactttttctctggtgaggatggcttttatgtcatgtatattactttgggcttatagatgtaatatagaaagtatcgtaataaaagtgcccttatatttaatttcagaagttaattacagaatgaatgtcaactttattccaaattatttgcttaaaatattttatcagaaaataaaattctaaagcaaacccagacttcagttttaaataagtatatgatagaaataaaattactagtaccttacacatagacttacttaaaatatatttctcgaatgaatgaatgaaatagcacaatacagttttcattgttacttgaaaaagtataggcatcaacataaagcttaacagtttcctagggatttttaaaatcaagattcatcttcagtaaatattggtaatatattgtggtgttcttaaactttacggtttttattttcctttctctttattgtgaattttagtttattcttgaatgcatcctgtaagaaaacatctaaaaatactattaacttaaaaataaaagtatttgttacatattctaaactatcaatgtcttttatttttattctagcaaaataaaattgtgaacactaatatatttctataatgtactattgaccaaacaccactatattcaccagttttaataagtggatacagagtagttcttgattaaagaatatttccttctattacttaccactttcattgagttttcaaataagcatatatttaaacttcttaaacttgactatgctttgaaaacttttctaaaatatgttccctcttttaaaataacgccttgagttcctttcggcttttttgcctttctcttttctcccagatgaatgatgtacattttctgatgacatataattaaatattggtttggtgcagggagctcttactgaacatgagagtcaggagttctggaattaggtttgggcaagtcacatagcctatatgaaccccaatatctacacttgtaacagcagggagttaactctgagatccctgccaacctaaaattctgagtctaattaattaagacatattggattatgaaatgttgagtggcacatacatttaaattaaaaaaccaaagaaatatatacttgaatgtacatcatttgtaattttgataagctaattaactaactgcactatcagatcaacactaagtctattattaacaagttggaaaattctagtaagttttgttgtgaaaggagtatagtaactagtgctgtgtgcaatccttatgactagccaaggccaacatgcagctcctatatgagcgtcttctcagaagaaaacagctacgaacacagaaagacaaccatctaggtacgtttacaaatagcttaagtaaatgatcccttttaattaaaaagtatgaaattttgctttaaattagcatcagatttcataaatgtatatttaataatgtggtatgtttccaccattctgaagaacttacctttaaaatcaatttggtttgtagataaattttggttaatttcctaattaatttgtaatattgaagtttttacttaaatctggaaatggtaaatgcaaaactcactggcttttttcatatgttttttaaagtttctatgaagagcactttttcaaaaccatgattattactacaatttgttggtttaatgacatcgccttaaatttgctcagttattttatctttggctaggcctagtgataatgaaatgtgattttaaaactaaaccaggccgggtgcggtgactcacgcctgtaatcccagcactttgggaggccaaggtgggcagatcacctgaggtcagaagttggagactagcctgaccaacataatgaaaccacgtctctactaaaaatacaaaattagccggatgtggtggcgcatgtctgtaatcccagctactcggaggctgaggcaggggaattgcttaaacctgggcagtggagattgcagtgagccgagatcgtgccattgcactccagcctaggcaacaaaagtgaaactctgcctcaaaaaaaactaaacctagttttctgcactgcagaaatagagaagagatgggaggctga

SEQ ID NO: 121429 - DNA, 1913 bp, Homo sapiens
taatgaagttagttaacacttttgttgagatatcttttatccttaaacctaacattgtattgccgttgtctgagctgtgttataaatatttgttgaatgaatggatagatttagaaaataaatgttagatacatgtaccctttgacctagcatccccacttctgttcacctgtatcatagaaatagcatactaggtagtatgtaaagatacaggtacaagcatgtttattgcagtattgttcttagtggcaaaacagtataaacaaagatcaatgcccattatttgggcaaagagtggaatacagaatatatcatgatgcacccacatcaaggaatactgtgtagtcatcttaaaaaatgctttagtgctaggtaccagaatactgtggggtaatgctgagagaaaaaaagcaagatgcaaaaaattgtgcaaaatacaatcctatttttataaaacagtgactccaaaactcatatgtgtatatgtatatttgaaaaatatggaaggatatgctctagactgtaaccttggattagtaataagagccaagcccccccccccagaaatatatgataatcatcacatttatacatttctataaaactgtataaatggatatacagtatacccttgaataacaccagaactggggcactgacccctgtacagttaaaaatatacctgtaacttttgactcctctagtacttaccaactaatggcctactattcactgaaagccttacagataacataaacagttgattaatacataaaaagactagtatctacatgtttttatgcaatcatgacatattcatctttcttaattttttcaatatttctaggctacatagtttgcaagtttcatattctttccaaaatatttattgaaaaatacttgtgtataagtgcacctgcgtagatcaaacctatgttgctcaagggtctgttatatatgtcactttaaaaagaaaaaataattaaaataggattttaaactcccttaaaaatctaagtgatttcaaaattattttcagttctaagattttagagttaaattatgcttttaaacattctttaagatactgtttgcattgaagtagctctcagtagctataatgcaaacatacccatttatgcagttaggttcttctatgtaaacattagaaaaatgtgtcacaactctcaaaaccttattttctaatttttaaaaatcagaggtagaatatgtaatttctaagactaactttactgattttttttctgtcacaggaaaagatcatgagtaatgtgaaaacagatggtggttttaatgcagagtctgttgctggttttttagttttggaaagcccaatattagaagccactggtttatctaacagtgaaatgatttgtgaaatcattgcaaatttctttagttaccaacaagttggccaaattagtgatctattttttggtatatatcaatatctaaatacaatttacttgtatattttgtgagttatgaaatacatgtgttccattgatttttagttaacaacagagtatttgttgtttatgttaccgggtggggtacagcgtccttgattcttgttgaaggaagaattcagccaagagacacgcagcaagggttaagcagcagaatttatttaaagagacagtagtatactctgaaagataaagcagagcaagcttctggagagagtgagctagcagcagccagtgctggggaactctatgaagaatacatgattattcatgaaagggcatgaggaggtgtcacttgcaatcatgttttagatgatccccttgggcatacatgctctgtagttgtacatgctagtacacacgttgcttgtctcgttagcatttaaaatctccacctagggatgtgttttttactattataat

SEQ ID NO: 121430 - DNA, 1050 bp, Homo sapiens
aaagtatcacaattttttctaaggagtcatagatattttaagtattttttcttagctaattggggaaaaaatctgaagaatttattatctttcaaaacaattataactctcattatttgagcactgtgtttaaaattcccagtattttggtgttagaagctgatcattctctatagcatcctaatttgtaattttagtttgcaattgacattatttcagttaacaagacatcttagatattgaaatattggttaagttgttgaaaattctttcagtaactatcaggtaagtaaaaaaccattgttaattggtctttgtctctacacatgtgcatgcacatacaaatgcacatctctttttttaaaccacaaatttgcctttgtattaatattctcaataacattatatttaagtatgttacattaaatcttgggaaatagtgaaattttttttcttttcatttcagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtaagttaaagagaagtgattttagagcattttaatgagtattatttacctttagaaaatttttatgaaaacaaacctgatttttacctatatattgataaatcagaaaagagacatttgtcatattgttattgtttgacttccaaaattaataatagaatagaacaatacagttaagcatatgacctatttcaatcacaatccctgctgctaagaaaaaccacctaaaagtaagtaaaataggaaaatatatgatacagaatagaataggaacctaagaataggaattaatagccaagcctcattagggacaggaatcaggaactagagagctgtctcaaacttatatctccctcttctccttttccttcccttcttctaccactgacctaatataggaatgtgtattattaacttagcaggatgga

SEQ ID NO: 121431 - DNA, 1037 bp, Homo sapiens
tatttccaaggcatgcctatactaaacatactttagtataggtatgatatgatatatatgataataatttagttgtgaattttatttaatgtgctcagcttttaatgcactagtattccatattattaaaaatgccaggatattggaatatccattaaaagacctcaagtattaattttttatttattttgtgtgatcttttataggggaattctaggctttttttttaaggacggatatttcttcatcacgttctcatcatttcttgtaactgcctgtgtacttacctctgtaattcatttttctttgtctaatttgctcttttaatgtggtgtggattgggaaagcaaataactgaaaccaagtgcaattgtatcaactagtaagtataaatcagctttgtaatgaaacaattttatgataattttgctatgagttagtgcaaggacgtaaaaaacatttgttcagtaaacatttgcaaggtgcttatttttttcaaggtagcatagatattagataatctatcagatatagaccctgcactcaagattagaatctaatctgaatgcacatgtatagaattgtaatataaatactgtgttagcaatttgaacagcattattagaatgaacacagatacaggagtatttaactctgtgaagcattaacaaatacttattttgaatgcttggctgtcttcctcctagcttttgaataagtgatgttgccaaataagtttttttttaattgggcacacaaaattcattttttataaatatcaaaaatgcatgccaaaatacatacatatacaaagcagtaatatatatattccccatatttgaaatttaaatttgtaaattaaaaatttttttctgtcaaacttttgcctgaaaattagctgtattgccatcaggtggcagtcataccttagttatggccacacactacagttaatacccttagttgtaatagctacagcatgataattatgctgagagtgaatttagaaagaacttcatttgggtgcatacaagaaa

SEQ ID NO: 121432 - DNA, 6172 bp, Homo sapiens
ttttgagacaggagtttcactcttgtcgcccaggctggagtgcaagggcgccatcttggctcactgcaacccctgcctcctgggttcaggcgattctcctgcctcagcctcctgagtagctgggattacaagcacctgccaccatgccccactaatttttgtgtttttagtagagacagggtttcaccatgttggccaggctggtctcgaactcttgacctcaggtaatccacccacctcagcctcccagagttctgggattacaggtgtgaggcaccacgcctggcccatagcttctcttctaaagaacattacactttaggaggggagatgatttattttaagacaaaaggtggtaaaggctatggtggtaatcataatagtttatatttatatatgctttccagatttatttcatgcagtacaaaaatacattggcaacactgaagagggagaagggaagtttaattctgacgggtgattgtggaaggcgtaatggaggcagtttctctccttaccataagatgccggattgactttttaaatacgtcatgttattaatactctcctttggaattttttaggtacgcagattttctgaggcattcttttgttttgagcatccaagagaagctgccattgcataccaggaacttcagtgagtagtataaattcaaaattaaaatgatattacttccttttacataagatacctgtctcagaatttatcagtgacagaatatacagtattaacaatataagaaattaggagaatttgaatttcagaaatcccatctataatcaaattgtttcatcttattagttacttcattaaagttccatactttacatataaagaagcataatgcactgtattcctccctccttttttatcagatctaccataatcttggtagtctcatacagctttggctgtagccttccatttagccatattctgtctttattttcacaggccagaatttcttatgttcatccttttttattacagattttcatatatactgtcttctgtaattgtaaatgatttacaattaaaatatccagaacaaatgccttctatctttcctactgagtagatttagtcctggttttctttggcattaaggaatattttgaggacattatgctgagcaaaaaaagctagacattaaaaattgaatactgtatgattctacttatatgaagttataaacaagcaaaagcaagatggaaaaaagacaggacatggttttcttggcattgacttgtgctggattgggaagacatgagggaaccatctgagtagatggaaatgttctgtatcatatatccatttgtcaaaagcatacagctaagatttatattttaatgcatataaattataccacaaaaaaaatcctgtaaataataatagagtatcagggtaggtagtgagtgctgatagaaagggtatatgttaactgttgaagttcggaggtatgtatatggggtattttatactattctttgatttgtttgaaattttccataagacagggttttctgttttaactgttttgtattagaaaattatacatcttgttttaaaatagctgttaattttatttgtcaatatatgttaagtagaaacagtagaaatgaaacacgtctttttcccagcactagcatcaaataattattaagcagttaagcttttggtatttctcttatatgtgatttgcagcagatttagaagttgagacattaagcatagaaattcactttaaaataacataagaaagtatggaagaatataatgggaattacataaataattagcagtctgtaatttaataagtcaataatttattgccaacaaactatcattttcattttaccagtttttatcgctgaccaagcagctctctcataagaaggttatgtcttgcagatgagggataggaattgaggagggaaggggaaagggtagattctacaaaggggagttgggtataatttttctaaattacaatctgactgaagaaatatttttcagtgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaagtgtaatctaactaaaatatacaagctatgtgtatagttttcagtatattcttcctaatatacataaaaccattccctaatgtggaatagtttttttccctctctagttttatttatgtttgaggatattagaagttatagttagaaaaagaagtcttaatcatatgagttctcacaccttgttttaaacctgaatctttttttctttggataaaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagcgtaagtaatggaacgtaatagtacctgctgctaaatatatacatatatatatacacacacacacacatacacacacacacacacacacacacacacacacacacatatatatataaaatcatagatagtgctaaaggattgagtgtctattttgttgtctggtttctgtaatacaaaagtgcttctttgatgactatccgaaatggagaaatgaacataatatacccttggccagacagacctatagttgctgaatgatcgtgctgttctgctgttctataggatagacattcctgatacagattttccaatggtagttttgtgttagaagtatggaataactgagcttaaaacccttttttcatcagtccctcatttctcctccattaacttccagacaaaagccaagttttatgagtttatctaggaaataaggataatattagttaaatgagtaacagggtagtggaaacttcttgaacttaccagatgctgattgccttcagctaagtcattggtttccagaattgagatttcatgtaccagtaaaatatccagaaaaatctggcgatgatacaggtttaccagcgtgcactggttcttaaaatattctattgcctcagccagactgagtcataatatttggggtaagaggtcttggcatgtatatatatagagagagatttttaaagttcccagattattctgatttatacacagaaattaagatacatagtgtctaaagctagtgaaaccactgaggtaacaatagccaattaaaaaattgtgatatgcagggaaaataaagtttatatcaccgtctggttacttcagattgtctgagtcatcagaaagcaatgatctctaatatagactttatatatttttggccagcttatcctactcagtttagtgttcatcaggttcctcttccagcttcactttatcagtccaaatgatgtatgttaaatagttaataatttttgatgtttgcaatccccaaattggttagattgtccgtcattgcaaacgagtatataccactaattgtatgcagtcacattcccctcttcgttctgctccttcttattggtatttttagagaaaaatacaaataacctaatctgctaaatactgtaactccattctcactgttacattttgtaaatcactccttcccttccatttatgcaagattaaaaaggagcaaaggggataagatttcattacaggataaacatcagattatcacctctccagtccctctcccagcttttctgtgcatacagtgttaaattttgcagaaagtataacttcactcagaatgttttcttagagttgatttcaagtttaaaagaatattttcaagtgatttcaggtttaaagtgttcattgtatttga

SEQ ID NO: 121433 - DNA, 1039 bp, Homo sapiens
ttgcttaaattaattgaatcttaaatgcattctgaaacagaaatatgcttaattttaattatcctaagtgtaatattagattccttcgtaagtaaattttccatggaactgacactcatgtgccaacattttgtttaatttgggattttttttttcattatactttaagttctgggatacatacgcagaacatgtaggtttgttacataggtatacacgtgccatggtggtttgctgtcatctacattaggtatttctcctaatgctatccctcccctagtcccccaccccctgacagtccccattgtgtgattgtccccctccctgtgtctatttgttctcattgttcacctcctacttagaagtgagaacatgtagtgtttggttttctgttcctgtgttagtttgctgagaatgatgatttccagcttcatccatgtccctgcaaaggacctgagctcagtggatttttttttttatcttctctcttattgttggttttgccagctgtcacctcctggcagttattttgtctccctttgatagtctttctggttcccttttacctggctgctttaaactttgtgtgctagaaaaatcggtatttctagaagttaaaatttcattaattaagttataaaaattaaattataaatacaggtacctggctttagtgctggggttttatgacagctgttttggttactcaacagtttttttttagatgtaggaactgttagaagatgccaaatatctctagaacaatgcaatattactgtattatgagattctatagcagcaaactagatttttgtggattatgaaaatattaaacaaatgtccctggtactaaattgtcataaaattggagatttttctttaaaaaaaaaaaaaaaaccagactctcaagaaataaaatattctcaatgctaacttttcttccctccctccaaacaataaagtcttcaaagaattatcccccaagaaagacttctggacccagaatctgccagaatctctggcaaattcttttttaaaa

SEQ ID NO: 121434 - DNA, 2247 bp, Homo sapiens
aattttttgtatttttagtagggtttcactgtgttagccaggctggtcttgatctcctgacctcgtgatccacccgccacagcctcctaaagtgctgggattacaggcgtgagccaccgtgcccggcctcaaactgatttcttatccttcttagtgcctcaaactagattctgttcaaacatgttataacaaattagtatgtgtttattttggtgtaaaaaatttttgaaacccatacgtagttttttttatgatgcattttctatgaactttttgaagaacacttgtgtcttatatctgtattgtaagtatatgtgtagatgccttttgagttaattattattaaaataaactttcttagatatttaaatggatttttatttttctcagtctgtgccagtatcaccaaaggaaggtcaacagattaaatctaaaatgcattcacagtttgctgtatgattacctagaatggtgatggtaagacaccatttatagctactgtagccgggagtcaccaaagtgatgtgctaacagtttgataaataaatacactgttaggtagaaaagtgaaagccaccaaaaccacctaagaaacaaactgttggccaggcacggtggctcacgcctataatcccagcactttgggaggccaaggccagcggatcacaaggtcaggagatcaagaccatcctagctaacacggtgaaaccccatctctactaaaaatacaaaatattagctgggcatggtgggatgcacctgtagtcccagctacttgggagcttgaggcaggagaatcgctcgaacccaggaggcggaggttgcagtgagtcgagatcatgccactgcactccagcttgggcgacagagcaagactccatctcaaaaaaaaaaagaaagaaaaaagaaaacaaaaactgttgaattgacattgcctggctaatagaaatcagctttgacataaaaattgagaactctatttcattgtatattgtctgttcacaaatggcataggccataagcttgtctctaaaaactgtaaaaatatgtgatggtgtactttctaccttttactttatctcatcctttaaacatcatttttcattttttaggaaacagtgcagatctccgattagtaaaaacttacattgaacttggattgcctgggggaagaattgattttcttatgtctgagagaaatcaggtacaatatgacagtgttttcagtgaaaacaaacatttttgtaccagtttctacctaaattttgccttactacaaaatgcctgtaatagtagaaataatttttctgatttctatgaaatttaatataaatgtatatccaaaggaaatatatatgatttacattttgacttatgatctcttcacatatgaaatatttctagaatttcacatttctatagaaatatttcattaattaaaccattgtaaacatcttatgtttcatactggtagtgagctaaacaaacaaataatgcaagtattttaagaacactgaacctttttttcccctagaaatttactctctttgctcgttttaagataaaaaaattacactcactaacttctctataaaacattgaacttaaccatactttcagtacctaaattaaaaatgtttatattgttagtttttcatgtgattatacatattcccaaatataatgtatgtgctttgctttctttttagaatgatacttttgctgattttgatagcatgactgatcgtcttttggatgagataatacagtatattcagatatatagtctaacagtctcaaaaataaggtatcttctttaatattatgcaatttatttttatatttctatgaattgtataaaagttaaacagaatttgtgatagggttgtcctattctgaaatataggagactacaactcaaattaatttatagtgaaaaaaagtaaagattttagggaaagatttatatgaaatgtccaaaaaagtgtatctgtagagaagaaaataggttagtgtttgcttagagctggggaagatgggggatggtggggataactacaggatataggatttctttttgaggtggaaaaaaggtcctaaaattgattatagtgagagttaaaactctgtgaatatattttaaaacattgaattgtacactttaagtggaagaagtataggctctgtgagttacatatatgtatatgatatatgtatatgatatatgtatatgaagcaacaaaaata

SEQ ID NO: 121435 - DNA, 1040 bp, Homo sapiens
attaactgggtgtggtggtgcatgcctgtaatcccagctactcaggaggcggagacaggagaatggcttgaacccgggaggcagaggttgcagtgagccaagaccacaccattgcactccagcctgggcaacaagagtgaaactccatctcaaaaataaaaaaaaaaaaaaatcaaatttcaagaataatgtataataaatttgttatttccacttgactagataatgtgattacttacattttctataaacagaaccaaaaatgatagttgaaggaaaattaaacctttttaaaaagagccatttttctgctttatatggaaataatgtaactaaattttataacttatctaaaaattggcatagtttttttattttcagttactattgtgaactaattttccttttttctgttggttccataggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaatt

SEQ ID NO: 121436 - DNA, 1102 bp, Homo sapiens
tgggagacatgactttttaaaaaataaatatttgccaggcatggtggctcacatctgtaatcccagcactttgggaagctgaggcgggtggatcacctgaggtcaggagttcgagaccaacctggccgacatagtgaaaccccatctctactaaaaatacaaaaaattagctgggtatggaggcaggtgcctgtaatcccagctactagggaggctgaagcaggagaatcgctcgaacctgggaggcagaggttgcagtaaaccaagattgtgccgttgcactccagcctgggcaacaagagtgaaactccatctcaaaaaaataaaaactaaaataaataaatacaaaataaataaataaatatttaaacacaacttgggttctacaagtgcctggactacaggtctgtttgaaggagctgccttgtttgttgacccatggtgatgtcataattatcgccagtaatcaatgcgtggattcagggtgccaatggttgaatatgatcatggtgaaccccttttctaaagccttctctagtcctctacagaggtactatggccaggaccaagaaaatgaaatttctcaaaggtcagtggtccataacagttaagtatgctacatgattctcttggttttcatttctagtgaggaaacacacttactcttcttcaattccacatacaggacaggcctaaaagctcctcccatatctctgagaacattagaccatgcactcttgaagaaggctttcccttttcctccttaaaaatcttcctccagcaattgagggttcccatgtgcagtatgttggctcctttgggtctgcacagggcccaatgggtagaaggtcatgttggccgcaccaccacagtctgggcaatcatctggctcaccatgatgtggtggtcttggagtcagggagcatgccttaggccttcaggctgcccagaaaaggatgatgccctgcacagagatgctgaagccctggtacaggccccagatcccatcagacttacttatcttcaccagacagtctcctaggtctttgaacctgaatcccagctctgtgtacgatttcccaacattgaccaccagatgggt

SEQ ID NO: 121437 - DNA, 1061 bp, Homo sapiens
aaaaaacctaattttagttttttcggttggagggcttctgcctcagcctttgaaacagatatactatttttagctgctatgttttgtgtttggagatctgatttatgtttaatgtcttgtaagtaatctcaagggaaatatttcttttttttttaaagaaatgtcttgtgtagttaagaaaagatcgtgtatatttttaattggtttatttcgttattgggtgagaaatagggtagttctctaaagcaggagacagtctctttggggaatgtcctttaagatttctgtgttatttgacttagacttttcctgaagctttactgttctatctcaatactatataaatgagtcacatttcagtaggctgataatatttgactagactgagccacacagcatcagcaggttacttcactgtcgtaacaggtactgaattactagaagaatcatgcgggaatactgtaactagattatttttatgaagcacttttcaatatagtaacttgattgagtcaagattatatttatcctatgtaaccttttcaggtgatgagtttttacaaagtccgtgcctggttcttgtaatacttgttttcctagtaacttgattgtgtgtggttatttgggagttctgcactgtgtttaggctcagttgcttgctcattgactgcactagcaaaacactgaaaaatggtcctttaaaaggccaagaagaagaaagaagctgaagctaaatagtacacattttgtcattttgagtaataacatggttaagtagagatgctggtaaatattaaatctgttcattaaaagtcgaatagtaacagtttcagaattaaccttccttcatctacagactttattaaaaataatttaatttttgttcaaatttctgtctccaaaaaagtactttataaaatcagattttcactaatgctttctaaaataatacagatttttaaaagccattattaaccatgttaactttttttttttttatttactcttttgaggtggggagaagagaatcatgtacttcttaaattaggatcaaaagtttt

SEQ ID NO: 121438 - DNA, 1055 bp, Homo sapiens
caaataaatgattctaaaacgatgtgctaagtgcttgtaataatggttttaagaaataactacctctatacttattttgggctgttgttccccttgcaccttgacttttgcccattggtggtctttacagttcctagaatgctgtttcaagacctttgcacgtgctgttcttctgcctgggaagctttctaacaagtttttgcctgctcagcttttgctcatctttcaattcctgcttaaatgtcttttcaagggaaataattctccttgatcctctgagattaggttaggcttccgtttatacataaaagacaacaccctgaatcttttattgcacttatcacaattgtaattaaacattatttaggtaattatggggtacactgtatccctgctggattatagctgtaagagaggagaccttgtttatcttggttagggtagtatccccagttttcaggacatgtggtaggcaaatgtaacttagcaaatattttttgaatgaatgaatgtgtgaatgaatgagcacagagcccctggcaggcagcagggtgtgtgaaagggagtgcacctgtgaaagggagtggcatgtggagtgaccctgttgggaccagtcacagaaggagtcttcatttgagctaggttctgaaggtggagtgggatttcatcagatagagaaggaattaaaggacacagctgcacacacacatgtaccagtatgaaagaacagaagaagtttccatacggcccttactagataagctttctttaagcatgatcagttttggtagtctcaggtcagaggaagaactgggatagtgaggattgcaggcaaatcctgagttaggagatgttgaacagtggtccaagaagagggcaagaggacctaaattcacacaatgtcaatatataagtcagggtatagagcaggaaagagatccactgtagctattttcaggaatcaggtacttaccaagtcattggaagggctggaggagggaaagtcagggagccactgctgaactgctttcaaggccacacataccaccactgct

SEQ ID NO: 121439 - DNA, 1121 bp, Homo sapiens
tgtctcagcctctggagtagcttacaggtgtgtgccaccacacccgcctaatttttgtatttttggtagagacggagttttgctatgttggccaggctggtctcaaacccctgacctcgagtgattcgcctgccttggcctcccaaagtgctgggattacaggcttgagccaccgcgcctggccagaatctagatttttataagtggtacagagttgggtgtatttaagatggtatgggatgatgaagtactacttaaattagcctttctcacaggacctatttaaaaatacatgcatgcaagagtcatttaacaatctctttgcaatgggatcatttatgtaggaaatcccaagaaatttatagaaaagctattagaatgaataattgagtttattaagtttacagaaataaagtgactatagaaaaagtaactctatatactagcaacaaataattggaagttgaaataaaaattatgatttataatagcataacaatatgaaaactgtgggataaatttaacaaaatacgtgcaagacctgtataccaaaaactacagaagatagctgagagaaattaatgaatactgtacctaaagaagtggagagaggtatcagagatatcatgctcatggattagaagactcaatatttttaagatgtcagttctctccaaattagtctctaaattcaacattattccagtcagaatcccagaaggctttttttgttgcaactgacaagctgattctaaaatttttaatgaaatgcaagggaccttccaaaatcaaaacattgaaaaacaaaaagaatgtttgaggtcttacacaacctgcctttaacagttattaaaaagctatagttatctgtggaacataatacgtagtccagaaatagactcacatattatggtcagtttttaacagaagtgccaaggtaactcaatggagagaaaggatagtcttttcaacaacaacaacaacaacaacaacaacaacaacagaatgtataataccttgaaccttacctcagaccattcacaaaaactaatttgagatggatcataaaactaaatttaagagctaaaactataaaactgctagaagaaaacatgggggaa

SEQ ID NO: 121440 - DNA, 1094 bp, Homo sapiens
tatttttaaaaggcttccttaatacagttggtgaaaatgttatactattttgcattttcttgatactcttaagatttaacttttttttttttttttttttcttgaggcggcgtctcactctgtcgcccaggctggagtgcagtggcacagtctcagctcattgcaacctccgcctcccgtgttcaagcagttttctgcctcagcctttggagtagctgggattacaggtgcccgccaccacgcctggctaatttttttttgtatttttagtagacggggtttcatcatcttgaccaggctggtcttgaactcctgaccttgtgatccacccgccttggcctctcaaagtgttgggattacaggcatgagccactgagaatattgaacattttttaatgtgctcattggtcatttctattctgttaggatttgctcctacattttgggagggtgggattggcaacccttttcacatttctctcttgaccagtcattgggccaagagaacacaaaattccagacagcattcattcttctgggtatcctggtgggccacaccattcatctccatattccacccataagaccgtgaataagtgggttgagcattttggaaaaatattttcagtttcagatctatatctatatatttttcagtaattatggaattgttgaaagtttagagatacaagagacctgtatggtatctgttcgagtctgctatactagagagataaaagaggttaaatgacttgttaaaagcaatggaacagtgagagaacatgggagtgaacccaggtcttctggaaatctgtctgttactttgtcaggtcacgtattaatgtgttacccttgaccttcacaaaagatagcacccaactttttaatcttttcattctctttaaattcagtccttgtgcacagtgagaagggaggtaaattgtgggtttttatgcttaaccaaaccgttatctatgtaatggcagcatattaacaagataattggttatcagagtgagcaaggattatctattatttagccaatttattcaaacataaatttggcagtaatgtaaacatgttttcaaaatttg

SEQ ID NO: 121441 - DNA, 1294 bp, Homo sapiens
gtgcgtgccaccatgtgttgctaatttttgtatttttattagaggtggggttttgccatgttggccaggctggtctcgaactcctgacctcaagtgatctgcccaccttggccccccaaagtgctgggactacaggcatgagccactggacccggtctcctgtgtttctttttaaaaaattgaggtaggaaatcctggtcggggtagccatggcagcttgtgtctgccacctgcccttggccatcacactgatgcaccgggtcccgtgctggccacagcctgctgctcagcatcgcctgtgctctgtggggactctgatgaggctggggctttgcagctggctccacagcgggctttggtgcttgcgcacgtgctgggtagaagttacacagtcgtgctgtcagtatagtgacttgccccctttgatgttagagggaatcgaagactgtcttctttatatcttgaaaccctgtgacaggattgacccagagaagctctcagtgaattcttactttatgaaagacctgtgcttggacagtttggaccaagtagagagtaagcatggtcatggaagataaatttgggtttgaaattcctggtatagatatggaaaagttaatatgtccacaagaaattgtagattatattgcagataagagagatgtatatgaataaaatatcagacccttttgcttcactgggagaagactcagatgatactggtgagtgtctggaagtgagaatgcattttggcattattgctgactttggcagagtaattctgttagacctgggtttaaattgtgtaattgttttactctgaaaataaacgtataaaaccaaaaaaagaaaaaacttgacttataattacagagagaacagttcacagatctcatttagttttatgagtcttggcaaatgtctgtatgatgtcaccaataccccagtgaagatagagcatttctgtcacactagaaagttccttcatgccaatttccagtcaagtcccccaggggcatacactacactgatttctatcccattgggttagttttgctatacattaaaatgtctgtctttttggaggctgttcctattaactttgacgtttaattcagatgggcaaaagtgatgatcacaatgtgatataatgttccatattcatatgatattttataataatttctttgatataaaaagtgcttgaggccaggagcggtggctcactcctgtaatcccagaactttgggtggccaaagtgggcagatccgagagtttgagaccagcctggcca

SEQ ID NO: 121442 - DNA, 1060 bp, Homo sapiens
ataaaatatcatatgaatatggaacattatatcacattgtgatcatcacttttgcccatctgaattaaacgtcaaagttaataggaacagcctccaaaaagacagacattttaatgtatagcaaaactaacccaatgggatagaaatcagtgtagtgtatgcccctgggggacttgactggaaattggcatgaaggaactttctagtgtgacagaaatgctctatcttcactggggtattggtgacatcatacagacatttgccaagactcataaaactaaatgagatctgtgaactgttctctctgtaattataagtcaagttttttctttttttggttttatacgtttattttcagagtaaaacaattacacaatttaaacccaggtctaacagaattactctgccaaagtcagcaataatgccaaaatgcattctcacttccagacactcaccagtatcatctgagtcttctcccagtgaagcaaaagggtctgatattttattcatatacatctctcttatctgcaatataatctacaatttcttgtggacatattaacttttccatatctataccaggaatttcaaacccaaatttatcttccatgaccatgcttactctctacttggtccaaactgtccaagcacaggtctttcataaagtaagaattcactgagagcttctctgggtcaatcctgtcacagggtttcaagatataaagaagacagtcttcgattccctctaacatcaaagggggcaagtcactatactgacagcacgactgtgtaacttctacccagcacgtgcgcaagcaccaaagcccgctgtggagccagctgcaaagccccagcctcatcagagtccccacagagcacaggcgatgctgagcagcaggctgtggccagcacgggacccggtgcatcagtgtgatggccaagggcaggtggcagacacaagctgccatggctaccccgaccaggatttcctacctcaattttttaaaaagaaacacaggagaccgggtccagtggctcatgcctgtagtcccagcacttt

SEQ ID NO: 121443 - DNA, 1011 bp, Homo sapiens
ctaaaactaagagcctgctgttagtaagccctgcaggacatagtcccagttccactggatgaagcctgaaatatcaaaatcattgatgggtgatgttggttctattgcaagttgaattatggagactgatagaatcttaggcctgttacttaacatctttacagattctgtttcttttcctgtaaaattaggataataatgcctgtctcatggttgttttgaaatttaaaattgcaaatataggtaaagtgttgaggctaatgcttgtgtcactgtagctattatgctatttttattatttttttcctgctacttactgggcagagtttactcttcagggccttgagtccttgaggacagctagtttgccccatattctttatcgcctccccaaaacatcagctcctgttgtttttttcccctgccctctcatttccaaattgcccaatctttcattttcactggttctttcactgctcccctacctcccacccttttctagtctactttttagaaacctagaaactaagcttaccaatatattttttatagtcacaaaatgatctctctacatctgtgatgtcattgaattcttatttccccaaatcccaactaacaaacacatccatgcacttttacgcagtcactttttggcagtggtctcctatagaaatgactcattattccacatcacctctacctttcagattttaatgttactatttgtgataacatcactagaacagtgtttaatagtttggtataatgtacatatctgccttgttcctaattattttttatttcccccccgagatattaatgagctacattaaatagatatgtacagtcatagtcattgaatataagatactgctgattttaagaagcacatccactttacggaccaataagaaaaaaaataccaattattagacaccatcaattgtgagatgtattcctatttcaaagacgttaaaatatgaaaaaatgtaaacgaggattgatgagata

SEQ ID NO: 121444 - DNA, 1051 bp, Homo sapiens
tgtgatcttgattgtaaatcagtagaatcccagggtatttcaaagctcaaaagaaagaaaacttgtcagccctggaaacgggagcattgttcaagtggtgcactagaaaaaatggcagtactgcctacaaactatgagggaattcactgttaggaagtagtaagtgtaaaggtggtactgttttcacaaaaaaagacatttagattatggactatggatcaacatacgttgataaatgtgaaggattaaaaatatgcttctgttttaacttgagtgattaatttcgtagttgtgatttaaattatatttctaaggagaatatatattggaaataataaattatttggtatttgtgtatatgtatgtatgtgtatgtatgtgcaggaatcactttttaatgtttatgtgagtaattaaaaaattttttttattatagtgcatgcaagatatgggaaatactaaagcaagactactctatgaagccaatcttccagagaactttcgaagaccacagacagatcagtatcctttaaaacttatttgttttgagtttaaaaaacattaactcatttttacagttcatattttatctgttagtatttaggaagatgtgaactttatcacgctactgttcattaaagatagaaattgacttgctgtgagctgtgctttgtatatggtaggtttttagtaggaatttggcacacagattacataattacataaaaatacacgatacatatggtatttagatgtgattacagacccctgattcacaatgattatttgacttacgatttttccacttcatgatggtgagaaagcagtatgcgtttggtagaaactgtactttgagtactagtgtaaccattctgttttcacattcagtacagtattcagtaaattacatgagatattcaatactttattaaaaatatgctttgtgttagaagattttgctcaaccgtaggctaatgttagtgttctgagcacatttaatgtaggctaggctaggctatgtttggtagattaggtgtattaaatgcatttt

SEQ ID NO: 121445 - DNA, 1038 bp, Homo sapiens
agaagactaacgttggctttatcatcttgacttttccatttctcaactttgcaaggataaaattggccactgttcttctaatacatgtggaatcctatatgatgtgcccagggacagcatatatagtggaaaagaacatagatgttggaatcacaagtgcttaatctttccaagttgctgtttcttcatctatgatatggaactaataatatgcacattcgtggggtgtgggaggaattaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccagctttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaatgtaagtaaaaccttcatctctcatcaattgtttgttgactagatttcaaacttttaacatgcaatacagcttaatttatttattgtgaaaacatactagttgtatatatttacatttgaatattggaacttttttggttatataatgttgagctcttgcagagcagaagtcttgatttagaaaggagcatattctaaatctaataaccacttacatggcatttaattaagttaatttttgaaatttgcaaaaaagctagaaccactaattgaaaatggtgggagagaaattttttcccctagat

SEQ ID NO: 121446 - DNA, 1047 bp, Homo sapiens
acttttcacctgtactccacagatttcctcctctgatgctcctcttcagcctttggtatcctctccttctctgcaagctgctgttgacaaaaataaattggaggtatggtcatgttttaaccagctacattatgtagtgttaaatggtaaattaacttccttttgcagtgtgtcattcgggaacactataatagttgttgatattttgaatgatccctagaattaaaacagcaatttctagaatttttttataccacaggtatgattaaagaactttgaatctatatttaatttcagaatgactgatttattggtgccatggctgtatctcaacagttaagaagcagttagttttttgttgttgcgcccattactatcttatacttacaggaacgtttttttaaaaaaaattttctttctatgattctgttgttaaaagcacttaaagaaagttaatgtcaagtttcttttttttaagcaatagtaaacatcatacagataaaacgtgtattatgggataatgagttcagaatcatcaatgacaactgttagaatgcattttgggtggaagtggttagggtgcagatactaccactatgtatttttaaagtcatctgtacaaatatttgagagttttcatttcttttgactctttacctattttttttttttttttgttacattggccttaataaattagtttcaggcatcctttcaactatcattttttcccgtagacatgggataaatgataaatggttggctagatgtgtggtatacaaaggcaagatatagcccctgccctccaggagcttacagtctaaggcaagaaaacagataactatatagcagtttataatacaatatattatgggctgtgattgaggtacgctcactgtactgcaggaggcatcattttgatgcatcttatgctctgaataagcattagatataaggggaaggattaggaagaattccatacatggaaactagcctgtgaaaaaacatatgggcaaagtgcagtgtttggggagttgcaagtagaat

SEQ ID NO: 121447 - DNA, 1825 bp, Homo sapiens
atatcactctaggtagcacttgaagttcctgttaggatttccccccctccctgccccattttctcaagatgtcctgtttttaaagagaaaaattaagaggattattaaaaactttgaatcactatttagatttatatcaacaagattaagttttgtctgtttttgagtttcatgtaaatgtaatcataccatgcaactcttcctctgtatggattcttttgctgatcattgcgtctgtgagattcatttatgtcattgcattctcatttcttattgctgaacattcttctattgtctgtctacatatgccatacttttttttttattctgctgttagtggacatttgagtcgtttctggcttaggacttcaatgagtaaagctgctatgaacattcttataaatatatggcattgtcatgaagaaaaatatcctagtgagtatagaaactaatctttttcttattctgtgctaatcaagagtacagaatttcctggcagttgagaggttatctttaaatgagtaaatttaattagcctgaaaaaatattgactactacgtgaagaaagctctttcagccaagatggtttgctctgttcttactgttttgttttacctagttttaaaaagagcgaattgaatacctaaaataagaattattacttaacagaaagcaatagcaagatgatagtaactttattttgttagttaaataaccatttactacaatgcccgcaagcctagaagaagaaacccgccagagatgtaatagctttttaacacttgcttattatcaaagtaactgtgatgataaagaatgtgtaggttgtagcagaaaaccatattttaggttctattacaggcttgtagtaaattgaaaacatttttttcttcatggaatttctaaaatgtttttgcaatcatttgaagctttattgcaagtgaggcaataaaaagggaagaaatccaattactttatgtgcagagctttcatttcctagttaatgaaagaaaggcttttgttcactaagcatgcatgctttacagttcttcttagtaaattagaaatttcctgaaatagaaaattaggaaaatacttcctgaatatatacactttgatagagggtagttttactaagttaaagcttatacttaagaatgttgcagcccaggtgaaagggtcaacaattagattagatgggtcattgaaggtaataaaaatagcaagcacatactttgtgcttaatgtttgtgaggcattgttctaagctctttaaatatattatttcgtagtcctcacaatagttatatcaggttgataccattattattctcctttatgatgagaacctgagagacagaagtttggcaatttattcatggtcacacagctattgagtagtggctgtgctgagaattgaatatgatcagtctgccttcagaatatgtatccttaaccaatatgctatatggcttttcagtctatttctataacatccaaaaataggaatgggaaggaaagaagcaagaaaaggtaagggcaaaggacctcaactctgtatctttgattttctgcagtttgaacatgatgtacttgggtataattttttggccttttatcttagttggtgttctctgagcttcctggatgtgtggttttgtatccaacattaattttggggaaattctgtcatactgtttcagatatttcttacgttcagttccttcttctccatctggtatttccattacatgtatgttacacttttttagttgtcccacagttcttggatattcttttccatttcttcagtgttttttttttc

SEQ ID NO: 121448 - DNA, 1092 bp, Homo sapiens
aaaaatcctatgatacaggttttgaaaagataaaaccttttaagtagccattgcaaatcctcttacagtctgttgtagttgtagaaatgttctttattccaaaggataccagtttcttgaagcagtagttgctatggagtggtggtcctctcatctctaactattgttgagccccaggatttgatgagcaaaaacttggtgtcaccttaggtagtaaatgcaacttactgtgaaaatgcttcagtctacctacattaacagattcaaattaagaagtactgtcttgattgtagatgtttttatatgggcttgggcttgtaagtgatcctcttgaatggcaccattttaccttctacaattgtttgattcctatctaattttataactttatttggattttaagtaatggataagctgcgctttactatgcagaatttgatagcttattttggtgtttgtctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttccttt

SEQ ID NO: 121449 - DNA, 1105 bp, Homo sapiens
agcggactcattaaaatcccaagattgctttggtatttttttttaagtaagttgtggttaatctttggggaaactgtatctagaaagtagataaagaagggaacaaagtagctatttgctttaagaaatatttgtatggtactctgtttttattccagtgcttggactagttgtcacattaatgaaaaaatgaccaactgtgtggctaaagaaacaagaattaaaagtgaagtaagcctcttgaactaagccttttatatgtttcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaa

SEQ ID NO: 121450 - DNA, 1173 bp, Homo sapiens
aagtaataattgttttgaaggtctgaagccctggatctctttttccttagtgactaaggtgatactgtcaagtcaggcaccctcccagagttgaagctccgggcaccaacccacaaaacatttctcagcaacttttgcccttctctacattaaatgagttgatttatgattcagtttgcaaagtaatactaaatgataccaggtggtaatggaggagctgtgaaaacaccacaaccaccatcctctccagatgccagactgggccagtctcctgttccagaccctgctgccttttggagaaaagttaacactaagccacttacaaacataacgtggtacagcaggtgctgagtgaagcagaacaaagaatcataaagcattagctgtaggactagccccagtatcgatacctccaccaaccctaaagggagggaggtggcacattttagcagagaatactggatttggaattagaagccttttgtttttgcctaggtccctgcccctgggacactggccaactcatttaacctttcttgattttctaacttccccatttctttatttgcgagagaagtgtaacacttcaactcaatgtttgatgaaaaattgaggtatggaaagactccactgactgcaaagcactgttcaaaagatactacaatatataaataaaaatactattgtcagtgtgatcatgaggggcaggtgatgccagccaccatttatggctgaaagaatactggttgacagatgtaaaaggtttgggaaagttccaggtagcaaagccaggacacctacatgtgatagcaactctggtaacaagtccacagccttccttagacacaactaggacaaccaccagacacctcaacaaaagccagaggttcaaattgataacgtagtgtcctttccaacaggtcagatcagattttagtgttaaaagatttcttgctttttcccacatgcttataaataagctttatccttttttttttttttttttttttaaattcagatgagagcctacccttctcagtcatactgaaactcctgatacattcttcacatggcttcaggatactggttgtatttccccattctctcaaaaacatgggatccaaattgtgcagaggtgatttctggaaatgatatggagccacctggatctga

SEQ ID NO: 121451 - DNA, 1050 bp, Homo sapiens
ttgtaagactttaaaagtccaacaagctatttacatttctggacaaaattgcaatagggactggtttttcctcacttgttttaaataacaaaaaggcagacaaaatgattgaaaaaagtttccagacattggaaaagaggcacatgagacagagatctctgagaaaagagaaatgtgacccctacaactgccccagcttcctgcctgaagtatgttttcaggctacaccacagggaggggaacccggaaagctctgcagtccccttgaattgaggaaacaactgagaatttgaggaggccaagacaactaggatatgcagggtggagtactagagaaggaagaactctgctgatctgtagacagctctcctcaactcttcaactgagtatgaagagcaaatgctcacacaactacctcaggccaggtacagaaccactggcaaggagcaggtgaatcaattactggaggggactagttcccattctcagtagccagagtggagctacctagtaacagctggagcacctggaggagaacttggaaggttatcgtgcctgttgtaaggtcaaattgattagccctaaactagaggctgagatggttttgcctaacaaacttcaaaagcaagcctggaaaggatcaaaatgtttccaagttaactcagttgtgtcccagtacaaagctcaagaatacatatgtatttataatatagtataacattacatatatatgtgtttttatgtatggttgtgtgtatacatatatgtctctctcatccagtatctagcaacataaaattcaaaatgcctgatgcccaagacacctcagtgatgaaaaatacaatgtctgagatgaaaaatacattggatgggattagcagcagaggagacactgcagaataaaagttgagtaaactcgaacacataatgatagaaactaccaaaatgaaacagaaaaggcaagaccaacacacacacaccgtacagagtcacaggaacagagtcaaaggtgaatgaatgagggagacagggaaaaaaatttgaagaaat

SEQ ID NO: 121452 - DNA, 1099 bp, Homo sapiens
ctggaaaactctgttcttacagcttagctcttttcattgaaattcccagataattatcttgtaatttccctgtgcctaaaaaagtcttatagtagtcaaactagaatagaggtacaatttgtaattcttaattaatatcagaataaatgtgagttagaaagagatcttctcgccggtggggccggctgggactcgccgctcgcacgcccttgggcagcggcggggcgcctgctcttccttccgcttgcgctgtgagctgaggcggtgtatgtgcggcaataacatgtcaaccccgctgcccaccatcgtgcccgccccccggaaggccaccactgaggtgattttcctgcatggattgggagatactgggcacggatgggcagaagcctttgccggtatcataagttcacatatcaaatatatctgcccgcatgcgcctgttaggcctgttaacattaaatatgaacatagctatgccttcatggtttgatattattgggctttcaccagattcacaggaggatgaatctgggattaaacaggcagcacaaaatataaaagctttgattgatcaagaagtgaagaatggcattccttctaacagaattattttgggagggttttctcagggaggagctttatctttatatactgcccttaccacgcaccagaaactggcaggtgtcactgcactcaattgctggcttccactttgggcttcctttccacagggtcctatcggtggtgctaatagagatatttctattctccagtgccacggggattgtgaccctttggttcccctgatgtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtataaaccttttcccatgcccagtcttcaaatttctaatgttttgcagtgttaaaatgttttgcaaatacatgccaataacacaga

SEQ ID NO: 121453 - DNA, 1098 bp, Homo sapiens
actcaagatttacttttttactagtgtgtaactttgaacaaatctcccagtttcttcattgttaaaatgaggatcataacactggcagcattctgtgaagactaagctggaaaatgtgcgctctgtgtaatatgggcacagcatgtagtaagcacttacaactttttcctacatttttcttttctcgttttccttctcctttgttttctccttctcatttcttttcttctatttctactcccctttctttctttttccctaggatgcaattcattttgatccaatttagcatttaaagaactatataactcctaggactgggattggcaaactttctatacaggggcaaatagtaaatattttgggctttgggggacagtgggtctgtattgcaactacacagctctgctactgtagtacaaaaactgccatagacagtacataaatgaatgtgcatagctatattccaataaaactttatttaaaaaacagctggcaggccacagtttgccaagctctgctttagagtacattgtccaacaaagccttgtgcaatttgaggtgctattaattttttttaattagatttatcacataaccgaatatatgggcatagggtattcatctttttaaaagcactattcttgtgtgctattattaaatttaaacaagttttcatataaaactcaagtgattcgaatcttaaaatgccttcacaatgtttgaaatgtctggttcatttttaaatatttactatttaggtgtttacattgaagaagttctaagtaaatggaaaggagattatgaaaaactggagcacaaccacacttacattcaatggtcagttacatattatctatcttgaaccatgtcctatttaatcatgtatgttttccagacaacgttaatagaaaaattttatttttttaaaataaataggcttttccccctgagagaacaaggcttgaacttctatgccaaagaactaactacatatgaaattgaggtaatgcaagctcatttcattttatacagggtggccaaataatattgctatttcactgtccttgtagctactgaatcatttcaggtgacttt

SEQ ID NO: 121454 - DNA, 1025 bp, Homo sapiens
ttcttaaaggcctcagcatacattacctttgtctttctttctctattggatgactgttctttctggtacactttaagctacactatcttcttcactgcccaccccttccaaattcccattagcaccatcttcacctagctaattttattcaggcttcaagactcagcctggctattagccaactcagaagtgtcttttgacccatcataacacttatagtaatggtgtatgtgtctgtcttgcaaattaagctgtgtccttctcgaaggtagggatgatacccttcatttctcatcacctagaatttaaaacattgctgatatatggcaggcagtcacaattgtttgttgaatgaatgaatgaatgaatgaaatgagtaagatcctgtaacagtttggaattatatgccacctgggtttacagtgtagtctcttatcaggtaggtttgttctgagatgtatagtaatgatgactttcttcttcgcccaagtattttgtgtaccttagaccagtttagcaaatgaagtccaagaactatttgaataagtcattcttagaaaataactttaggaagcaactgactccattcatgtgtatgcctctaattgtaggttcacttctgtccgaatatgaatttttaaaataattttagcattatattagcaatttgcaatataccatttttatgcatgtaaagttgtattctaacatatttactttttgctcatttgattaaatttattactgtgtatcccatcattaaggtaactaattttcagtaattaaactgttggtcttctgtttagccattattctcagttctgtgcaggagtgagctgaaacaaagttgtatagcccagagagtgagaagctgcatttcatgtctcccaacagtcagaaagggattatgtactgtttaaggaaggagtttggcgaatattttgaaacccttttgggaaagcatagaatattgaaaatccaaaattaaccaaatccgtgagtgtgcaagctcaaagctagagacc

SEQ ID NO: 121455 - DNA, 1079 bp, Homo sapiens
tacattttaattagtacattttctttttctaactatttggagaatttataatattcagttttaacagtaactgatggaattacagctgtaaacatgttgtaccagctgtgttttctgaagcaaatctaagtgataaaagcatgttatcatcaccaagtacatataatccttacccacatggaggagtgtgcagttggtagtataatgtggtaaacatgatttttgcccattatgaccttgtaaacctataaggcaacacaatgaccaagatagagacagttgctgtttcacaagtcgacaatggataattgtaggagactccacttttaatgagaagcaaactatcataatggaaaatagccagatagattaaagcttaagccattgaggttgaatggtgtacctcttatggatagcatatagttgtgtctagcttttatatacagcttggccccaacaggacttttcattagagtgtttagtccacttacatttactgtaattagtgatctagctgaatttagttctgccactttactgtttgttttctatttttctcatatattgcttgttcctcagtccttcttttcctgatttcttttacgttaaatgtttattttaccattttaattctgttgtctttttaaagctacatttctttgcattcttcttataatgattactatagggactataatatgtgtatttaatttatcacaatgaaaactatttgcgaattaaccttggttttacatatataaatcttgcaacactaaagttctgcttacctcccgtctatcctttggtgctatagttgccatatacattacatctatattttttaaaacacaaaatgcagtgctacaagtttgtctttaagaaactaagaacagtatgaaaaggatgttaaaatatctgggtagttattaaaataaattatctctaaaatgaattttgtaatctattattataattttactagttagaattttcaattgttattttttatatctttaagaggtgaaccgagtatagagtatagaacaagaaaaatgtcaggcagtcagctggactcactt

SEQ ID NO: 121456 - DNA, 1388 bp, Homo sapiens
taggtactcagcttcccttccactctctagggatcctgtagaccacagtgtttgtgctcaactgcagaagcttcatgtgagaaaaaagtttccttttctccactgacatattcttccactttttctttatataatttcctgctggtctctttaatccccaggcttctttcaaactcctgtttctctatatagtagcttcctgtacaaatgtatgtcacatttatatgtggaaacttgcctaaataaaattaggcagatgtgtgatgccagatatacacatatgactcaccccgcccctccccttgcttcatttagtttctggtcaaataccactttactaagaaaggccttacctgaccaccacctccacctaaaatagctctccttcaaatggatcatttggcttactgcacttccccttgcagcagttgtcaccacctgtgaaattatataatatcttaattaattgtatttgactccatgaatgccaggatatcagggactcactgctgagtctctatagcctagaacagtgctggtacatagcccttaaattcttttacacaaagaagaacctattaaattttgtcaaataagaaacttgaggtttatcttaatgacagagttgctattatcaccaccatctgttttaaagttgagtatactaaaattcatagcctactcaaggtcacacaagtagtaagtggagccaagcttcaaacatagatctcctgactccattcatatgaccctataaactgtctcaaaacaaaaagataaattaatataaatatttattgaatatgtctttgtagagaaagcataataagcataaagggcaatgcgttaacctttatcacaagcaaccctattggaatgtgtcaacttatcagaatgaatcaggccagaatatcaagtataaatgaagcctgtagttaactgaaagttgcatatcaatcaggcactccagtttctctcctcaaactctgaatattcaatgaataagataaagaaatggctaatttgattttacctttcatttttttgacctaattctaaggtgactactcactcctcaagatttaactaatgttgctttatttttatccctctggggagacagaagagatgattgggaaacacatgtttgaagtttgtaagttctgctgctttcaaccccacagatgtctcttactgcccacttgggccctggtgattaagcaactagatttggagccagtcaggcttttgtttagacattttaactttttcttgctttccttgcaaactcctcagccttcagactggttggaaagtaaatgtacaatcttacataaattttcaggtaatagcatttcagctttttccccaagattttttgcttggga

SEQ ID NO: 121457 - DNA, 2202 bp, Homo sapiens
ccaaacataactactaaaaggcaaatcctggtgaagtgttaatttaaccaattaaattatatttaagagtctaaacataagggaaccagagaataagcacaggaaacatatttgtatgagtagatatgtacagatataaattcagttttatatattttctatttctttacatccctgatttctatatggaccttctgtagatggctagtttgttatttataaatttgagctgtttgcacagtagatgttactttaattgtgttattctaattatctatttatctatatatctaattatacatctatctgcttttaaaactatagcaatatatgcatgcttttataatctcttcacttttatatctgacttttgaagaggaagttaattttgatgaacagtgatgaggaaaatatccttgaagactaaaacactgcaataaaaagagaaaaccatgagaggtttccatgtcttggtctctgtttatattactaaagagatgttaaaaatatcatttggggactatcttatattctgtaactagagcataactatctgctgacacataggccacttccgaaatattgcttaataacacattttcaaataccctggtgccatctcaggcaaattaatctctgaactaacaagagtctttactgtgctgcacagatcttctcagagatatgtaataaatggtatgtattcaaggactgctgcagtaatagtatttatgtagcttggctagaaacatttgctctcttaacagtgggcatttaagatgaagactgtccctggcattgtgcagcacagtaggaacattggcctgctgactaaacaaatatgattgccaaagtgaattattaaattccaactggcctcacttgctagagaatttcactcctttttctcccacacagcttcctactttttattaaaggaacagttttcagctcttgcaaataattgcagtattttgctagtcattactacagcagtttcccactgtttatattttaaaactagcacttggatgagtcctgttgaagcagaacaaataactgtgtgtgcatctgtgtaaatatttatcgaaatttgctttattaaaagtcccagtgaacttttgttctaactgctataccttgtgtcacttctgacacagtcacatcatcaagctactgttactttacaaaacatgggtgacttcatttcagtatttccttcagaggacttatttgggagactcccttccaatagaggaagtgggttgatgagtgctggtgttctcattccagatccttcacatctctggaaagctgcatcctttgtagaaaatagatctgtatgtgtgccaaagtataaccctgatgttcatcagggcagtgggaggaggtcatatattccttgtctgtttgaacagtgatcctcccatttggcaggactttgagaggaagtatttaacaatgggattttataaaatttaatgtagtaaagactgtttttatatttgaatggatctaaggaagttttctttttctccctccgataagtggggggtgtttaagggtaatggtgtctacgaatttattgggaggatttggctgttttattggaccttgtggaataatttgctttcattttatcatttccatgaaaggtagtcctcagaagaaaaaaatgtggtctcttaacttcataccaatcttaaatgttttgcttaaggggaattagtgaggaaataacagtctcaggaaggttgaaaactgtgattttactcaacaaatattgctcttttaatctctccagccatgccagaaactatgaagttattttctttcacacatgcactgtaagacctggtattttaaaaagctttaaatataagtagctttatcttgaaaataaaaattgtacatagtaggggaaaagatgttcttatcatcatcccttgcttccagccacatgatgtctccagtggagctgctgacgacacaaatttccctaagtctagcacacccagatagtgtcaaatggtttgttagcagttactgcagaaagttagaggacatctgaggaacaaaggtaaatcccttttctccaagaactactaggtttataggtctagaatgaaagaaaggtttaggtcttcattagccagtgacccaggccatcataacacagagcaaaagttacctctctgtgtt

SEQ ID NO: 121458 - DNA, 1844 bp, Homo sapiens
taaaaatacaaaaattagctgggtgtggtggcacgtgcctgtaatcccagctactgaggtggctgagaattgcttgaacctgagagggagaggttgtggtgagccaaaatggtgccactgaactccagcctgggcgacagagcgagcctaccatctcaaaaaaaatatatctatatatatatatagatatacatataaataaataaaataacatcaacagtgtgttattcataattgaaataagatctggatgcaattttttattttacaaaaaaaataacttctaaagtttacagtattatgtttctaccactacgtggacagagttaccatgcatgtgcttaggtaagataaactaatatttaacataaattagaaacccttactaattgctttcatgtgttttttttcttactataatttttaaaatttcacatatcagcataataaaatatctataaactaaaacataaaattcttaaaatggactgtagtaagtcagttactgaaaataaaacactgtcaaaatgtgttagttaaatgtaatgtgagtgttgctataaagttagtaatgtttaaaaaatagcaccacactgagtaatcatcaaaagtattatacatttagtttttattcatgatttgccaaaataaaaattggcacatgcttgaaagggagatttctaaaggaagttaagagcttctgaaagtgtcagtggtgaatgatttaagtgatacttatttttcctgaccttaaaactctgatttgaacttgcactccattttacaatgatgttgtctataaatattacacatgtatgaagcctttcctctactacagaataactaaaaccagaccagaggactgtggaggcaagggaaatgcatttgaaggccgtctgcatgggaattagttacctagacctgagaaacccctttctatttagattcctctcagaattgctctgttttcttttactagaattttagctaaacattaccattcaaggggaaaacaatctttcctgagtggtatcaatttttggtagcttaataacactaattcaaaattgcccgttatttttctgtatcagaagagtaacaggaagttaattgtttatcttaattttggaagcaccttactgaaattttaaaggtggtgcttagtgaactgtcttaacaatctcactaaaataatacagaagactttcttcatgtggttctatatcataagaagtattctgtatagatatggaagataaatttcctagtgcgtactgtagttgtttttgtgcactgccaaacaaatacataatgaagctgttaaatcatttgagattgagggtttttatgattattatttttcctcctcatttttacacctcctaatggccagtaagtaaaatgcaaaaaagtatcctctgattatgtttattattagaaataatagtcagtgaattaaatattctttaatagacttctgttgtaatgtgcggagaagtgtctcgctaatgtacacttctaaaatctcaatatgaatgtgatgggcaagttaatgttgccaagcaagtgatgctaaatctgcctttcctaatttgtatacctcattattatataaccttaataatgcagtactttcagggtagaggctttttgatgcaaattaaaacaaagtaggttggggattcatttagcacaaacactaaatgtgaacttactgtccccacagacttcagtgccctgaatggttagagaaattaatgaaggagctccatcgggtgcctttacaactcttagtaatatgagaatctttccacagctctcatttcaaaaatgataacatgaga

SEQ ID NO: 121459 - DNA, 1595 bp, Homo sapiens
tttttaaccttaatgggatagagttaccctttgctttgagaaagtaatttatggagttcttcatatttgttagtttcagtaaacatgatgctttttgtgtggattttatttttgtttcgggtttgagatcacaaactactaagacttacacaatttaagaaccttacggtaacttcatctaaaaacaaatctcagggaaaggcacacccacttttctgtatcaacttaatctttcactagattcagaatggttttgaattacttcaggaaagtagtgactgatagagcttaaccttcagttttcctcatttattttcataagagaatgggagtggaattcaaaacattcaaatttggagttaatgtgcgtcactgttgtgagtgataggttctgtgtttttccagtgggaaactttgatccacatactgatatatgcctgtgttatacctcgttattcttttctgtttttctcctgattgttgcttactctttcaaaaatcagctgactgtacaagtcctctctgggagcagactttagagcaaaagtgatctataaaagcagcatgtaagtcttttttttttttgtcagagtttataactttccaagtagaccttttatattttcacggtagtctaagttcactcaactgcagtatttgatgttaaatgtacgctttacgctgttaagataatttagtttctgtgtttggtcacttttgcttaaaggattgtaattacataatgcatgttgaaatcatattaagtaacctggccacttgcctatttacttcttgtggctaacaataatgaatgaaaccatttatatatgttgttttagtatatcacaaaattttatagaaactagaagctcggtgatgaataatagacatccatgagccttcttatttgttttgaatttgagacattttctagaatattgctgtttgaatgaggcttcagtactttacagaatcgttgcctgcacatcttggaaacacttgctgggattacttcttcaggttaacccaacagaaggctaaagaaggtatattgctgttgacagtgagcgactgtaaacatcctcgactggaagctgtgaagccacagatgggctttcagtcggatgtttgcagctgcctactgcctcggacttcaaggggctactttaggagcaattatcttgtttactaaaactgaataccttgctatctctttgatacatttttacaaagctgaattaaaatggtataaattaaatcactttaaaaccatgtctgtacatttttagagggcttcagcagggcattgaggaggtgctctgtgtatgcatagaatttgcaatatcaaaaagaaagtattcgtaagagaaatgaggaaatgtgttacagtatttttattttttttaaaagcgtagtagggcaatatttcccagaaaaatctatgaagtgatttgttttgtcctgccctttctgcagtttcaaaataggtgttttttagacccattcacaaaaaaaaaatccattaatgaaaccacaattatttgggggaaaaaagtaagatgaagggttagttattttcacattacttggattaa

SEQ ID NO: 121460 - DNA, 2007 bp, Homo sapiens
cccctctttgccctttgtatattcttttgaaaatatgatccagtagtgtttatgaatgtgtgttgtgtaaaatttagagattgatgttaaacaacagaattaaaggacaaagctgtcttttttgttggaattggggatgggagagcagctcaaagtgggaaatatggagaaaggagagacattgtggaaaagaagagataaattgaggggaaaaaaagaggatgaaaaaatgaagagagagaattactgatgtgcttcacacccacacctcctctccaacttcacagtaacagaggcaatgtcactatcttttacctgacaagtgctttaccagggagttgtgcctggcatcgtgggagtggaaaatttttcccttttgcattttgagacttgggtgtgctgctttaagatgccactggtatctaagtaatgtttgtttatactggatatttttctctgtagcctttgtggattggacttataatataaacaatattgttagcagaactgcaggtactctattgctatgtttattttattagttaaaaaactaccagagccctaggacttctgagcacatttagaaaataccagaggcaattttaagactagcattagaaagaaagaaaagaataagaataaaactaagacttgcataccttagaatcctaaccaatgtggtgatttttaaaaattaatgtttcagagactctaaattagggtagttggtttcatcaattacattttttaagttaatataaagtgcttttgtatgtaaattctcttaatagataatttaggtaaaatgaaagtgtggcattttttgttccatagaatgtaaaactaacgtcagaataagaattcttttgggaatttaggatttttttgatgcttctcaaatcatctgtaatgacttttatttatagaaaaggtagattattcattagtttttatgaaaaacactcagtttaaatagccgggtatggtggcgcatggctgtagtcccagctactcaggaggctgggcacgagaattgcttgaacctgtgaggcagaggttgcagtgagccaagatcgcaccactgcactccagcctggtccagagtgagattccgtctcgaacaaaacaaaacaaaaatattgagctaatctaaatggtaaaaatctagatttgaagaaatttattttaaaatagttgttcatttgtcaaatagaaaagtatgatcttagcaggtttggttagatccctatctgaaacaaagtaaactaaagatgtttttcttgatcaatgcatagcaataactgctgttcaaacatgtgaggaatcaccagtaaattgggggatagaaagcaggaaaaggagcttttttctcttattttttttcatttatcagtttttcccatttgtccatcctttcctataatcatggaaatttttattttttacactcctctccccatttttttatcctagattgccaccacaccaaggttttctagagttaggcagaaagagaacctgggcctagatgctaatggaaactatcccatgctttctcagactctctttcctccccagagacaagaggagcaaaacaggagttgatggctcattgctgttgcttctgtggctgccctgtttggttgacctgagctttttttaaaaacctccactcttgacgcttaactctatgaataaaattagggccagtcacactgtattttcatcatcagttatccctagtgattcaaatttagcacaaacctgctgtgagtacatattaattaggtgaatacagtagaatgcaatcataacatgagtcttttaataactattctttgtttgatttttattttagaagtttgaagttattttgttgaaaatctagaaaatctttatgtgagcaactgaggttcgggtagcccacaacagtttaaatcaaacattaacttgcagtaaaacactactgaaagtgtctttgattttgaggtgcagagagctgtttca

SEQ ID NO: 121461 - DNA, 1032 bp, Homo sapiens
gggccatgtggccagggaacccttcatgaaaccacctctgcaggtaaatcaacatagaatataccacctacaagcagagttaaggctgctttgggacacaaggctcaagagaccacagttcacagacccctcctactagtgggatactcccaccatcctccttaacctgttggtgatttgtgggagtggcagtcccagcgttctgttcaactagggatataccgtttcaagcaaatgattggaaatggaccctaagggacggatgacctgagagagaacagacaagaatggtggatggagggctgtcccttcaacatccttcaagcctcagatttcaaaaactttagtcctaaagcagataatttggcaagcaagtgtggctaagcccaggcacctctgttcttggttgtcaaaactttaatctacaaactcatataatggctcctataatctctatctataaatgcccaacatgtgagaattttcaagcttatcagttaaaaaaaggtcggggggcagtgattgtttagaagagaggttcaaagcataggttgaggagtcaaccagtcctgattgcaatcctagttttgccatttactgcttgggtggcttcaacctacatccttgactctaagtttgtttccttacttgaaaaatgaggataatagtactgcctcataggagttgttttgtaaattatgtaagattataaattaaaacatcagctaataaatcacacggtatatatttaatatatgtagcttttaatttattataataactttttcaaatttcctttttagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttattta

SEQ ID NO: 121462 - DNA, 1045 bp, Homo sapiens
cggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcgggtgagtcggctttaggcgccgtgggctcaagtggtttagggcacctgggcttgggaagaagtcgtggagagagcctttaatactttatggagctggcggggagaacaaataaaattgcggtagcttgaagggcactgacatgccactgacttgggaaccgtatccgtgggaactcttcgggtgccggcgcgaccaagggcctgtgcgcggctgggtgggagatggaaaggttagaaggtcgcggactagccctgcctgcgactggctcagcttgaccttggaccagtgactttaccacttagatttttctcgtgggtaatatgtggggccacagcaacgtggtctatgctgtcgtccagtttttagactacatctccgtttttgagattttcctagggcctcaacacggtgcgcgagttatcaagcgataggccaggatatgtttacatgcgcctggattcacctttcagcctactcagaagtaacttttaagtctgatgttttaaaacactaacatttaaaggctttccttcactatccattgcttattttacgaaccttaggattgtcgtattttgctgcaccatttggaatcctaggggccagggtggggacagagagccaagtctgagggtgaagtggcaggtgcccccg

SEQ ID NO: 121463 - DNA, 1034 bp, Homo sapiens
tttcccttttatctacatctgccctgggccctttcccacacaaggtgaggaacacactttcagagacctctacctccacttcttaaccttcaatgaaaggctttctgtagtttcttctttaattactccaaaagaggaaagaaattgccatagggaaacatttggacaattggacaggttgacatttagcactaatgctcaacagttttacctggcctgactttttctggtcttatgaaggatagagatgagaataggcataaaacagaagagagactactgtctgccattgatgagggaaggataaacaattctccctcttaactaccgaaaaggagacatatgacttggggcattagatgcttcagtttaatgccttagagaaagtctgagaactaatttcttcttactgtggatatggagtggacattagccgttttaatcatctgtgcaatttaaatcttgagaagagattgaaaggacacaattgtgtgtgtgtgtgtgtgtgtgtgtgtgtgtgtgtgtgtgtggtctgagctaacatgccaatttcttatttctaagaatatgcattaagaaaaatttggaaatcatggtgagaggctggattttcagtttcaatttctgcctaatatataaacgaccaaaaaaagtctccttgattctaaaacaggagttatgacgaaacataagttctataaaaaggaaagaaattaagttggtaaatctaacatgattatacccaataatatttcttccaaattagtccatggctagaaatattagtcatttagttgcatttgaaagaaatttctattcttgaatcaggagaaactaaattaacatcagggctacattttcaaaaataatcatacaaattttatgtgtaatatatgcttacaactttaatatagaacttttaaaaagatgtgtaactaaaggtcattttaaggggaaacatttacgcttcaaagttcatttagaaaaagatttgatattgaagatttcagtatcacctgttttatctcagtaag

SEQ ID NO: 121464 - DNA, 1075 bp, Homo sapiens
ttccaataaaaagttgaatattaatttgaagacacatttgactgggaaagtatccaaaatgatttaacttatgtttggggaataaaatacagagttatatgaatccaggtatgttttggaacttcttaaccttcactttctgactgactagcaggtgtgaattctgcctgggatagctctgtagtgcttgggagcacataaatgagggagggattaaggaacagaagagtgactttgcatatatttggaacagaaactgaaagtcctgtctactttgagataataaatgggaaagtattgctcagagtcttgaggatcatacaaaggtagtaattgtaactgtcctaacactttgtcattccagtcggtgcggtggtgaaactcctgtagattaggttatcattatatacagaatgaaatccaaaaaacttcagccatgcccttcaatcttcacagtgtcttgtgtcttgacacaatcacctctagaactctgttcttcctgactgattagcatttatttcctgtatttcacacttaccatacacttttccatctccattatttggcagtgttctgcctttttaaaatgtcctctatctctagctgtgatttaaaactaaaatcaaatttcgccttctcctcaatcgttctctttgaatacccaattttattcttaatgtttgcatgtgctttcctaagggaaattaattataagcataaacggagaaatcatctttctacatttatatattgttttatggttactaaagtgatagtttatagttacatacatggaattatagttgttggattaagttgtacattgttgaatgtttcttttttaatttatagaagtaattagaaagtaagaaactaataaattttataatttcatagggagaaaagatgtatataaaagtactgctgaggatgattgggtttgaaaaagggtaacttttcttgtcttctaattcttggcatatctgttaagtttattgatttaatggccatgcatttgggaaaaattacttaggtcaataagtaccttttcattggatgacaagacattatttac

SEQ ID NO: 121465 - DNA, 1094 bp, Homo sapiens
aaggaatgaaacagttttctaacttgtgtttactgttaatcgcaagaaaagtattgtaaatgctgagctaaaaagcatccatttaattgacatacttttgcaaataaaaaccagtgaaactaaaaaaaattaatgctaatttatcatttcatgtatctatgttctttgcttttatttatcagtatcgtttacttacagcttttaaagttcagtaattagccctgtggtttttgacaagaaaacttaagaattcacttgtagttttcccatgaattatttcttcatgtcacggtttcaacactgaagaacacttttatttcttctacttaactgtgctccttactttgtattaaattcacacatccccacctttgcaactctacccagtaatttcaaggcctggtatcacaaaatcattggtagcttattaaacctatttattcaaacataagccatattcctaaagatgcatctttaagaacttaaagttacattaatatttgtatatttatagattaaatatgcacatagaagcacattttggaagaaaaaaactacacttaataggcggattccaaacatcttcccgaataaattgtttctttattcacttataagattataggttttatgttcttaaagtattgtaacttatctttccaaggcttataacagtgaagattttaaattatggagcaaagaatctacactttgcctttatggggtgcttttccagtcctcttgttccatgtattcttttattttaggagttactaaatgtcctgttttttcctgtcttgttcactgggcaaacaggggtagatggtccccctccctagataggagacgacctcctagtcccaggattcaaatccagcatgcgtctccggagaatgacaggtactagtcaactcctcctcacagacaagtggcttctagaagcttataggccaccaactgaaggataaccaagagaaaagttgaatatgatgtactttattccaggagccagagccagatatgttagatgtagccaactctggtaaagcacctcagaatatttactgaaatgaggatagcatacaaatggcaga

SEQ ID NO: 121466 - DNA, 1065 bp, Homo sapiens
atagattttaacaattacctctgtttttcatcagttcattttataaatcttcacactaaattaatagaaaggaaataatcacagaaaatggaacttcaaaagaattggggtttaagtagaaacatcccattttctgatttttactctagctttgatttaataataaaataattgcttttataccttacagttgaatgtacttttatagctttaaaagaatttctttagtacattgtgaactagaaagcataaggccaaaaatcacacaactattaagttgtgaataaagggagaaaaactcaagatttctgattcttgcatgtttaaaaccaagtaaatattctttatgaataatattgtaaagataaaaaatttatgccagaacaaaaaagcatgtttaaactaaaaataagacataatgaaaacactgaaacagtgttgtcttgttcactcgtgcccagggatctctcaaataaacatctaatcattcaaaatgaacatgtggcagagtcagcagagaacttaagcacataggggtgtgatggtgttatcctcatcaacttattaaggtctatcatagcttggatgagacacttaaacttttgtggactaagtttcctcatctctaaacttaactggttatacatgggatagctgaattttaatgtcctatagactctaaaattgagtctatactgccttgttgcatcatgttaaaacatccattaggccctggataatgactgacagttcattatgtattattcagtaaaccaaaggtcatgttgtatttaagtattttatattttgctgaaggccagaaaattatgcagttttatttttaaatttatttcatttgaggcaaactagattttatagccctagttagttcttttttattgtaatttttgggctttcaaatttaatgataatactcaaaatattaccttttaaactatccattcaacaaataattattgagcaactaccatatgctaggtgttgatattacactgataatccaaacagacacaattcctgaccacagggaacttaaagtggtat

SEQ ID NO: 121467 - DNA, 1127 bp, Homo sapiens
ttaaagcttttcattgatttttattagagtgtaaactacatgcctagtttctttgtgaattgttgaatagcaggttacaaaagaagaactggcctgggttttctaatttatgttagctctgaataagagctgttaagaagataccttgaatttacatctagctacacgtgaaccgaagacacagtataaatgctttggacactgactcctggcctttgagagttgataacttcccaaaaggagtcatactacacagttttgcactggtttctggcgaaatttgctgtttaatgatcataattttaaaggccttttattgccctcaacaaatgtaacctcatgacagatagccttttaagaatatattttgaaagagatgatgaccagttgtcattaggagacaagtagaactgatttatattttttgtgtcaagccacttaaagaaatgtatcatattttctttggaagcttcttgataagataaaagtctagcttttcatcttcatgtgaattcacccttgagaactgctgcccatcatttctgcattccattctagtgacttttcttcctgtagaaactacactctacattctaacttggggatgctttatttctttatttggactactatttagaattgcttacatatgcattttatggtgtgttattgcaaaagagcctgtgcaggcctgtaacggaccagcacagtaggaaccactttgaaaatttgaccttaaataccacatacatgtccattctttaacaagttgtttaaaaacaaaaacaacagaactacattgtttttaggctttggtagaagcaatttactgcaagtccatttgcagcaacaaaaatgtctgactaaagacgcaaatttttattgagaagtatgttttacttaagtgtaaatcaaaactctagtcttagatgaaggagagtaggcatggattgaacttagtggtaaatgtttagatacatacttgaagatggtaaacttagggtcaggcatacataagtttgaattaaacttttgctctgcaaacttttttttttttttttggagatggagtcttgctctgtcacccaggctggagtgtggtcacacgatgttggctcactgcagcc

SEQ ID NO: 121468 - DNA, 1029 bp, Homo sapiens
ttcaaagactgatgtggcatagattgccatgcagaatacttgattatggaaaacttagtgtagatttttaaaggtatcaacttattaatagagtaacactggtgtgataaactctgagtttatattttttaaaatacattctattgatactccatgctttagttttcagggttgctaaaatggtattcatttagtgaatcatgaaaatatgatgcattgtgaaactctgactttcttttttaaaatcgcagttaattcattggaattattcattgacatgtttaacatttttcctctcctctctgggaacattttaaaattattcataattaatctggcaataacccagatgaaattgttttaaaatttattttttaaagcaaaagttggtgtttatttaaattatctattcatgagctcctgttgcacaactgaaagaactacaaatgtgggtgtttagttacaaactcggtcttaccgatcatattttgctaaagattgatattctaaaagtcatgtgctcctaaaattctttgcatttccttcagttgcaaataaaacattttatgggttcaaaagcatataagggtactgcatataactctcctatagtgagattctgattacattatttctgtagaaataagaattccttccacaaaataagttgtattgtatgttggattttggttttttaaaaaagctcatgttctattgttaatataaatgttactgtttatgatattcatattcacagttgtctttcagagaaatcatcaatttgtaaggattgaattgaggtgggaagaagggaatgactacattggtggagttactttgatatttaatatgacaaatacactaataaacattttggttatttgagtttcctgaaatatatgatctttagagttatatacatacagcttttaagaaatgtgacaacaagcatgtattttatatatctatatatataaatgttctataaataaaagagacctggttggtgttttttatgatataaatatg

SEQ ID NO: 121469 - DNA, 1064 bp, Homo sapiens
aatgtaagtaaaaacccagcagtgatttttactttagaaaaatgggtcagtggttttatgcaaggagtaatgttttaatacaaatatgtgtttcagatattttctgctgcttataaatttaaaagcttaatgtcctaaaggtatatatttaaaaagcaaatacaaaagggagagtggctatttttgtattgtaaaatataacaaaacactgcttaaaattatataaaattggccagacagattagattattcattactatgctcaatactatgtaaaatcaaaggtaagtgaaatattgaagcaatttaaatagccagcaactgttttttctcttaaaaccaacattggttccattttctgttccttaatagcaagagccttatcacaaaatttacttataccaaaaagctttcacaaaatcctttttatatctcactcagcattctggaaagtacctattttaaattattcattctactggatatattggcaaataaattagaagtaggaaatttgagtcatgtcttaaaattacaggattagaatgaacttagaatagctagcatccctgtgatagatctgcatctttgcccttccaatcagatgagctgttctatttgttatgaaggagaattatttgtcttctttagagtcaagttcctttacagtaagtataagaggcatttttcatttgtgttgtttcttttgtttaaattttttatggtggtgcttcctggtttttggtgttttgtttgtttgttttttaaattacactttaagctctgggatacatgcgcagaaagtgcaggtttgttacataggtatacacgtgccgtgatggtttgctgcacccatcaacccacacctacattagatatttctcctaggcctcctaggagatatttctgctatccctcccctaggcccccacctgctgacaggccccggtgtgtgatgttcccttccctgtgtccatgtgttctcattgtttaactcccacctataagtgagaacatttagtgtttggttttctgttcttgtgttagtttgctgagaatggtgg

SEQ ID NO: 121470 - DNA, 1024 bp, Homo sapiens
cctgttgtcaagagttgttaataaatgatttcagtatactcgtgtaatacttcagattacttttttttaaaattgagatagggtctctctgtgttgcccagactggtcttgaactcccagactcaagcaatcctcccacgtcggccttccaaagtgctgggattacaggcataagccaccatgcctggccttcggaccacttcttatttaaggcaacctgaaaaacaagtccattccagtatttggggcttaatctcatcctcagacaatttaggtgattatttatccccacatgcttaaagtatctcaatcatcacaattattaaataacatgataaaataataaaatccactccctaaatgtgtttatttactagggctgctgtaacaaaatgccatagactggatggcttaaagagcagatatttattttcttaacattcgagaggtcaaaagctcatgatcgatgtgtcagcaggtttggtttcttctgaggctctctccttggcttgctgttggccaccattttgttgcgtcttcctagggtggtccctcttgtgccggtggcccctggtgtctctgtgaggcctgatctccagctcttataagaacaccagtcaaattggattagggtcaactttaatgatctcgttctaacttaatcactgctttaaaaggccttttctacaactacagtcacattctgaggtacagtggttagggcttcaacatgtgttttagagggacataatttagctcctaacactagaaatactttggaaacattgaagctgtgaaatcaaacaatttacacgagtgagaagttcagcatttggatgtttcccgctctcttatctggctttagccaaaataagaggtagtacagatggtatgtttcagtgtatacaaatctctttacttaaatatttttgggcagccttattaagtttaatatgaagattatttaaaacatacgaaaagccatgttgaacttgctattgtttatactttcaatagctcagcg

SEQ ID NO: 121471 - DNA, 1028 bp, Homo sapiens
gtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgct

SEQ ID NO: 121472 - DNA, 1035 bp, Homo sapiens
aatacaccaataatggaccacttatggacttcataagtgaaagccaaagcaatgagtctagcatgttatgtactgacaccgagaaagcaagcactctcctaattcgcaagatttataccctaatgcaaaatctggggcctttacctaatgtttgtttgagcatgaaacgtttttactatgatgaagttacacccccagattaccagcctcctggttttaaggatggtgattgtgaaggagttatatttgaaggggaacttatgtatttaaatgtgggcgaagtctcaacaccttttcccaccttcaaagtaaaagtgaccactgagagagaacgaatggaaaatatttattcaactatactatcactaaaacaaataaaaacaaaacttcacaaaatcctgagggacaaagatgcagaagatgaccaggcgcattatacaagtgatgatttggacattgaaactaaaatggaagagcaggaaaaaaaaaaaccctcgattttctgaacttggagaaccaagtttagtttgtgaggatgatgaaattgtgaggtataaaaaaagttcagatctttccatttctcattctcaggttgagcagttagtcaataaaacatcggaacttgatatgtctgaaagcaaaacaagaagtggaaagtctttcagaataatggcaaatggaaatcaaccagtaacatcttccaaagaaattcggaagagaagtcaacatgaatctgggagaatagtgctccatcactcgcattcttctagtcaagagtcagtaccaaaaaggagaaagtttagtgaaccaaaggaacatatataaaaattatttttcttctgtatgtttgcaaagtttttctcaacatttaaactgaaggacactatattatatttccctaactctgaaaacgtatatgtagtttaaagcagtttgtacactaaaattaagttcttggctgactgtcatactgtgttccttaatcttgaaatgaatccagcagaacttttgaataaaagcaaaagtacacatgtt

SEQ ID NO: 121473 - DNA, 1612 bp, Homo sapiens
ctaatgtatctttgcctgacttaatgctatggatgtgaattatagatattaaacaaggagacaagaagaagtcacccaagctaggagctctgaagtcatcctttttctcatacttactccttctggtcaggcaaaaggtcattaactattgtttgtttactttataggtatttttcaaatacattcccttttcttctttaccacttctattccattctgtttcttacctctccattagatgatttgtaatattctcctgcctgatcatctggtttctgttctcagccttctctctgctctaacatcatagtattgttcgtaaaatgcaaatcttatcatatcatccccttgcctaaaatatttccatgactcttatcatctactccttcatctatgtatccatctacaattattagagtgtgtaatatgtgctaattcccaaattaacaaggcaaaggcctccactctggaggaaggaaaagacgccagcaagggactactacaagcctgtgaacaagtgtgaaacaatgttattggtgtgcttagagagagaggttacaaagtgacatgagaaaagaaaaagaagtgaagcccgggcagaaaagtcagcacaggcttcaaaggggaagtgaggtgtaagctgagtttccacaaatgagtagttaattttcaggtgggcatagcaggagggaatgaacaatcttgacagagaaaacagcttgagtaaagatatggagttgtgaatcagcacagtaattctaggtactgttaagtattttcagggtgaggaaagccacaagaaagggtggtagagcaaaaggcaaatcaccaatctgttggatagattctgatgctgaccatagaatcttgtatttatcctgtaggcagtagtggtcattgaatggtgataatcaggggaatgatataatcagatataaattttggaaagatctgcctttcattagttcagcaaataaattggagtgcaaaatggagtcaatatggcctataaggagatgataccaattgtgagaattttccattcattgttgcattcatttattcataaacttattctgtgaaatgtctgttgactatcgactatatgctgtggatcatactagaaaggtgagagatgattgcctaaggaactaaggcagtaactgtggagatgagaaggaggagtttaaccaaagaaatgttaaggagataaaatttgcagattgttttcaccagtctgacatgtggtatgaggaagatgattctgacttggttgatttgaggaatggaagtgccattcactaatatatgggacaaagagtgaagggcacatattctggtgaatataatgggttcggatttgaacatgttgggctttttgagtcattcaggtggagattttaagtggtgggaacatagcagtgaacaaggcacagtctatttccaaccacgttagatcagcaaccagaactgtttctggcacatagataacactcaataaaatatttttgaatgaatggaatcatttacaaatctggagtttaatctaaatatgtaaccagatatttagctttgaaagcctctgtcagttttgtggtaattaaagcaataa

SEQ ID NO: 121474 - DNA, 1074 bp, Homo sapiens
gaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaa

SEQ ID NO: 121475 - DNA, 1085 bp, Homo sapiens
tatgcttgttcttcatgggttcatatatgtaaagcatttagcatacaatggtgcataatggaccatttttctgcatttacagcatctcatcaatgggctagaataagcttctttaaatgaaaaactggactgtttccaaattatttatttatgtttagccatcacagcacccaatagagtgtcacattcaaaatgaacttatgtgatagaggtggcgcagtgctcatgctttcccatacaacccatcttttttcatgcagtgcttggttcatattttcttccttctcctaaacctctttttggcataatctttcttcttatttctttcctcatctgatgcataactgtttccctatttagaaagcaatctttattattacttcttttcctctcagcacatttatatcttaaaccttattttttggtgcagctgaggagaataaattctattgccatgtaagcacatttacttcagtcacaatttatccttaatatttttaatgatcaaaagtactagccatgaaaaataggtattttatgtcctaggaataagaggaaaaataaataaaattttgtactttccttgtatagtaaaatatctgtggcttgtttctttttaattctctctagccaatcagaaatgtggtgatgatatgataacataaataacttttgtctggaatgtttttattgaaaagcagatgtgaatcagctactagacagatatcattacaccatgcccatgagagacaaaaaagaaattaaaaattaaataatattcacaaatagctaaactaaagcaagtaaaacatcaaaaactcaggttaacttggaaataacttttttttttttacaatacctaagtaatatttttcttttccctttagaaaggctcctgacattgtttagcaaatacaatattgtggccaacttaagaactaaatcactgttcatctttttaggagattgctttgttgtgttactgttttgttttgtttaagctgccctaattattagtaagagaaaaacaaggctattttgagagctacaaatatgcatcatacaaatataatgatctagaataa

SEQ ID NO: 121476 - DNA, 1055 bp, Homo sapiens
acacacattctcacttactcttggattctggtctttggtgggagcttgaagcaagtgcttgttagccacatatacttttttttttttttttttttttgagacagagtctcgctctgtcgcccaggctggagtgcagtggcgcaatctcggctcactgtaagctctgcctcccgggttcacgccattctcctgcctcagccttccgagtagctgggactacaggtatgtgccaccacacccggctaattttttgtatttttagaagagacggggtttcaccatgttagccaggatggtcttgatttcctgaactcatgatccacctgcctcggcctcccaaagggctgggattacaggcgtgagctactgcgcctggcccacatatactttttctcttgcccagctggtcttaattgtatatggtttagatgtctcttaggaatgcctgggtttgtatgtttggtgtggtaaaaaaaaaaaaatgccatttgtgtaactgcttaccaacttaccaagttatgatgaataaagtaattatgtcaaaatgtttaggtttacattgtctggagcttataattttataattgctgctaacagctagtttttcttttatgttttcacatcattttctgtcctcatggaaagtcttaacctgtgagaaagccatcggtatcttcattttagtaataatgaaactgagacttagcttaccaacccacatggtcaatatcaacacacaggtcttttgatttcaaaacctacaagaaaactctgttcatgtatgtataatcattacctattatgcacatggcatgatcacctggtctctataaagcaaaaacaaaaagcccgacatgattctcttagccttccaattccgaatgagtatgggttccaccatccatagtcaccaaggtccttattcattcaagatccttccttagtcagatcctgaggcttttgtgtgcactggcagcaatggcatcccacgcttccctgacactggaggatacctacagaaaagatcctagctgcttgccaattttaaggcacat

SEQ ID NO: 121477 - DNA, 1033 bp, Homo sapiens
aaagtatcatctttactattccctcttgtcaaaagaacaatacttagaaccacatgtaataattttccatgctcattcatatatataaacatgaagacacatatagcaacataatcattctaccagtattatacttttaaggaaaattcattatcttaactgtttcttggtttttatatcagggacaaagatgtttagctaacatgatcatacaaactatgagtgtgtgtatatgtgtatacccatttaggcatgtgcaccagccaaggttttcaactggaaatgacaattagctacttcataaatgcttttggctatgcgtgcatattcacaaagccacctgctttttaaaagtattgaaaatttttattactaaatttcaaatctggattttacgaatgttgcctatcctactagagaccagtgttgattaatactcttttaaatatcaaggcagaaagcccaaattaatattagcataattaatataaatcagtactaatttgtattgataatagggatgttctgtatgtgatcattgtgtcctgtgtcctcacctgcaggcattatccttatatgtgtgtacatatatgtttatttcagaattttaaaaatgacgttgttatactttatatctggattcagtagggaatgaaacaaagtttatatttgttaattgaaatgcataatattgaaaactatccaaaaattgccttgagaaaaattatagccaagataaaatgcttaaatattcaatttatttcatgatccttgaatctcctggaacttaaattatatattaacctgataatagttaacttaggacagaatgtaaactagatcccacttataaattttatgtgcacatgtttaaccattcatcagacacagaacttcttttattttgagacagtcttactctgccacccaggctggagtgcagtggtgcaatcatagctccctgcaacctctaaatcttgggtttaagagaccctcctacatcagccttctgagtagctgggaccacatatgg

SEQ ID NO: 121478 - DNA, 1041 bp, Homo sapiens
taatatgcaatctagtgtggaaggcaaatagatacagagatacttctagtgtggagtgaggagtgatctgacagaggtgagctcagggtaagagggactacatattacaggaacctgaggaagcctgagtaggggagtagcattaggaaggggaggggaggtggaaattgcactgagtcccaaaggatcagttgcaggggagggtgtggatgtatatgagggaaggggaggaggtggtgggaggatagaattagttagctaaagagaagagccaacgggcagagaacttgcccagcaagaacagagtgtgtgaagtctagcaagtgaaagagagtgcggtttattcaagggctttgcccactcttatgtctatcttcagttgggaatgactgaagagatgaaagtggagaggaagccactgggactagatcataaagggtctttgggacaaactacttgatttttccattatgcttgagtgcaggaatcactggaggacttgaagcagggatgtggtgtgctcagacttgcatttcagaaaaatgaatatagaggtacagtgagaatgggttggaggtcagcaagattcaaagaaaagagtactaaagaggcacattagacaagaaatgatgagagcttaaacaaagtaaagagtggcaagtgacttgcaagtccttaaggcgggagaaggggaaagaaactacagtatttggcatggactgaatcaggaagtggggaaaatgggggaaagaaaggaggaggatgctccagtgtctgtcctggacaactatgtgaaaagtattactcttcataaagaagtgaaaacaggaaggaaagtagattttgtagcaaaaataaggtgtgttcagttttctgtgaaatggggttaagatgctagttggacattcacatgggactagagaaggtttgaacttaggaaaagaactgggctgaagaaataagtttaagggtagccttaagccatgctgtgactaagccacggtgagtagggtagggtgaaaggaggacagaactatgaat

SEQ ID NO: 121479 - DNA, 1008 bp, Homo sapiens
catttcatatggtgaagtctagccaacctcaaatctattagtctgatctacttcatccactacatttgtgtaagattacccttctttcatagtaaacacatatgtaaaatattttaatgtgtttttgttagattcattttaatgtttccaaactgtttctattaatattaataagtaccattttatatgttttctcctatatttcttgttttcatccaggactactagattccagtaagaataaaattaaacattagaggtttgtcttccatattgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccagcggtggtggggtctgtgaaataatgaagaaaaaaattattttaaaaaaagagaggaaaaatgatacctaaattagaaaatcgttggttttatttcttgtatcaaaatatctgataattttaacattcattatgtgttcttttaagaactgatgctcatcagttttctcatcagtttttctgtttttcacttggcatttattgatattttctattgcctgagtaatttaagagcctgcaaaattaacctgcctttcaatttgcacatgtacttattatggtaaaatcaatattttcatcctaggattggtcatgtactttgcagcctaatgataaggagaaaaataacctcagaagagtgaagctgtgctggccagcaatggagatttgatagggaagaaaggtgtcatatcacctggatatagccaactaacagcttgatatatatgattccaagccaaaacctacatttagtctctctctctttctttctctgtctctgtgtgtgtgtgtgtgtgtgtctctctctctcatctttatactatagattataaaatttggatacgtaaatagtcatc

SEQ ID NO: 121480 - DNA, 1053 bp, Homo sapiens
ggacattaaacccagagaaccctacttgatcttccggccgttcaaggggtatgaagagtccctactcaagctcaccgcgagacagcctgttttgtgatctttgacagcggggcaggagcagaagcggccaaaaatgcgctgaacgatattcgcttagatcccgaaaacccacagatcatgaggctagagtttgccaaagccaacaccaagatggccaagagcaagctaatggcaactccaaatcccaccaacatgcaccccacctaggagcacacttacttcatcgctcgggacccctatgacctgatgggggctgctctgatgcctgcatgcccagaggcctgggcccttatcctttgtacaccacagagctgaccccagccatcacccatgctgcgttcacctacccagctgccactaccgttgccgccgccctccatgccaggtgcgctggttcccttcctctgacaccacccagcaaggatggaagtatcgtcagttctgttagttcttcagtctggtcaccggggagttggttctgggaatctgtggtggtgccgggacaggcgccctgagctcccaccgcccccgcccccgggcggcctgtgcagagctgccgctgccccccagaaattgtgaatcctaagcctgacacagtggactccttcctgtttccccttcctcctcttcctcagcccttttctgcacactcaagcctttctccaacgcctcccaggaggatttggggaccttctcgctgaggcgctcagatccagctcggaggatcacttggaccctgcaaggcctgacctcccacccaactttgcttcggtagctcccgctcgaggaaacgaggcgtttaattttgcatgtttcctggcacgaatgaagacgcttacgcttgtgtatatgtgagtgtacagtttgttttcacgctgtcaccatagcaacaggtcctggcccccggtggttcatcctgcctggcctctctctgctcgcctcgcccctgcacccaccacgcttcagggaggcccgagcccccagccccgtggc

SEQ ID NO: 121481 - DNA, 1925 bp, Homo sapiens
gattataggcatttgccaccgtgcctggtgtacccagtttctgttatcaacagaatgcagtggtgtatggttgctaaagggtcccaagatcaggacctacgttaaggtggattttgaattatttaaaattctgattttgttttatttttaattaatctttgggggaaggatgggaggggggtgagggttgaagaagtaaacattgtacctattggatacaatgtttaatatttgtgtgatgggcacactggaagcccaaacctcactattacacaatacattcatgtaacaagcctgcacatgcacctcctgaatctatttttaaaaatttaattctctagcacagactccctttttttggtaagatggcggggtacgacttaactactcgcatcacgcaccttttggatcggcatctagtctttccgctccttgagtttctctctgtaaaggagatatataaagaaaaggaattattacaaggtaaattggaccttcttagtgatgccaacatggtagactttgctatggatgcatacaaaaacctttattctgatgatattcctcatgctttgaaagagaatagaaccacagttgttgcacaactgaaacagcttcaggcagaaacagaactaattgtgaaaatgtttgaagatccagaaacgacaaggcaaatgcggtcaaccagggatggtaggatgctctttgactacctggcggacaagcatggttttaggcaggagtatttagatacattctacacatatgcaaaattccagtatgaatgtgggaattactcaggagcagcagaatatctttattttttcagagtgttggttccagcaacagacagaaatgctgtaagttcactctggggaaagctggcctctgaaatcttaaagcagaattgggatgcagacatggaagaccttacatggttaaaagagaccatagataataattctgtgagttctccactccagtctcttcagcagagagcatggctcgttcactggtctctgttttcttcaatcaccccaaaggttgtgataatattgttgatctcttcctttaccagccacagcatcttaatgtgtccacacattcttcactatttgactacagcagtcatagcaaacaaggatgttcgaaaacgttggcaggtgctaaaagatctaggtaaagttactcaacaggagtcttacacatataaagacccaattacagaatttgttgaatgcttatagattaactttgacttagatggggctaagaaaaagctgagagaatgtgaatcagtgcttgtgaacgacttcttggtggcttgtcttaaggatttcattgacaatgcccatctcttcatatttgagactttctgtcacatccaccagtgtatcagcattaacatgttggcagacaaattgaacatgactccagatgaaactgaaaggtggattgtaaatgtgattagaaatgcaagactggatgccaagattgattctaaattaggtcatgtggttatggtaacaatgtactctcaccctatcagcaagtgattgaaaagaccaaaagcctttcttttagaagctagattttggccatgaatattgagaagaaacttaatgacaatagcaggtcagaggctcctaactgggcaactcaagattctggcttctactgaagaaacataaggaaaagattttaaaaaaactctaaaagaaagatgaaataataaaactattatataaagggtgacttacattttggaaacaacatattgagtgtaaattgtgaagaattggaataaaattgactgattcaaaaaaatttaattcacaaaaaaattttaatccttttaagctaattatagattcacatgtagttgtaagaagttacaaagaggctaggtgcagtagctgacgccc

SEQ ID NO: 121482 - DNA, 1886 bp, Homo sapiens
aaagtggagccgcgggtcctgctccttaaggccgaggggatacggacccttctttggaacgtgtgaggcaggaactcgattcggcagctactgggtggtcctcgcaccctcaagcctggacgcccgctttccgaggttcaggtcccaccggttgttccctagaggaagaggcaagagcaccttgcccccagccattcccaagcccatgggattctggtgcgaaagacacaggtcaatgcaggtggaaaccctagttaacttggagacagctgggcccgggtgaggctctcccgaagtcgcgggaagcggaagagttggcaacctgctggaccgcagccagggcggcggggcatggactcagggtcctggcccgggccgggggcggggcctggccgggggcggggccaccaggtgcgaggctttatcgcccctgagcctcggccggcgtgattaggcctggtttgcgctggagagtggtcttggttgtgagggtcataagatgggaactctcccggcacgtagacatatcccgccgtgggtgaaagttcccgaagacctgaaagatccagaggtgttccaggtccagacgcggctgctgaaagccattttcggtgagtgtgcccagtactggcgggctgccccggctcgggagtctcagccggcccggggatctcatctcttttccccaacaggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgaggtgagaggcccagagactgggtacgcggaacacaggctcgcgggggccgcttcgcgcctctcctccagccctctcctctttctcctctcttgctcgctgccagcaccttgggcgtcaccaggggtgcccttggcatctgggccttcccaagacccctttgggaatgggggccccagaatgccggccgtcggtcttggagacccaggggtgagactatggtgaaaggcggctggtgctggacccactgggcagggttatctgagctatctcaaccgtctccccgcccccttcagtttcttggagaatgttcgaatgggccgagtagtctcgggttccaaggttctgggcctgactctcaggcccagaacgcctggatcagaagtcccagaaacgaaccctgaaagaggcggagaacagtccgggcgcttactattttcccccagactcacgccgctgttgctatttctggtgcagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttgatagttcagtgtggttgatggattgtaggtactaccttaaatatctctgaagcacagctgaagtgtggccctgagcttaacccttaattgaaatcctccaaagacaaaatgagggtccaaaggcacacttggctagtgtcaaaaagggtggaggagccagggtcctgagatgcagcactgaactaaaaacctatgggagatgtgatgattgtctcaagtgacctg

SEQ ID NO: 121483 - DNA, 1926 bp, Homo sapiens
aactgacacattgaacaagcctgccctgggtccgatatacctatctttgggaggcaacgatgaaaccttaacctagccagcaaaggtgattcccagtctattaatagagtcgtcaattcaaactcacactgttaatcagctataaggtgggcagaggactttcaggctaagcataccttacgagcagagatgacgaaggagagcattggagacccaacaggaggccaaatgaatactagttcaaggtcaaagaggcaatcccggcgattgaagcagcgcaggaagtgtccaatggtgccgctatgccggggcgtcgcttgcacccgctcaccccgacgcggtgcgaggcgccgccggaaggggcggagcgggtcgaatatggtaaaagagagcccgagcttcgcgcctgggtctggaagaggtcttgcgaaagccgcctcgagcgcgctccgcggctgctggtcccagtatggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggtgagcgaccccaggtgtgctagtgggctgtccacctccagtctgagagaggcttggcagagcagctctctacagtctctttcccagattcgcaagccaggagtgttgcagtgatgcccaccttccagttcttcccttccctggccaacattcccttcaaatccagcttctaacctgccaccgtgcagcccctcagagtttttccttacttgtttaggcccagaccgagccataattccagaaatggagtggacgagccaggccctgctgacagtggacatagttgactcagggaacctagtcgaaatcaccgttttcgggcggccccgtgtacagaatcgggtgaagagcatgctcctgtgcctggcatggtttcaccgagaacatcgtgcccgaggtgagggtctttgagaacctgcatgtggaggaagccacgagtgaccatactggccttgctcggtttccttccatcctcccttaaccttctcaaaatttcttggtttccagaccccagggagctagctgtacgaagtttgttgggaggggatcctggggtaggaccttgggaaagtcagcagagatctgatagattcagacccatcactgcccaagtcagcctcacctgggttacagcactatcgcagatctttctctcctccccaactcccagtcacggagtagttcgaaacagcaaacacttgtccctgtccatggttagtatcaactgcttctcttccagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaatggctattttgccaaaagcattaagatcttcacacacttataataaagcaaatttataaaagattgactcccactcatgttttgatatgaagggtgggcaggtgatagttttgtaggtttttgtttttgtttttttttcctgaattcccatcattttgaaactcctaatccttttatgattttctggtcagagagaggccctcacccacagggagcggatatgcaggggcagataacctcacaaatggtgatctgttttgtttttacataattggtcctc

SEQ ID NO: 121484 - DNA, 1175 bp, Homo sapiens
agctgggtgtggtggtgcatgcctgtaatcccagctacttgggaggcctaggcaggagaatcacttgaacccaggaggcggaggttgcagtgagccaagattcgccattgcactccagcctgagcaaaagagcaaaactccgtctctaaataaataaataaataaaaaataattgcatacttaaaatcttctggccctggccagttgcagtggctcatgcctgtagtccaacattttgggaggccaaggcaggaggactgcttgagcccaggagttcgagaccagcctgggcaacatagggagacctctgtctctacagtgggtgtgatggcatgcacctgcctcagctacccagtgagctgagatcgtgccactgcactctagcctgggtgacagagtgagaccctgtctcaaaaaagaaaacaaaagaagagaaggagccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtgaggcctttcgtttttaaaaaaaaaaaaaaaaaaaaggaaagaaaaagagaaggtgagaaagaatcttccggcccttaagagctctgtgaaacgtcagtttgctctggccgctttcccattttgatctcgggctggcgtcaggcccactgcaggatccctggcaccccaagaagctaacccagatggcgggaaaagtgttctattaacccagccaagttggctcagtgcatctctccacctcagtctctggtgttggcttccatgcactcgggaaaactgcccacttgtccccaggcttccaaggaggcccacgtgactgactgagctcccaaaaggttttcttgcacaatagccctcctgtttt

SEQ ID NO: 121485 - DNA, 1320 bp, Homo sapiens
tttgtatttttagtagagacggtttctctatgttggtcaggctagtctcgaactcccgacctcaggagatctgcccgcctcggcctcccaaagtgctgggattacaggcgtgagccactgcgcccagcaaaagatgtactttttgtgttaatgtttatcattccgtttcagtcacaggcatggcccattgtgttgcaaggaatagatcttataggagtagcccagactggaacaggaaagacattgtgttatttaatgcctggatttattcatctggtccttcaacccaggtaagaattcctatggctggtttcttcttatagaggtttaatagatttagatatcaaaaatgtaattaaagtttctttacctattgcttgatccaaaggtaatgcctagcttcagagaagatgcaaggaattaaacacttagattgtgctggtgaaagtataaactggcaaaacatttttaggaggcaataggtaatatctaccaaaagccttagtagtgaaacagtggaaactgtttaaactatgtccaatacacttatctattccatgataaaatatttgacattttagatgttaatgaaaagaccatcttaaacaaaaggctggtattgggaagttgggttttagggtgtgtggctttttaaaatttccctactttatggtaaatatatattggttttgtaataagaaaaagtacatagaaactaacactaatctctcagtaaagcaatcttaaatctgagaaaataatacattttcttatggggaatttggcatattctgtgtaatatcagccattttttaggtacgtagatcataattagcaaagtctgtaatatatagagagactacttttaatcatataccttctcacaaaaaggcatagtctgactatgtctaactgatactcattgctacaaattttttttttgagacaaagttttgctcttattgcccaggctggagtgcagtggcgtgatcctggcttactgcaacctccgcctcctgggttcaagtgattctcctgcctcagcctcccaagtagctgggattacaggcgcctgctgccatgtctggctaattttttgtatatttagttgagatggggtttcaccatgttggctaggctggtctcaaactcctgacctcaggtaatccgactgccttggcctcccaaagtgctgagattacaggcgtgagccaccacgtctggcttgttgctacaaatcttgatggtactgaataaatgtaccgtgcatctgagacaagtaatttaatattaatctgttttctctccaaagccttaaag

SEQ ID NO: 121486 - DNA, 1062 bp, Homo sapiens
aaatgtatctttctgtcatggttcgaagggtttaggacccatttgctgaaccatggtatcttgtaacttgccggcagttacttttccattttcacaaagtaagcattttaatgtaaacagtaagaaataaaattgattaaattagttagggcaaatattatttttagatcttgggttggtttataccagaatggttcagtgttcatttggctttactttttaggcaaagtgagaatactaattgcaactgatctagcctctagaggacttgatgtccatgacgttacacatgtctataattttgactttccacggaatattgaagaatacgtacaccgaatagggcgcacgggaagagcagggtaagtaagcttagtccacccatgaaaggccaattctagattctccttattcctctcacaaacttcttgcccagaaaaccattttattctattacctataatttttcagctacttcccagattatacttgctactttatttatccctgttcatttggcttgttccagactcaaccagattccatccatgattagcttcttatatctggttctatgtgttttatatctagtgtcaccgctgagctctgtacccagtggttactctgaaggttattgacaaattggtatggatatgagacgacctttttcctcttaagagagctaccactgggccgggcacggtggcttacgtctgtaatcctagcactttgggaggccgaggcaggtggatcatgaggtcaggagattgagaccatcgtggctaacacggtgaaaccccgtctctactaaaaatacaaaaaattgacctgggcgtggtggcgggcgcctgtagtcccagctactcgggaggctgaggcaggagaatcacttgaacccatgaggcagaggttgcagtaagccgagattgcgccattgcactccagcctgggcaacagtgcaagactccatctcaaaaaataaataaataaataaataaataagaggtactatcatataccccctttgctgtttaaaccacagcagatttagattccaaatct

SEQ ID NO: 121487 - DNA, 1162 bp, Homo sapiens
ttctgtagttgtaatgtaaaatagtcacattccattttgatccatggtaacaatttaaaaaatgactttaggccgggcgcggtggctcacgcctgtaagtaatcccagcgctttgggaggcagaggtgggtggatcacctgaggtcgggaattcgagaccagcctgaccaacatggagaaaccccatctctactaaaaatataaaactagctgagcgtggtggcgcatgcctgtaatctcagctactcgggaggctgaggcaggagaattgcttgaacccgggaggcggaggttgcagtgagcggacattgcaccactgccctccagcctggcgatagagtgagacttcatctcagatagatagatagatagatagatacatagatacataaatacatagatacatagataatgactttattcttttttcttgttatttagtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaaggtaagatactttacgaaaacctggcttacagctggtattggctattcacagcaggaagtactgtaactttttttttttttttttggcagcagttcactttatagcactattgcttatagtgcaaagaaatgattttttttttttttttttgagataaggtctcaccttgtcacccaggctggagtgcagtggtacaattatgggtcactacagccttgacctcctgggctcaagtgatcctcccacctcaacccccttgagtagctgagaccataggcatgagccattgtgcctggctttttaaaatttttttgagaaatggggtttcactatgttgcccaggctggtctcgaactcctgggctcaaaggatccaccccccttggcctcccaaagtgctgggattgcaggtgtaaaccaccgaacccagcc

SEQ ID NO: 121488 - DNA, 1123 bp, Homo sapiens
aacttaattctccagataaggagttggggaaaatcaaataatacatcttattgaggtgctactgtttagcagatgctgctgcatttgctcactatacttagaaataatcttttggggccgggcgcagtggcttatgcctgtaatcccagcagtttagcagatcacgaggtcaggagttcgagaccagcctggccagcatggtgaaaccccgtctctactaaaaatacaaaaaaatagccgggcatggtggcgcatgcctgtagtcccagctactagggagtctgaggcaggagaattgcttgaacccagcaggtggggattgcagtgagccaagattgtaccactgcactacagttgatgggcgacagagcgagactccatctcaaaaaaaaaaaaaaagaaataatcttttggtatttattctgagatctgatattatttcaaagaatcttgttcttgatctgccttatatgacatggatccttatgttaatgaaactttcatatatttgcagagctctcgatgttctgaagtatgaggaagttgacatggattcattagccaaggctgttccagagcccttgaagaagtatactaaatgtagagagctggctgaaagactgaaaatagaaggtagaaaataatttttgacttaacatacctttatcatatgtgcaaattatgaatagacaacagatccattattactgttggaccagcacagtgttagcttctgtgcttttcaaaagtgtggtcctcagctaagagcattgcaacacctacaagcttgttagaaatacagaatcttggctgggcacagtggctcatgcttataatcccagcactttgggaggctgaggtgggctgatttcttgagcctgggcattccggaccagcctggccaatatggcaaaaccctgtctctacaaaaaaaatacaaaaaattagctggatgtgaagatacatgcctgtagtgccaactactatggagacagaggtgggaggattgcttgaggctgggaggtggaggttgcagtgagccaagatcgctgtactccagcctgggtgacagagcaagatgacatctaaaaaaaaaaaaaaaattaaaaaaaggaaatacaga

SEQ ID NO: 121489 - DNA, 1050 bp, Homo sapiens
tctcaaaacacgctgaatgataagacttttaatttggtagacttaataggcaaagtccctatgagtaggcaaatctgcatgttgagttttattccaggttcagttttaggttcactgtctctctctttgatgaacactgcacaaagttatttgtattacagctccttaaagaaagagtacaaattgtttacgactagttttttcatatacacgaaaaagcacaattataatttctgtcccactcagaaattaatggcaaacccatagtaacctaataaagctattttaacatgtgctaaataattcttttatctatactgttgtattgatcaaattatttatatgctctttaaaaatcttttatgaattgaaagctataactctctctcttgaagtctgtctgcatcacataagtattgatcagtcttggatgattcattcatagccgactgtcttcgttgagtggtcttcacaaatctcagcagattgatgatggcggcaggtgttactccgggtatgcgactagcagccccgatctaaaaatcaataccacaagagaaactaagtgagctatgctatgtcaaatcaaatctattttcctccaaataacaatctgtatagtatagtttatacaatattttcttaattattattttgatgtattatcttaacatatttccttgtaaagtagataaaggaaatattattatttatgtcttcattttacaaatgggaaactgaggcacagaaatgttaaaatagcttgtgcaagattacataactaatagatgttagagtatctacttttttgtcccattaaactaagaaaaactgtaatcaagttcctttcttcaaatacaggtccacagtcccttatttgaaattcttgaggccagcctgggaaaaatagtgggactctgtctctacagaaaataaacaaaaattagcttaggatggtggtgcacacttgtagtactagcctctcagaaaacaaaggtgggaggatcacttgagcctgggaggtcgagaatgcagtgagctgtgattatg

SEQ ID NO: 121490 - DNA, 4496 bp, Homo sapiens
ttgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgaggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatccgacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaacgactcttaatccttacagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttattgcagaggctaaagtcatttgagactttggatttgcactgaatgcaaatcttttttccaaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaaggatgactacttaaatgtaaaaaagttgtgttaaagatgaaaaatacaactgaacagtactttgggtaataattaactttttttttaataggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttga

SEQ ID NO: 121491 - DNA, 1344 bp, Homo sapiens
taatttctgggtattaaaaaaccatcagagacatttctttttccttataaaagaagtcataacagtgaacatttatagcacttagcttactaagggtttcacgtcctataatccccagcactttagcaggctgagaggggaggactgcttgaggccaggagttcaagaccagcctgggtaacatagcaagaccctgtctctatttagaaaaataataaaaacaaagggtttcacatgtattttagaaattagaccttccgaagttgtgagatttgtaataatgttcattttagagactagaaaactaagcctcatgaaggccatgtgacttgtccaccattgcaccagtgctgagtggcagatctctggtctggaagccacgttcttctcactataccatgttgccatttttcagcaactggtgcacgatgcatattctccaagacagaagggaaggaggcttgattaattgtggctcagcctttcctcatagttttggggctgtaagacctgtgcattgtaagtgaaccataaggtctgtttgcctcagagcaggttagttcacaccgtgctgctgctgcttttaagcaatgcaggatgaacggagcttgggagcaattttctctcactcccatggtggcatctcttcagttcactttctttgtactgctcctcttaggtttatggccgtgcagttgtcagtgctcctgtcagtctttccaaccttccctctaaattcctggcaccagcagttggcctagaacatgctgatcttcagcaccctgacagaaaaggctgctatcacagtggaaagtgtggcttcctgggctgcctcttggcaaagggctctagcttgtccagatttgggtcagccccagggtctatcagttccaggagaggtgttgaagggctgtgacaaatgcctgccctggcagatggaggaagctctggctagcttgagagcgcagtgtaataacagctgccctgagaagggacttccagccattcttgtgctctgagattgtgtccggaattggtgggttcttggtctcactgacttcaagaatgaagccgcagacacttgcggtgagtattacagttcttaaaggcagcgtgtccggagtttgctccttctgatgttcagatgtgttcgaagtctcttccttctggtaggttcgtggtctcactggctcagaagtgaagctgcagaccttcacggtgagtgttacagctcttaaggtggcgcatctggagttgttcgttcctcctggtgggctcgtgatcttgctggcttcaggagtgaagctgcagaccttcgcggtgagtgttacaggtcaaaaaaag

SEQ ID NO: 121492 - DNA, 1184 bp, Homo sapiens
gcgcccttgggctttttttttttttttctagaaagttttctggtgagttaaaaaaacgtgctcagagtcctacccacccccacccccatccccagcccaggcgagttgatgtgtggattcctggcatttgttatttgctgcccaaatgaccctggcctctgggaatgaggccccggacctttgcttttatgtcccagagctcctgtgagttttacaaaattatcataattatatttcaatcttaagagctagttctgcattttaggctaaaaagcaagaaatgagggacaagaaagtcactttttgcctagtgtccctgctgcccccagcggtcagcagcctctgacgctgagggtgtagacccgggttctgaggccccagtgtgactttccattgttcgcgaggccctcacccgctgcgccgcccgggctgagtcattctaaattcctttctttgtgttttctctctgcagtcacgcagaaatagttgctccactagtcatcttctttccttaaaccaaaaagaaagaaaaaaaaatctagcctttgatagttcttattcacgaatcagctaaaatatgagtcaaacacaagtttcctgagagctataaatatttgctgcaccccaccctactgggaaatacccacagtccgtgtttcgccaccgagtggctcaaatctggaggatttctttggtgtccggggtaaaacgatccctgctgtgagtggtttttagggcagtgaatctgtaatgtattccaagcttctgaagacagggtgtgtgtgtgtgtgtgtgtgtgtgcgtgtgcgtgtgtgtttatgctgtaacaatcggttctttaaaacgtattttttaaaatacaaagtccttatggtgaaagttatggacattgacactgggataagagagtggagaaagtagtgagctgaatggcatccttcaggagtgtcagtgttttgttttttggtgtttttattggcaagtaaatatgggtcatttggcatggccagtgggctgacatgaatatcaacaagggccactttgtaggccacagaagccaccttatcatccagtctgaggtgtaaagtttgagggtggattggggagggtcactccagcctgaagcccaagagccagaaaccctagatttggggttctaaagtcaggcggaagttttggggctg

SEQ ID NO: 121493 - DNA, 1024 bp, Homo sapiens
aaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattgatttttggatctgacagttctgtgatgtttcctagtgtccacagtgactctttgacatcttttctgcatcctgctcgagccatcgtcttctctacacacatttctgctaccacaaagccgaggaacttgggcctcctaagggatacagcatcagaaatctctgttgccatcaacctgcccttcctagctctgaatagagtcagtcc

SEQ ID NO: 121494 - DNA, 1047 bp, Homo sapiens
acagaatattacctccctcagtaagaccccaggtaccatttcctcctatttttccttcaccctcaccaagtggaaccactctcccaacttttaaccccatagattagtatggtctgactttgggctttatataaatggaataatttagtatgtaccttttttgtctggcttcttttgcttcatattttgtttgtgagctgtatttatgatgttgtagcccattctcattgctgtattgtattacgttgaacaaatataccactatcctactgctggtggacatttgggttgtttcaaggatgaggcttttatgaataatgtggctgttttaacactcttgtgacactatctttttaatgaagtgaactacacacaaaattttatttcacttgcattttttgtcttcctttatagaacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgt

SEQ ID NO: 121495 - DNA, 1092 bp, Homo sapiens
cagagtaagactccatctcaaaaaaaaaaaaaaaaaaaaaaagaatgattcattaagctatgtttatgtggttttctgcatctgcattttattttatagtaaaaaaaattttttttaaataaatgagtgagaatggaagatgaaaatgttcagtagggagaatccataggctaacaggaaggtttgtcttctctcacaacccagatcccagagaaacagtcaagattacccgaagcagacaggactagggcaaggcttatttccctctgagacagactcttagggactgccttggactgaaccctataatccttctgacagccagacttatttactgtaattatattaaaaaattaacaacatattgctatgcatttcctttgctttcaagtggtggtcattggctgtgatgaatgtgtatgttttgtttttttctctcaccgtaattaatcctgtatcttcttattccttccagaatgggtttttatcttcattgccttatttaggctcttggttatgtatgatcctgtctggtcaagctgctgacaatttaagggcaaaatggaatttttcaactttatgtgttcgcagaatttttagccttataggtaagtgaagcaatcaggttttgttttggtttacagttatttaccatgtttacagttataggagataggaaaacaaagtgtgtttcccacttttacacacagttaacacaatactcaacacagaacacctcgctctaatcaccaaaatgtttgtggggatttctgcctacacataaccagttctgcagcggacaccagctaggtatcctgtaattcagttctgacactgtccagctggcggtagcatcagatcctataggttgagggctcagttccacaagatcgcccccctacttcggataccaatcacaagtcccagcttgtgacctctgcttctgactgaccggctataaatcagggttcccatgactgtcttgtcaggttcagttaatctgctagagcatctcagagaactcagagaaacactttattttatgtttacccacttattataaagggtattgcaaaggatatagatgaacag

SEQ ID NO: 121496 - DNA, 1032 bp, Homo sapiens
ccagctgacaaggagtaggggttcagtttgaatctggaatagatctttttctcagcaaaggtgataaaactactacctccatgttttaatgaacttttttatagttcaggctctcatgtgtgaaatttttaccaaaactacagatatgagaaacagctaatctttgacaaatgtttcttagatttgcttaatctaagaatattctttaacattttttcataattatttttgtacttttaaaaagcaacctttttcattatttagacaatatcatgtaattaacttttttaattaaagcagccgggtatggtggccaatgcctataatcacagcactttgggaggctgaggtgggtggatggcttgagcccaggagttcaagaccagcctaagcaacatggcaaaaccctgtctctaaaaataaaaatttaaaaataaataaaaattttccccaatctttatttcagctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacggtaggtgctattttttaaggaaacaattttaattatcctaaaatacttgcaagtaaaaatattaaaaggtcttttttcatcctacagaaactatactttgtttgtgtatactctgaatcactttctttttgtgttttcccaggaactgattgggcaataacttgtaactatagctactactgctatgccgtaatacaccttcatctgtttgaaaagtagttcttccattccctctataaacataccatgcttaaagaaaatttggaaaaacctgttttatataacagaaaattaaactgttttaaattttctaaatagcttttataggagtattatttataaccctatatcacttatagagttacagct

SEQ ID NO: 121497 - DNA, 1050 bp, Homo sapiens
acttccctagttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcgggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccggtaagcggcggggtcgtccaggggcttcgagtgggcagcggtaccgggggcggcggtctctgggccggcatggcccgggtacccgcaccctgcgccggcgggaccggagctgctcaggcgcgaggggacattaagaggggagcccgttcagagtgccgctcagtcccgcctgcctcggtgcgcagaagcccctcgggaaccccgggggccgcgaccgtgatcgcggagccgagccggggcctcggcaggtgcagccccaccgggcgggggcgggggcgggggcgggggcgggggagcggcggtgcagccggcgctgagctggtggttattttgggtagtgctgagcaagggacccagtggaagaacgaactgggagagaatcatcaaatgaatgggctaaggtccgagcggaggaccccggtgtaagagcaaactggaggagaaacctgcagatcagtaggcagagggctgtccttccctgtcaccgctaggtttccgc

SEQ ID NO: 121498 - DNA, 1053 bp, Homo sapiens
catcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttgacatggcatgtttctttctttgaagggccttttggactgcctcaagtggttgttacaacaaac

SEQ ID NO: 121499 - DNA, 1016 bp, Homo sapiens
tatggatatatatatatatatatatatatactttaaccattacatacgtagatggatgtgtatttatattttttacttagtcattcaacttttaaaaactatcatctttgacctgtttcaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatc

SEQ ID NO: 121500 - DNA, 1066 bp, Homo sapiens
tttgattccagatatttcaggattctgggtatccacttttgtcaaaggagtacttaatactctagagaaaacctacatatttctataattctactggtttggctgctgtactaatagggctactaaagataaaatacctttaatatgtttttcaatgagatattataacaatttcttcaggattactgttcctaattactatttaaaaatatattagacatgtttgtttgcttcaaataatttttcccctgccttgtagccaaattttttcttggccataaatctagaattacacaaatgtctagaaagaacttggcttaaagagtgaacttctgtgaaaaattaggttctgctttcactaaggaaatgaattacttgaatcaaatattatcagttaagatgaaaattacatgcttccagataatttttcccctgtgctttctctttttctccctccttaggtttgccaggagagaaaggtgaaaggggtactggatcttcaggacctcgggggctgcctggccccccaggtaggtttgctagtattttaaacaggcaaagactataaataccgagagggcacaccatcccgaagagattcacaacttcatcctgttattcttttttttgtttttgagacggagtcttgctctgtcacccaggctggagtgcagtggcgcgatcttggctcactgcaagctccacctcctgggttcacgccattcttctgcctcagcctcccgagtagctgggactacaggcgcccgccaccacgcctggctaattttttttaatttttagtagagacggggttttgccgtgttagccaggatggtctcgatctcctgacctcatgatcttcccactttggccccaaagtgctgggattacagaagtgagccaccgctcccagccaacttcatcctgttattatagcataaagcattcttattaccatggcatatgttttagcaagaagttcaacctccataacttcattttcatgttccctttgttaaaaaaatgaaaagtttctattaggcattaactataacattaatatatg

SEQ ID NO: 121501 - DNA, 1070 bp, Homo sapiens
tgaggcacgaaaagcatttgaacctgggaggcagatgttgcagtgagccaagatcccaccactgtactcctacctgggcaacagagtgggactctgtctcaaaaaaaaaaaaaaaaaaaagaaaaagaaaaaagaaaaaaaaaaagaaaatacctaacaaacaagtggaacaaaactcactcaaacattgcatttcagccaaagaggtgaatcaagagtgggaatctcacatacacctttcacttttctatctctttctcgtagacatatgttcaaacatgcattttggccaaagaagtgaatcaggagtgggaatctcacatacatgtttcacttttctatctctttctcgtaggcatatgttttcatggtctttcctcatgaagtaaggatcacattgctctcaatggctcacacccttgagagagtatgtgtgagaagttggcaatgttaaaatgtggaagtgccaatataaaatgtttttcatgcatctttagctgatgttgctgttggttgtttgcagttccaaatccagagttttgacattgtctgcagtccagtgtggaccagtagagacagatgctgtgatattccctctagggtaagtaaaacagaattgaattctgccatggctttaacagtcccccagtaataaacccttgtgcctgggagaggaagtagcactgcacagttgtatattcaggatggagctaaaagacacgcaatgtgtgggtgctcaccagctactacagaaaagccagtgcctgtgtgatccctccctcacaagctggtaatacacagactgtttctgggacttctccctaagagaaaagtcctgctgagttaatgtgtttgataagaccacttactgtaaagccctcttattgcttgtaaagtatcagcattttacaaaacaagccagcacctttctggatgactaaggttttttagatggtagaaataaccatattatttctttttgagatgatgacttttctttaatagtatctatgtaggtggtaatagttacaaagttgaacgttggtgatggatttgaagcttttggccag

SEQ ID NO: 121502 - DNA, 1050 bp, Homo sapiens
catttttttcagttattttgccaaacacctttaaattttctccaaacaacttcttgaaagcttgcatggatgctttggagctttgtggttgagaagcacatctggatttaatatctcgtgcttctctagtgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtaggttgaagatgatagtagatatgaaaatatttgttttcctagtaggtttaaaaaaagaactttatcaagtatggatgatagcatgttttgaatacttgtcactttgttaacacagtgttgaaaacttgtgatattaataaagcagtttttgaaaatcaatgatatattggactgtcttgtcaaaacagaaatgttttgctgtgtgatattaatctcaaaaagatcatcccttggtagataaaaagttatcaaatctaaatggtatttccttcccatccagattccttatatggctttctattctaagaattactagaaaatgtcatgtttctaaaaataaaaggtagcaagaggttgcagcaatgaagaggagcagtttgtcagataacaggaagataggacactagagaaggacacagagaaaggagaagtatgttgttagaggggtgtccttttgggagtgttcttttgggagttccgtgatgaccggattcaaagttagagcaaattagaagggcttcatgaaccagcaaaacttgtgtgtgcttgagggagtattaatgtcagaatctcagaggcatttttggaacataggagtcatttctctaagcactcagtgactggttctgctggtcatttgtggattatacaaaagctactttatacatgtgcacacatttatttcattctgcatttccatttaaaaggggtacaatggccagtggatctcacaagattcttgtgcatagcaaatgaagtaatgctgtgcgtaagagaccat

SEQ ID NO: 121503 - DNA, 1094 bp, Homo sapiens
attattacataaatctatttttaagagtaatatataattattaatgtattaataattattagtgatgtaattaatgtagtaattttaaattatgtaataacgcataatttaaaattgtgcattaaatttattaatgcatttaaatattaaatttaaaattatgcattattgcataattaagctctattatttaaagagtttttactaaatgtagatattgtaccgttttctatttttaatgactaagatgcagttttcttttgttaaagtaattgcagaaatgttttatttgggctgggtaagcagtgttaggttacataaatgggtgggcaactatgacttgggaaggaaaatggtaacataagccccttagattttctgtccctgccacaattacagcctttatgaacataaagctagtttttaacattcttagagacggaggtggtggacagagtttacttctgatagttttcattattgctaaaaaagagtagatctgggcagagcaggagcaggcttgtaagggcttatttccttgggatagtatttgggaatccttaatcctgatatagtatataatatatgagtgacacatttgtattctgtagtgtgatgagcattatttaattttttccaatgatttcttttgtaatataaagaccaaatgctaaccttgtaataaactggaaaatttatagctggtaatataagcttttggaaaggagaacattaaaaaaatggatgtggacaaaatcaagtgtcaaatcttgctgttttgcattaatgttctattgtttctcttatgatgatattaactgacttatatttttattttgtagcttgtacactgaggatgttgggattattttctctttccaaagcttttcctatgtatcaatgtttgtgcttatctttacagctctcaatttgtatatttgtttgcatacttttctaaattgtcttccttctttcttgattctttaaatgtgcaaacttcaccatctatatttacatgatttttattcacagtagatcataaatttaaatgattaatagctagataataatatatcagggtttaaaaaatatat

SEQ ID NO: 121504 - DNA, 1055 bp, Homo sapiens
ctggtgtaaacaggcagaatattagtttaataaacttttgaatatcgctatttatatatttataaattaacatcacttatttttgaatacttgcctatgaatatgaatatacatttaaatgtatatttccttgtcagatataactttcccatgattccttattttcattaaaatatatttttcatctctgctacatattgagatttatcaaataacaatgaataattacaaggcaaataatgcagagaatgaaccaaaaccatcattgtttcttgtccatattgtgggaaaaaacatattatgtcaatgttttgaattaacttctctggttgtaagcaggttgtgatttggcatgcttgttcaaaatgcactcagcatgtatcgaaattcctttaattgttatgtgaattgtttgcatatgtggttattatatgtgatttcattgtacttgtatgtacttgtatccaaatatgtttctattatgcttgattttgctggccattcttgaatgacctagcaactcaagaatcaaaagtgttttgtgctgtcttctgtaatatgtacactctctgatgttttgtcagcttttagttttattcttatccaacaacatatcttttatatttgttggaaacaaatttatgcaaagacaattttagaaagctttgctcaacacaattctttattaattaaattgaccattttgtgacattgaaaagtttaataatataaactctctcttttgcagttgacccaccttcagacttgaattttaaaattatagatgaaaatactgttcatatgtcatgggcaaaaccagttgatccaattgtgggttacagaataacggtggaccctacaacgggtaagttttgagactggggttttaggacagaagcatcatgatgatataactcaatctccacctcttctcccctttcatcatgaagaagctgtgctttaggaagcctgagggatttgatccatgtcaccagacatttgctgaactcaggtttcagatttccagtctagtgtccactattatattttaatgt

SEQ ID NO: 121505 - DNA, 1037 bp, Homo sapiens
ggtacataacacataaacaaagggcttcagaataagacatatctaggtttgagttctagttcaaatgtaattattgtgtatttgatctctgtatgttctcagcttccagttcttactaatgatagtaacaataactgcctgagatagattgtctacattaatttatatttgggattcttgctaaatcaatattatagttatcagatcgtgttgcagattatgaaaccagaaaacaaatctatctagaccctgtgtgtagtggtataaccatttgttgtgctagtcactgtggaagagagaacaacagctgctttctcctactccctatactctacaacacttgtcctctttctgcaattcatccctgcaaagcaatttccttttcccattccttggaatgcttttcttctcactgttagctggctcctttttttctggtctcagttcaaatgtaactttactcagcccttttctagcttccactgcgctattcctcctaatagatcaccctgttgatctgcagttcccactataggacagtatcaggcttatgaattatttgttgtctatctccaccaactggaatgtaagacccatgaaagggcttgctcatctatttcacagctgtattctctgagcctacaacagtgctttatacaaagtagactcatactcagtaagaaattgtgggatgggtggatgaggaagggtaaggtttaagtgaatgataaagatcctcctctgctcataatctgaacactttccatcgttttcatggctaacagctgctcttagtcttcatcacctctcatctaggttgctgcagtaagcatcttaaaggatctgcctgtttctaccgctgcccctctatggtctattttatcacaacaatcaggctagtcctctaaaacatgtaagtcattcttcattgagaaatcctatgatggctctccatgtcactcaaaagccagtccttaaaataacctacaaggccctaattgatgtggcccaccccctactaacttcctctccatcac

SEQ ID NO: 121506 - DNA, 1113 bp, Homo sapiens
attacatttgattactttaaaattatatcactctttttttttacattcactttagggaaggcttgcatattttgaactctttttttctttggcatttaatcatccttagcatttctcaggcagtcttgggttaatatggaaataacctttgtatacgttcttaatcttatttttaaaaatttttgcattttatgttgacaaatatattattgtgccacactttctatattaaaactagattaaatatattttacatatatttatttaaaatttttccagcacctatcaaaatacttttttgtgttccaattaaggtagtcttaatgcaaacttacaacttttgaactggaatattaaatttatacacttagatcttagaatttatggttaagttcttttttgttttttatttttaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttgtgaaagcaacattattgtgatgttattttagtgaaattttacttctaacagctcaaaattagtctcaacttctgtctcaacttgccgtttgaatgcatattgctttttccccctacccactccagtatatcttggaatatgctagaacccgggggtagtggaagcagattatctttggctcctggggtctatatttctttttttttttttttttctcagctatgtgagagtatgcttaaatattggatatatcccacagcttagaattaggctttagtagaatggctttgtaagatatttcagtatttgtttttttctacactccgagtgggttcaggtaggtttctctcatcaggaaccaaccaaagcaggacagttcctgggctccccag

SEQ ID NO: 121507 - DNA, 1941 bp, Homo sapiens
ttggtcagagtggtctcgaactcctgacttcaggtgatccgcccccctccccggcctcccaaagtgctgggattacaggtgtgagccaccgcgcctggcaggtttttgatgatatggcagtatattatgaaaatatttgggtttggtgtattttggttaagcactatttttgtaatatgtgtatgtcaatatgtttgcatcaaggattataaaatgctactggttctgttcaggtagagatcatgattttattttttggttagaatctatatgaattgcttcttgaatatgttatttggagactgcagaatgtaattcgaagagcagaggatggataacaaattgaaaaacctggatgctcttgcatgactttgctgctgacaaatcagatatgcttcaagtctcaatttaccttttctataatatgaacgactgaaaatagttggttttgaaggtttctttaggctctaagtctatttaataatattttcattttaggctcttcgtcagattgggcagaggacgataagcactgcttcccgcaggcattttaaaaataaagttccggagaagcaaaaactgttccaggtactgaagtattttataggagatgttacttgtaattattagattaccaaaaggtaagagttgggataaacaagtatgtgtataaattagatcatatgacaatataaacattacaaaaaaagtcaaggacatgtaccatagtgctaatagtggttgtctcttggggaaagacctggtggagcagagcaatttacctttataagtagtttgattatgagtgatttttgttttattatggtttctagcttttcctaaataaagcttaaagtgattaaaaatagttgtatcatatatacctaaaaatacaatactttattgaacagatgtactaaatagctactgtatgctggattagatgctagggatataatttagggttataaaccaaaatcccttccccacttttttaagggaaaaaaagtttcctatgactaaatctaatgtgtggcaattattggttcttttatatttaagttatattaaagttgttgagatcagtgtgtatgttttatagctttaatgtttatatattctttggaaagaccgtcattaatggatctcaaattaacggtgaaagaagaatgctgacttttaggaattcttattttaaaagtagtagtagtagagacggaataaagaaaattgtaggtcttttaaattttaatacttaaaatactttaattctagggatttaaggagctatatcattttatatgcctgttcttttgaaacttagttggaaatgagtgagacatttattattgtcttttttttttttttttaaatctaggaggatgatgaaattccactgtatctaaagggtggggtagctgatgccctcctgtatagagccaccatgattcttacagttggtggtaaggcctttggaatgtttgaaggtttatagaaaagtaatagtaatgataactgataactttattgcttttgctatgccagtattttaatgcaggcagtttgtctccagaatttgatatcttactatatctcataatgattcaagagggtgactgatacatactgtataagagcattgtgatgtcttcttttttttttgaaatggagttttgctcctgttgcccaggctggattgcaatggcgcgatctcggctcactgcaacctctgcctcccgggttcaagcgattctcctgcctcagcctcccgagtagctgggattacaggcgtgcaccaccatgcctggctaattttgtagttttagtagagacggagtttctccgtgttggtcaggctggtcttgaactcctgacctcaggtgatctgcccgccacagcctcccaaagtattgggattacaggcatgagccactgcgcctg

SEQ ID NO: 121508 - DNA, 1198 bp, Homo sapiens
aactgactgtatccgcgtaagaggagtaattcttttttgaattttatgaggcttcagagctgtatttcggccaacccagtctttgttcagtttctagcggcttcaaggttgcccagttttacgccttctcgctcaaaacagacactagttttctttgatagcctggtctcacattgacttcatctaagcttattacattcgtctcataaatcgtttgctttttccccagccttagctccagggaccagcctactgaacatcgaaaaggtcaggaacgagatcacgggactgagacggcgagccggctagagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggtgaggagcttctcatcttgcattcatgatgggggcgagggagtggagaggaggctgaggcaccacgacagaaaaccctcacctgggaggggtgccgaaggcggctaatgaagtcaccttgattcgtgtcctttttccctgaccttactttcccttccgtctattcctctcgccccaggccgttactgggtagatgtaaggagtggagaggctggggaagtgaccagagactcgtgggttagacccgtcttgggttcttagtcaccacctctaaccctgtcggtcattgatgaggttagtagctccgatctgagtaaaaccaagacccaggtggggagtgtctgacacccggaagcatcaagcagaaaggtgtttttctggtactgaaaggttttaagtttcaatggttttgagctttgcgagcttgagaaggcagtttaaaaaccaagccattcaattttgggtggaactttaggaatagtcatggctgaagtgcagtgttatttccgtcaggcgattgtgcattgtccttcacccctccatcgactttgagcatgtgaaatatttccccaaattttgataaagaaaaatgcgacaatgattattttattttttaaattatttaatgaagttttgcttcattaaaatcctcaatgtaattttagaaaatcgagagcat

SEQ ID NO: 121509 - DNA, 3212 bp, Homo sapiens
gagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagcgtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacattttttgttggttaagctgtaaggttttgttctttgtgaacatgggtattttgagggg

SEQ ID NO: 121510 - DNA, 1166 bp, Homo sapiens
tctgctccctgggttcaagcatttctcttgcctcagcttcccctgtaactgggattacaggcgcccgcaaccacgcctggctattttttttgtatttttagtagagacggggtttcaccatattggtcaggctggtcttgtattcctgacctcgtgatccgcccacttcggcctcccaagttgctgggattacaggcgtgagccactgcgcctggcctggtaattttaaattttctaatagtcatatttaaaactatgaaaagaaacaagtgaaattaattttagcaatatgttttatgtaacagtatatccaagatactgttatttcggcatataatactatataaaagttgagatacttcatattctaattttttatactaagtctttgatatctgatgtgtattgtacacttatagaacatactcatttggaccaaccacatatgaaagactcagtagccctgtgtgcctagtggctgttgtatgagacaatgcaaacagaaatggataagcaagaagctattggggatgcattattggaaggaaggaaatgcagatttaccttgcaattatagttgggttaatattaaaacatttgatcttactgcatgtcagctagcctatgggtaactgaattagaactctgttaaaggaagagaagtccatctagaattataaagttaccatagttaatccacataggaataaagaacaaatgtgaatcatatgcctactctgtcacaaccacttttggaaacaaatatcaggtccttatttctcatagagttaagcagatgctatgagttttcaagagatagttagtaatgtctttctttgcttgtgtttagatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtaaaacattactaatatcccttaaaaaattaaactaggagttttaatgaagtattttaaattttctatcttcagaatcttaaagttatgctttgaaaaacacaatttttctttcctcagcttcataccaagttaggtaaatgttctaatgtactaaaattctaaaggaaat

SEQ ID NO: 121511 - DNA, 1090 bp, Homo sapiens
tgtagtgcacacctcccagtgtctagggatagaggcggtagaacggctcaagcccaggaattaagggccagcctgggcaacatagcaagactctagtctctgggagaaaaaaaaaagaaacaagtttgaccattatccctgtgaaaagtcgatgctaactgggtgaagaccagtttgaattagagaaaattttaaattgaaggtagctcagagtaggctaatagattccttgaatattctcttttaatgtaaatagtacttttttgacgtctttaaggatagttttaaagtttacttgtggctttttgtaacataccttctctagccttatttacagttgtgccattttagattgctaagtactggtggaatttaccccactacctatcacaaattgtaaactaataaaagtccaaattacgtagcttttatgtacacatgaaataagtttatacagaatagtttttatatgaaaattttttccctctctgtttctctagggcaacgtgtttatgtattatggactgtctaatttctatcaaaaccatcgtcgttacgtgaaatctcgagatgatagtcaactaaatggagattctagtgctttgcttgtaagtaaaatgataaatatgaaaatatgatatctgtaaaataagaatatgtagtaactgttcagttagaattgttaggatgaaattaaagtgttgtcatttatagtttgtatagtgaggatttttttccccccgagatggagtctcactttgtcgcccaggctggagtgcagtggcacagtctcagctcactgcaacctccaccccccaggttcaagcaattttgcctcagtctcccgagtagctgggattacaggtgtataccaccacacccagctaatttttgtatttttagtagagatggggtttcaacatgttggccagtctgctttcaaactcctgacctcatgatctgcccacctcggcctcccacagtgctgggattacaggcatgagccaccatgcctggcctgtatcatgaggatttttagttaaaatattttttcctggaattcacacagatgcattgatgcccagactgg

SEQ ID NO: 121512 - DNA, 1941 bp, Homo sapiens
aggtgttgaaaaaacagtagctcttggtaacctaatttttttcaaaagtatataatggaaagctgaggtgactgaaaagtatttaagattgaaagatttaagaggaaaaactgatttattgatctctgttaatctagtattttaatagtttagatgttttagctatgtaaatatgcagttttgaattttgtatgtatgattttatgcataaatatatttctttgataaaaagaagagaggactttacttggaaagatcagccagtagaacaacagaggaccctttccagtttttactacctcacactgtcaaacagatgaccttaaaaacagtttttgtctgagctctaggtcatttcattggacttaattttccttttaatagcaagtcgtttcagagtgttttaggtatccactttctctaaggaagtgcttagttatatttttctcttgcagattgattataccggaacagagccttccagtccctgtaataaatgtttatctccggatgtgacaccttgcttttgtaccattaacttcacactggaaaagtcatttgaggtctgtgtttccaagtaatgtgctagaaaagccatgctttaaaaaatactgatactgtactaaatgtcttttacaaggtattttccttttatagagaagtctgtataatttactggagtttataggcttttgaggaagatcgttttgtgtgtttggctgttggattttgctgtctggtaattaaatacatttatttgaatggtttagttagtactttgtagacaaaatttaagatattgtattttatcctttcaacagataatgttatgactgtacgaatcaattttttatcaagttttatatacttgtatttttaaaattattgctcaaattgttgtgcatacttacgatactaaagcaagctttactttagaaaataaataattctcccattacttaattgaattatttttatgacatatgaagcattataaaaaatgcaaacacttattaaaaccttactgatcatttatgtttttataagtagttagaaatccatctgtttgcatttacactgccattctgaatacatgctaacggacataaagattcagaataggcatgtaaagaccactctgtattctcctgtgcctgaaaattgagcttaaaataattattcttaagggagcaaaactgcgttaatacatgccaactttttagattttctgaacttaagattttctaaaggtagtgatgactttaatagtccctaatagttggttgccatctagtggttatagatgctcttgcactgacataaaggacaggatcatgctgcttttgaataatacatgaaaacaaattttgtagaagacaaatgtaattatttaactttgtttcagcagaaacagaatatacatttaaagtatctttacaagtccatgatttttcagtgtgatgggcagacaataaagatacaataaattctgcttttgtcagaacaggcagaattgaagaaacgagagactagtagtgatatagaagctctattaattttctctcccattcaaaaaacacttcagaacttgttttttgcaaaggcagtcaacctcaaattcattctcttgtggactctgtgtttcttcacaagctcaaactttgaattggactaaactcttcagggaacttcaagtaggttattttatctcagtgttcattcaaataatctctttttcagtttacaaattgaatttactgtactgaatctcgaggtaatatttccttttaaaaaagaatattcattttctcaatttctgtgatgtaattttgatattccctctcttccacaagaaggtttccatgtaaacattttctttatatagaatgggaaaatttgcatggtttgacatttgaaagtcaagcattaaataaatgatag

SEQ ID NO: 121513 - DNA, 1932 bp, Homo sapiens
agggggcgcgggtggattgagctacgagccagagttggtgggcgtcctttgagagtgcgcgctgaagtctttgacatttaaaaaattttggggtggtggcctaaggatgagagcagccagcattcacatcttgtctggtgttcatgaaaagtttcaaattgctaaggttgggtgcaactggggaccaatctaagtagggaggggacagacagtttcattgaggtgtgttttataccctctggtctgtttctcagagtttcaggcttgcttttgcagccagccttcagattaggcctggccttgtctgatattctttcggaatgtgtttttataaaaatattctgtaaaataatttatctggaaaaagagtaaggtttacagtgtcaattttggggccgtaactaaagcttattgacacaatttgagttttactcactcgtgagggaaagttaaacatttgctgtaagtagactaagccagcctcaagaaaagctgtatgtttttgttggggaaggtggtaatggggaacaatattgatttttttggcctatgaatatataaggacccccaaaatagagctaaatgttattgtaattgtagcccaagaagtgtttatattacttaatttgactatgggttcagtgtttacactttgtttagcaaaatgagtctctgctgctcagagactcattcttcttgttaaaaagaattaactactctttggataattttgcaaagatgattttcattgcaatatgtcataagctttacttcaaaaaataacttcttttagtatgtttcggaaagattactgaatcaagaaagtacaatttaacttaaaattaagaaaatccctaaacaggttctataggagggtgttgaggaatgggaatgctttggtactgctttgttaacagcacctcgaacagtgcctggaacacagtaggtactcagtgttagtctagtgaaagaatagtgaataatagaggtaatttttcttaattcttcttacttgagtatagtaaagtgaaaaaaaagtcttaccgtacaagccagcctttatctaaaagtgatgagaactttacaggagatttcctagtaagagtaagaaaagcttctgagtttttctgggttcgtttcgtattacctccattccagtttgcggaatgggtacctgtcgaggctgagagggtgcagcttgtgttacaggtagtgctatgtgtgttgtttttgttttgaaattggaaacaaaagatggcttactcgtgcttattatcttcagtatgcagatgattatacttttgtgctatcctagatttccagcttctataggcccgattgagttaaaattctaattggatgaacatagggaggattaaaacaagcacaaataaagccacagatgtagagttaatgtgagtttcaaactactacttttactttattctaatctaagggtctttgaatgtataggtatgataaattcgagtttcaccatgtcttaagcatttttataaagcaagcaaacggtaacttctttagagcataagcataagggttctgggcacggtggcggcacgcccttaatcacacacagcattttggagggccgaggcaggcggatcacttgaggccaggaattggtgaccagcctggccaacatggcgaaaccccactctactaaaaatacaaaaattagccgtgtgtggttggcgcgcgcctgtagtcccagctactgcggaggctgaggcaggagaatcgcttggaaacgggaggcagaggttgcagtgatagcgccactgcactccagccagggcaactgagcgagattctgtctccaaaaaaaaaaagcataaggaaaaggaacaattttagttcctcataaccaattttcatatgctatattgaatctttccaaataaatgatattta

SEQ ID NO: 121514 - DNA, 1163 bp, Homo sapiens
gagaggcagtgctttctaggtagagagagtaaaataggggagcatggcatgtttggggaacttaagggaggacaataatggtgtcagataggagagcggtgcaagatgatactggaggtgacatcacatttatttcaaacaaggtcaatagccgggcatggtggctcacgcctgtaatcccagcattttgggaggccaagttgagaggattgcttgagcccaggagttggagaccagcctgagcaacatagtgagcccgtgtctgtacaaaaacataaaaaaatgatatgggaggattcttgagcccaggagggcgaggctgcagtgagccatgatcgtaccactgcattcccacctgggagtacagagcgagaccctgccacccaaaaaaaaaaaggtcatcagctgctacatggagagagcttcagagaggggcagcagattatccagttaggagatgattggaatagaggacaaaggtgattgatggtggctagcttgttcctataaactttcttttgatattctaccttttctttttttcactctgggggctctaacaagcctacctactctcttatacatttcttcatttttgtactgcacttgttcatatctagttttcttttccttttttttttaaccaagtgaattccttctcctatattttctcccgtttttcctgaagtaacttttttctgccttcctttctaatatacatatactactactttagtttgttttccttttcatttcagcctgtcttcctttatggaccttgtctactaggttgaaaagagtgatgctaaactgttgcatgcaatgttgttctctacagataccagcaaaaatgcttctgtctccaaatgaaaagtgttttccatttcgccttagccagtcttttatgttatatataaactcattgcagaacccaatcagtttgccagttttactggagaccgtaaatacctaacactgtctgttgaactagagcacagcttctcccaaacgattggcattccatggaatatgaacagggtttctagtttctgcctacttaggggaatacacctctttttcttttgattgcattacttttggaaactacatcatggtgtcattccttatttactccttacttaagtatgtttatttcctgattt

SEQ ID NO: 121515 - DNA, 1188 bp, Homo sapiens
ttttcatgggaggatattttaattatgggtttttcatggccttgtaagttgtgaaaattctggctacaaaccctagttaattgtcatctcttatgattagggatttcctgtcttagttcattcgggctgctgtattgaagtccatagactgagtggcctttaaacctcacatttctcagaattctggaagctgggaagttagatcaagaggtccagattcagtatctggtaaggtcccactttttcacaaatggtgccttctggctgtctcctcacagaatggaaggggcaaacaggctccattgggcctctttgataagggcaccaatcccattcgtgagagctgtgccctcgtgatctaatcagctcacacaggccccacctcttaataccatctgtatcttggggttaggatttcatcatataaatttgagaacattcagaccatagcactgaccatggggtggatgtactttatttgtctttagttcaactcagaaagccagagccaagcttaagacatcagaattatccccactgcctcttcagtgagttttttgttctgttttgtttttccctagttcaccaagtcagagcgttgcccttcagcttgtctggttttcagtctgacatctcattttgctggggccttgaggttaacctaataaagcctgggttctaggacatcaggtttttggtcatagggtaccaagagagaaatgccatctttggaatttcatttagctctctgggttcccactttctaattgttaatggcttcaaggggtttcagccatgcacttataaaattttttaaaattcataatgagcacatttagtgttctgatctagagtttttcaggttgtcaagttttaaccacattgccaaaaccgaaaacgttgtttgtttttcttctgttaaaaggcaggtatcgttgagtttaagggagagtctagcagtctggatatagttctcatgaagaaggcaagcaaactatttataggtacttatttctagaatcagtgatcaaagatgagatttagggctgattttatatatattcatacatattcatgtgccctccgtttttattatagctttctaatctgagcttctttgtgtagcaagcacatgtatggatgattatgaattagtaaaaacagattttaatgtcttctttttctctt

SEQ ID NO: 121516 - DNA, 1057 bp, Homo sapiens
ggagatacagataaagagtaaggatttttttttccctcagatgttttataagaataaaacttctcattagaaaaacaatttctattgtatggaaatatttttaggagtatggtattcttaagaaaacatataactctttcacagtcgctttaaggaaagaaaaagcaattccttattgataaataattttactgttattttctccatcttttgaaatgtataaatatatgcttgtagtacatgtaaccttacaattaaaaattgactgtacaatggaaggcttcaaaataaggaaattgttttttgttttttaaaaaggcattctgttcaggcagcaatttggaaatccaccatttatcatgagtaagtgaacccagataagacccttgcattttgtatgaaagtttaaatactacagtatctttcttccccagttgtgaccaccacccctaccacatccatcttaggtcagattctcaccagagaaagcagaaccattataaatgataaacacaggtgtttacccagacagaagttaagcaaagtgttcattacactttgttaatctacttggaatgactgttgtgtaaaaattttaaatgatagttttaatagaactttttgtttgtcatgagatttgtttttaaagttcaacatctagttttttggccgggcacagtggctcatgcctgtaatcccaacactttggaaggccgaggcaggtggttcatttgaggtcaggagttcaagatcagcttggccaacatggtgagacctcatctctactaaaaatacaaaagattagctggatgtggtggcatacacctgtaatcccagctactcaggaggctgaggcaggagaatcacttgaacccgggaggtagaggttgcagtgaacccagatcatgccattgcactccagcctgggcgacagagtaagactccgtctcaacaaaacaaaaacaaacaaaaaaacattgtttttagttttttgatttattgatctggttttctgctggccaaaataaacaacaaattcagagatccacaaatatac

SEQ ID NO: 121517 - DNA, 1072 bp, Homo sapiens
gttgatattttcaagagtggtagaagtataactattttaccatggtaataccactggaattactttcttttcattagctaaggctttctttcctttcagttcatttctttgtttctctatctttctacccttaattttcaatctaagacaaaaaggaaaaatgaatgagaatatataaaatccataactaaataaacagaattatgtgttcatttattgtagggttcaacaaactatgatccatgggctaatcttgcgtgccacctaattcagttaataatttttattggaacatagccacatgtattgtttatggctgttttcatacaacatatgagtagctgctacagagaccatatggcctgcaaagactgtggtttggccctttacagaaaaagtttgctgattccctgaattaggtgaacatagaggataaaacctcagaatttaatataaggattgtgattgctacttatgtttttttccccttattttctgtgtagtgggacaaatctgctcagtgtggatgaagatgaggattctgaaacctcaaaaggaaaaaaggcaagtgttgcttaaaatattttcttcttttacattatatacaaaaaaattgttacctcaaaagatttaatatttttaaattataaaccccagttacccactttctccactccagaggcaaatggtgttcccagtttgttatttatcactttgggaatgtttcatgcattataaagaagagaaatatttccacctcccatgttacacaattggtaatatactgtgcatggtttttctgatcttcctttaacttaatatattatcttggagaccatctgtaagagttcataaaaagcacctcattgttttcagtgagtgcatagtattccattgtattatataccattaaccaattccacctattgatggatatttacagagttgtcaactttttaatttttttctaaaataatctgtaaattagccttctatatgggttattttgcacacatacaagcgtatctgtagaatgaattcctagaggttgcactgctttatcaggacaggt

SEQ ID NO: 121518 - DNA, 1095 bp, Homo sapiens
ttgcatctattgaagtataaagtatcaatttctgcctgtacagaaactttgatactaaggcaaaagttcttatacataagcacaagttgaaatgacagccgattgccatatttggctgtagtgttctccagatagcagcaaggcctgataagcaggggaaatgcttactttttactctctggagaaagctatcctaagatcctctaccctaattgtctcaaatatctttggaaagattcacatgaaaagaaagtaatacaataaacctccatgttcctacaaatttgcattgtctttaggaaaaaaaaagtaggcagttgaattattcttaaatccatgccaatgctatccaccatcattcccaatagctgtatgtttttactacttttaaatggttttcaaatagttgttgatagattgtcacattatagcatttttgactcatatttctggatctttttttacagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgaggtataggcacttcaccacacattcctacagaaaagataaaggaagagtttgacaccaaaaacttagaagctaataggcccaacctgtaccttttcttctgaatttgtctatagggccaagaggtagcatggtcccagtatgtggattctttgctttgaatcttaggagtaggattgattgcagtgtctcttgtttctgaataaaacattgcaagaaatactttgttagggtgggatatcatgattttgctttcatacatttagtagaatctcagtcataatatttgaagaagcacaatagagtggtgtggtcatgtctcctttaggaaatactaatcaggattgtctcaataggggacttaaaaatttcttattcctcctttttacaatagtgaaccaccattattggtaggattgggtatcagtagcaactcagaaatagggttgaaagtcacttttatttctgctgtctcaatttataca

SEQ ID NO: 121519 - DNA, 1673 bp, Homo sapiens
gtggcaaaatcagaaatagtatttaggactcctgatttttattttagtattctgctttattttttaaattttctcaacctccgcctcccgggttcaagtgattctcctgcttcatcctcccgagtagctgggattacaggtgcccaccaccatgcccagctaatttttatatttgttattagagacggggttacagcatgttggctgggctggtctcgatctcctgacctcaggtgatctgctatttttaaatttttctttaattggattggaaacatttgaaagacaaattcaggaaatggaaaactcccaaaagacaattgggtttatccataaattttttgttgttgttggtaaaggtttttgtgtgtttgttcagattttaaaagattttttttataaatgtgtatataatttttccgtgttcaagttattttttgtttcttgaatctgcagtgaaaatacgcaaaatacgtcattatgttctggaactgtagttcatggtagacgttttcatcatgctcatgcacagataccagtagtaaaaacagcagcccaaaggtaagaattctaattgtctttggttagtatatacatggcatcttcttcaataggttttcactttttttaaccatttttttcctttgtgaaaccttactgttttcactgtctgtagagagatatatctctgaaataattcatgacatgaaattatactattttatatctgcttttgagtaatcagattctgtaaatagagaatttttcactaagacctgttgtattgcattataatccagagaatctaagatgatactgaaactgatttacaatattgacctgaaagtgtttgactgagatatcttcagttggtagtttagctctgaagagtaaaattacagttaataccgtactttctttataaggcttataagagttcatagcatcaaaacaagtcacattagttttaaatgttggagaaaatgttattttgtagttgtagttagatttaggagttctcattgatcttgaaagtactgcttgagtcaaaataatgaaagtaacatttagggaaccatttttggaatgttacatgacctttcagttgactgaaattcttaggctacaagagttaaataaataatttgtttattgcattataaacagttccttataactagtaacattttaagatttggcatatattttagatactgttcttcattttttaaaaatgtaatatctagactgctcgtcatttagaagacacgtcctgaaccttgctatatttttctgtttacatagatgggctatcagatcttttacttaaaaatgttaagtaacctcatactttatgataaaccaaccttttgtttttgccttaaatgtattattgtatcaaatagtgttcacctgagatgcttgagaaacttaaaaggacaaattactgtgcagaccaaaaattggcttactctactgcaaagtatacaagctctctggcctacatatggcaaaaacatgagaataaacaataaaaggagagtaattaggggagagaaaaagagtagacacattcttatgccctgatcatactaatagaaaccattgctgataaagctgacttaatattctgataatgtagtctaagtttgaaatactaacttaaaccttat

SEQ ID NO: 121520 - DNA, 1031 bp, Homo sapiens
cgttaatagtctggaaattgggttgcgatttgttttactctaggtctcaacacctataacattttgcatgtgtattattgctcatttacataaaagattagattcagttcatatgaactagtttatactggtaaaatgtttctttaaaaacaacaacctgagttaatttgtatttaagaaataatcctaattgaaaaattcttaatgattaggggcagcaaagaaaactgtataatcaagtcagcaggacagattctacttacatttgtcttttatttattctgtataagaataagcatttcttattccaactgcagcatgactgtcactaaaaagattttgatgttcaaagacaagtcattgagagttcttcggttttcttccttcaaaaacattgaatgattttatgctacataccaggcatagatgaggtgcataaagatgaatatgataaaatctctaccagtaaagctcaagtttgattgcagtagagattgattagggtacagaaagacaagtaaacaaatgattacatgcatggttagggcagcagtagagctatacaaaatacgtgtagtaaaaactacagagaagggaacaagaatttataaaggaaacattaaaggagtttttgagtttaccaggtagaagaagaaactgcatgcagtaggaatcacgtcttcaaaggcacaaagaaaggctttaactaagattgttgcttccagggatttagcacaattgttagacttcaggtgagggtaaacacattggcttttacagcttctcctaaattttcttattttctgaagtcttaattttttttttttttttaattatagagatagggttttgctctgttgcccaggctgtagtgtagtgtctcagtcatagctcactgcagcctcaaacttctggtctcaagcaatccttccacttcagcctcctgagtaactaggactgcaggcatgcaccaccgcaccaggctaactttaaaaaaattttttttgtagagacgtggtctcactttgtta

SEQ ID NO: 121521 - DNA, 2170 bp, Homo sapiens
ggctgaaattacaggcgtgtgccaccatgcccagctaatatttgtgtgtgtgtgtttttagtagagatgcggtgtcactatgttggtcaggctggtctcgaactctttacctcaaatagtccacccaccttggcctcccaaagtgctgggattacaggcttgtgccaccacacctgtcccattttgagagaatttttgaagttgtaaatgaggtcattgataccagaatttatctattagtctttttcccttttcttttgttttttttttttttaattttaaggccacagttatagtactaattgaaggtaatttttcttttctatattgtatgaaatagtccaacaagaatgtaagttgacatttttacaaagtcctacattactaataatgacttttccccggttttatgttttattttaacatgaaagcaactctagggcaggacttgataaaaacacatattgaaggtacctgtaagaataccatgacttgttaatcagatacattataatgaatgcattttttctcaaggataagaaaaatgagcattgatgtgtctttgtgtgtgtagtgtgtgtgtgtgtgtgtgtgtgtgtgtgtgtgtgtatatatatatatatatatatatatatatatattttttttttttttttttttttttttttaactgttttccttttcctaactcccttggcttattgggaagtattatacctaacccgtttcttctacctctgtttttctacctatttcctttcctctgtacaggtgagtataaaaaacaacagaggccggacatggttgacttagacctgtaatcccagcactttgggagggcaaaataggaggatagcctgagcccaggagttcgagaccagccttaccaacatggcgaaatcttgtctccataaaaaatacaaacattagccaggcatagtggtgcacacttgtagtcccagctgctcaaggtgggagaatcacctgagcctagggagatcaaggctacagtgagctgtggttgtgccactgcactccagcctgggtgacagagccagaccctgtcatctcaaaaacaaaaacaagagagtactaaactgttcttattttttgggcacagcagtatagaattggaagtggctacattaggtattaatgcctaactgttggttttcattttgctttttctggaaatgcagctatataagaaataaatacataggataggacagactagatttaaacttttatgtttatattttgcttcgcttctttaatagggatgtgattatattcccttgtttttctgtcatttatctaacctatgtgttttttagtagcaaagataaaatttcagatatattaatgtacatttataatattcttttccttttgaaaattttttttaaatttgtatatttttaatgtgttcatgtaaaaacaagttactatattttttttcttcatttgctaggattaaattggtattttagttgcatactccacatgataggagtataagaattgatataggaatttggggattttgtaaattatgctttgcttacagttagttccaaatatttcattccttttataataaggataaataatattagacatgaatctcattttattctaaattgagggcttatataatttcattctcgagtaattgatgttaatagctttttggagttttcatgaactatggagaagggtggaacttttatacattggacttgtgataagaagccaagattttaaattataggcttttccttgtgtcccaaatcatataccatatttaatctaagacttttgtgcaaaaatttcagccttaaaaaattttttttcttactccaaaggaaataatcatacctgatattaggatcagtctggaaccagtaaaaattttataacttctaggaaatgctattgtttcttgaagactatttctgtaacaacagtagtctcctccttatttgtggtttgatttaaccattcccttattagtagatactgaagttgtttctgaatttgctatgataacattattgaatttttcagatattgagaattatgtccaggtgagggaagtacatactatttataaaagtacaaaggaggtaccatggcattaaacatgaaaggacaagctaactcttct

SEQ ID NO: 121522 - DNA, 1397 bp, Homo sapiens
tggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatattatatatatataatgtatttaaaacaagttgatcacagtataattttgccttaatgactatagttactgcaactacagtgatatatcaacaatgaggtcttgcctcttatattttttttctttttcatgttttaagcagtctggaccgaaaagaaaggtaagcttaatattgaagaaattagagcatggatatagtggtaaaatataaaattatttatatgttttgaaaaatattggttgaattagagtttataattaaagctttttttaattttaaagttttagttgacatgtaataattgtacatatttataggatacagagtaatatatcaatacaggtatacaatgtgtatgatcagatcagggtaattagtatatccatcacctcaaacattttttgttcctttgtgttgtcagcattcaaagtccctttttctggctttttgaaaacataaaataaattatagttaaccatattcaccctatagtgccacagaaagtgagaactcattcttcctgtctagctgtaattttgtatttgtgaacccacctccctccatcctctcctcccctacccttcccagcctacagtatccacagttctactctctataataaaaggaaacttgttgacagtacaacatggtatttggcttatataggtggtatttgaggctcattctgaatgtacatttttctataatggttatatatatttatgctaataagtgactcctttcttttaaaatagaatatttcagtgctttagtagtaaaattgctttcagttacatcatcaaaatctttatcattatattttagtgataatacccttgtttttatgctttaatagactgggggagggagagggaaatgtattaaacaccttaagcttagagttaaaactttaaacatcaagtgtattctcttctgactgaaaggtttgtaagagaattttgtgatcagtcttctatcattatttgttctctttgtaagaacactggcagacacatgttgttcttttagaggatatttgaatggtataaatggcatggaaaagtgtttaagaaaacacacacatttctttgaacatttcaaagtaaaatgatcataattgttctaaagtgggtatccataagagtagctggactgggcaaggtggct

SEQ ID NO: 121523 - DNA, 1002 bp, Homo sapiens
agatcaccagtgtgaatagaattacaaataaatagcctcttttatttttatgtggtttatttagagtaggaaagtagctattgtagctccctggtctgttgcactttttgtagttccccttctgtgatgcgcttttatacaattagctataaggtttttgctttttttccccccaaattttgcttttttcccccaaaattagtgttgtgtttaaatagatacagtatttggatgtagtatttagatatagtacttagttactaaggattatgtttaaaatccttgatattgtgtgtatttgaagtttaagagaggaatttaatactttacaacaaacatactttatagcccctgacataatgtaatcatactacaagactaaatacttgttccacgattgctgatcttgtacgtaacgttttttgttctgattttggaattgtcctcaagacaatctcattcaacatttattcctttatttattaatttgtttttaaacaactaaaaaatacagtaaaattttacaaattgagtttcatttattggtatagttttgttattttatagtatcactttttatatggcaaagaagctatgatttgcttttaataggcttattgtaagtatgccattaactttttcattttgaaaactgtatttcctgttagaataaaactacataaatttcttttttaggaaagaatacccacctcatgtccaaaaagttgaaattaatcctgtaaggttaagtcggctccaaggtgttggtaagtgtgcagttttgttacacctgtgaaggatttcaaattgctgtatgaaaagtacaatggagatacgatgctggctttagaatattcccaggtataatagatatatatgtagaaaaccatttttttgtaactgatttgagaatttcttcaatggtaacctgatacctggaacagttgcacagttaggtgattacagtttgaaatcttttgattattttagcatttttgctat

SEQ ID NO: 121524 - DNA, 1679 bp, Homo sapiens
aatcatggtgagtaagtatttatattcatattgaaatatttttcaatatactggttattaatccaaaaaataaaataagggcaaataacatttataaaaaatatatcatcataaaatcagttttcattatctggaataatgattcttaatgtgtgtccatcttgtttttctgaggcctttgtttgtttaaatagctctgatggctcttacttccaaaatagaataatttttaaaagctaggtttttctgatagcttagaatgtgcttttaaaaaacacccacatttttttttctactttgggtgaaaatcttttgtgcatgtattgaacatttctctatttcataaagagaatattccaaacatttcatcctttcttaataatgaacagtctttatagatgtgaattattatactttacatactaagcatagttaagcttactaagtttattaagtttagtaatagtgactactctcttcagcatttattctgttataccttaaatgtttattgagctcttactctgctatatgcttagtccagtgctttgcattcattatttacttttatcctagctttctgttgaagatccctataagctaaaaaacttcctcaaggacatagggctagtaaatgacagagctggtattggaacccatgtctgtttgatgccaaatcccactcttaaacactgtacattactatattcttgctctgtcacaaagaaggttactactaatcctcagaactgtacaaaaggtattatttttattttaacaaatgcatttctggcctggtatggtggctcacacctataatcccagcactttacgatgtcgatgcaggcaatcacctgaggtcaggaattcgagaccagcctggccaacatggcaaaaccccatcgctactggaaaaaaaaaaaatacaaaaattagctgggcatgatggcacatacctataatcccagctactcggaaggctgagacacaagaatcgcttgaacccaggaggcagaggttgcagtgagccgagatcgcatcactacgctccagcctgggtgacagagtgagacttggtctcaaaagtgaaaaaaaaagcatttcaaagatgttaagtgatttggcccactaataatggttttagatgcctatcagccaggcttgttaccaataatttttaaagtttattcaacagcattcattaagtaaataagcatattcaagttaagagaaaaaagagcatgcttatttactgttcttttaacttgggttttgtttgtttgtttgttgttgttgttttttgagatggggtctcactctgtagcccaggctggaaggcagtggtgtgatctcagctcattgcaacctccgcctcccgggttcaaataattctctgcctcagcctcccgagtagctgggattacaggcgcctgccaccaagcccagctaatttttgtattgttaatagagacgaagtttcaccatgttggccagactggtctcaaactcctgacctcgtgatccacccacctcggcctcccaaagtgctgggattacacgcgtcagccaccgcgcctggcccttaacctattattttgaaataattttagacttagagaaaatttgcaaatttaatacagagacatacgtttattttttcacacagcttcccttaatgt

SEQ ID NO: 121525 - DNA, 1002 bp, Homo sapiens
acatgtatgcttgggtgtaggataaatagcaatgctataataatactgtatatattgttatatgaagattgcattttatttcaagatttcctttggagataacttttaaaacattgagatttcaaaccacaagatcactaattacttgcataacacttagcataattttctcctaaacgatatcatggtctttctatagttaacactcaaggtgattttctttattgttctctttgccttctttattttgaatttgaggcacttagtatatttttttataagttatagccacatatcagtacttaccagcatgataagcagttctttactataaaattaaagtttgtaaaccattaagtgtaatttttggtcagaccacaagtcctgttgcttttttatttagttgctttaaaaattttttctaaacatacagaataacaaccgttaagatctcatttttctctccacctactctctcatttgtttcttaaactcccttttttttcagcctgttttttgtatccttgttagagagaacagacatatattgtccctgaatgtacatttaattatattcttcatgtaattacattatgtaattacaactcaatcacctaatttagcactgcttaacacatgttaacttttgctttttgttcgtttttgagacagggtcttgctctattacccaggcttggagtacagtgacatgattatggctcactgcagcctcgacctcctagtcttacatcattctcccacctccaccaagtagctgggactgcaggcgcatgctgccacatccagctaattttttgtattttttatagagataaggtttcaccgtgttgcccagtttgctgtcaggcttctgggctccagcgatctgctcgcctcagcctcccaaagtgctgggattacaggtttgggccactgctctggccacatattaactttcaaccagtcatggtagctgttgttaatattttaatatataactct

SEQ ID NO: 121526 - DNA, 1067 bp, Homo sapiens
taggtagggatcagaattttaatgtcatttttctctacctattatcaattaaaattttgaattatatcaaagctttggacatttgtttccctctttgttatgatggtagagaaaatgtgacatagacatgatgttataggtatggtgaagagaagagtgtgattacataatcaggatgaaatgatattgtttttttaaatgtcagtctccaggatgcagcagaaaactaattagatacatgtttgagcaaaataatgtgcaaagatactgtgtggcttaaaaagattaatgaagtatgtttataaggaaaaagctttcctttgggtacattatcaaatttagtaaggccaaaaaagcttgtaggggcttatgttttaagactgctttactgtaaattaagtttttcaaataattggttgtgtgtttcagacaactgtgtttattttccgaattccaaaatgtctgccttctttttatagtgtcacatcatagctcttcaacaaagtaacttagccttcataaaaataatacctggatgctctggactggagcagctgctctgtaacctcagattttagatctcgggagaaaaaaagcactttttagttactctctggccagaggctaagtccttaattgttctatatctgtgtatgaatcattatctctgtgtcacaaaggtaatgccattttcagagatgacatagtgacaatgtctcttcctccgacccctgtaatttcatttttttatgtgtcatatagttttatgtttctcatgtaattcattaatccaggaaacatttattaagcccttgtgtagtttctagatgctgggaaaacacatgactaaaacgtaatttctgctcttcccagagctggcaatacaatgggggaacagaagtacaaataacaataaaatgagagctgtgaaaactctagggattaattgtgcctagagtggggcagaggcagcttcttaacaaagaagagtttgaattcaccacataggcagagcttcacttgtgaaaagaacagcatatgtgagggtaaaagagagaacacatgaa

SEQ ID NO: 121527 - DNA, 1146 bp, Homo sapiens
ccagcctgggcaacatagggagaccctgtctctacaaataataaaaaaattagctgagtgtggtggcacgtacctgtagtcacagctagtttggaggctgaggtgagaagatcacttgagctaaggtgtttgagattagagtgagctatgagcatgccactgaactccggcctaggtgacagaatgagaccttgtctccccaaaaaaaaaaaaaaaaaaaaaaaaaaggggaattgtgagtatgtgagtggttaggcacaggaagggcttctgttaccttagtagaacaaaataaagtgaagaggatattgatacacttgatgaagtggtccatatgtggagatcctgctgaggagtgaaaaataaataagagaagagtaatccaggatataattattggtttagtcttatgttctgattatttttttgctgaaacactagcttattttaactaaaacttaaagtttatttttttctccttcctttagaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggtaagtagagaaattattctttgttgctaatcagattgtgttttgattaatattagtttcagtacttattaaattctaggtgatcttttatcataggaccagaagagacttggaaaacttatttaggcagctttttctgccttcagtagaccatttttatgcttgttcaaaatatagaatttatttttctgtaaagaatttatcagtgcttccctgcaacatacttcaaatgattgctctctgccagaatttttttcaaataattttaagaagccaaaaagttacaaaaaatagtagaagaaaatctatatatttatctcccagattccttgttgttcacatttgctttattgtcctcactctctatgcctttttccctccttcctcctgcctacccataaacgtgtgtatatgtatttttttgtactatttgagttgaagttgcaagcatgatgcccatttaccatttaatatttaagtatgtgtgtttttggttttttataatcagaata

SEQ ID NO: 121528 - DNA, 1170 bp, Homo sapiens
gctgatggaaggcatatggtaatagctcagaacatacttctgttcatattttaatattggggattttaatagtaggaatgtgttttttctgttttagtatcaattttatgagaggaaacagcacttttccatggaattcttttcatttagatttgccctctttacctttattatagatactaaagtaatggagccagtcagtactcagcttgatcatatcctcagattcttggagacagaattattttatatatagctgactgctagactagatagtcttgaaaatttcttccagcattttgatattaaatcccgactaacattacttatttaggctctcatggtagccatgatggtaatgatggggaagagagggacttaattttgagactttgaggggattccttaatgatgcagtaaaatgccaaaatcttttatttcttttgttcttttggaacttaaagtttatgaacaccgtgaatgttcaaaatgtggaaaggaaaaagaaaatcagaccaaatgccaaagttgtggtgttcttttttctaaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaagtaagtattttactccctttaatattgcttatatcaatccagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtgggtttttttttttgtgggggggggggtgcctaaa

SEQ ID NO: 121529 - DNA, 1553 bp, Homo sapiens
ctcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataagagtgtatactgtggagaatgaacataatttcttctaaaaaatagaaattgggcacagtggtgtcccaactactcaggagactgagatgagagaattgcttgagtccaggagttgaagtgtagccagggcaatatagtaggaccctgttgctaaaaaaaaaaaacaataataataattataaacagaacactaggctttccttttaatatatacttgtgtagtttttcattaaaaatatagttcatgggcctttttaaaaaatctatatacatgtacacacatacgtctgtatgtatatatatatacatctatatatgtcaggtactgtgctaagcattttacataccatttgttcttgcaacgattctgtgaaatagatacccttattgtccctaattctacagagaagagaaattgagccaaataaccagtaagtggcaaaaccccacctctcaaatgctatatatgtaaatctgtttagatcgtctaatctggcctgttaggttttctgctaataaaagaccagtgttgaaagagaaaccatgctcaatatttgttcctgagactggacagtaaaattaaaaagacaggtagagaaatactgagatgatacttctctgggacatgtacattactcagtaaaaattaagcatttatgtttgaaatactaataaagtcaacgcatgacttttgaatgctttttctgtgtcaggctgtttcaggcctggggatatagcagtgaataagacactgtccctgttctcttatagtttatgtgtagcagggagaaacagataaacaagtgaacatccgcaacaaggaacaacagaaaatttaaatcagttaatttgactgtgtgtgtgcttactttattgggttatcaaagtgatatttaggctgggcgcattgggtcatgcctgtaatcccagcactttgggaggctgaggcgggcggatcacgaggtcaggagatcaagaccatcctggttaacacggtgaaaccccgtctctactaaaaatataaaaaattagccgggcatggtggtgggtgcctgtagtcccagctactcgggaggctgaggcaggagaatggcatcaacccaggaggtggagcttgcagtgagccaagatcgcgccactgcgctccagcctgggtgacagagtgagactccgtctcaaaaaaaaaaaaaaaagtgatatttaaactaatacttggtggccaaaatgcataatattgagggaagtagaattcaggcaggagcaagcttgtggtgtttcagggacagaaatactggctagtgtgcctggaggataaagagacaaaaacagaatattatgagaaaattggataaataggcaggggccagattatg

SEQ ID NO: 121530 - DNA, 1187 bp, Homo sapiens
tataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaactttttatcagatagagtggattgtatcttcattcatttttattaattttagatctggaggaggtccaaagcaaatttaggatattttccactttggtaatttatttgcatttttaatggacagaaatgaaatataaaattataactatagttttaatataaattataaattattaaaatacttttagtcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccaggtacttttcacttttgttgacatttgttcagattaatgcctccattttggggtgtaaattttttttagaaggcagtttggtagtgccaagaaaaaatgatggattattaagtggggcttaaataccacatgggagattatttggaagaacattaagccatatacaaaaataagtttcaattaaacttaaggcttgaagtataaaaaattcaacaagaaaacacagtatcaaccttaaaataaaatgtcagtatgtacaaaaatttcttataaaatctagcagaggagagaagtcattttgacagagatatattttactgtaatactatgtttcattatgttttatattttactataaaaatttcaaaaagttcacatggaaaaaggtaatatgaacgatgtcaatagacagtgtatctaggacaactatttgtaatgcagatgacatagtatttta

SEQ ID NO: 121531 - DNA, 1355 bp, Homo sapiens
tttacaagatcagattttttttttttaagaaggaatttcgatcttgttgcccaggctggagtgcggtggtgcgttctcagctcactgcaacgtccacctcccaggtttaagcagttctcctgcctcagcctcctgagtagcctcctgagtagccgggattacaggcacctgccaccacacccagctaattttttgtacttttagtagagacgaggtttcactgtgttgggcaggctagtctcgaactcctgacctcagatgatccgcccatctcggcctcccaaagtgctgggagtacaggtgtgagccactgctcccggccaagatcacatctttaaaaggtggtgtggctgtttgaatccaggcagtctgattcccagagtactattcctgaatgccatactattactcaaatttaaataacaaccaaagtatagctaaataagatacaaggatttactgttatataaaaaccatgaattttaattttatctaacactgttgaagggaaatccattttatgttgtgatatttacatttcttatattgggtctttgcatatgtttatacttagcttgcagccttattttagtaaattattaagtgaacattttcttttcctttttagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattgtaagtacatcttaagctctttactataccaattataacattaaaaattccgttgctaaagctaatatataatatttaaaatttataagttaaaatatttaatagaatatcagttagttcaagatttcacattgctttaagagtatataaatagtagctccttgccattaaaatgagttagaaaaccttccaatatgttattgtttattatcatgccagcttcgtgcatgaaactttcaatgagttagaaaaccttccaatatgttagttttagtatcatcccagctaagtgcatgaaaagaatatattaaagaactgtagtgagtgaatgaagattccagaagttttggggtttgctggaaaatgtattatagcatcaagactcctagaaatagattattgtactataatggctgcccaaaggactttgtgtactttatcttacccatcatacctgtgtacttactattctgccaccaatccaagtttttattttctatttgaaattttaatataatctccttaactagccttcttagtcattatttttttctctaat

SEQ ID NO: 121532 - DNA, 1099 bp, Homo sapiens
aaagtgaagcctgcctttctttgtaagtctagagcaatactaattcatctttttttttagttttgtttagattttatcaagatacagctagacggtaagctattttatgtctttttacttaccaaagctttctttacaccaaagcactttacaggaataaaagattaaataatattcatagaatttattaagatggttagttgttacatatatcttcttatcaaagggcatatatcttggtgtaatttcattcagaaatatcacagaacctaactttttagaaaccccttttcatttggaaaaaataaaaaagtttctttaaggcagttataaagattttttttattacccacaagagtaatgatttatagagcataataaatatgtgcttacatttacttaaacttgtatttcctcacaatttcccccattcatgatattaccctcttaagaattatttttccatttcatttgttttcctccagaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaagtaagttgtgtaaaacagattataatagataataatagatactgtatttacaatatctgttaaatagcaaaatgtgagtgcactttgacagatgccttaggtgtatattatctacaattgtcacagccaccttgtgaaatagatattactttctccattttacagatgaggaaaaactcacagaaagtggaagggctgaagataaaacccagacttactcatttacaaagtttctaagtggattaaaacccaaaagatctgcactcttaactaacactgtaatctgagtaaaataaaattttttaactgataggaatattaaatgtaaatcagccatataaatctggaaatcttgaaacttggcctgaataggaagttgttaagttcctaaaatgggccttaagtctttataatacata

SEQ ID NO: 121533 - DNA, 1365 bp, Homo sapiens
ttggtctgtcatgcccaggctggagtgtagtggtgtgattttggctcactgcaacctctgcctcataggttcaagtgattctcccacctcagcctcccaagtagctgggattacaggcactcgccaccacacccggctaaatttttgtatttttagtagagacagggtttcatcatattggccaggctggtcttgagctcccaacctcaggtgatctgcccacctcagcctcccaaagtgctgacattacaggcatgagccaccgtgtgcagcctaacaaggtttttggttttttgtgtgtgtgacagagtctcactctgtttctcaggctggagtgcagtggctcaatttcagctaactgcatagaatgtgtccttgttttaaaacattagatctttatgttataattttattttcaaatagcaattttcattgcctgaagataatcggatagttatcaaactttgctaataacttccttggttctaaagaagagagattgatggttctaaagaaaaaagatttactgagtttttaatacaaagcgaactgtggccgggcgccatggctcacgcctgtaatcccagcactttgggaggctgaggcgggcggattacttgaggtcaggagttcgagaccagcctgaccaacatgggggaaaccctatctctactaaaatagaaaaattagctgggcgtggtggtgtgtgcctgtaatcccagctacttgggaggctgaagcaggagaatcacttgaacccaggaggtggaggttgcagtgagttgagatcgctccactgcactccagcctgggcaacagagtgagactctgtctcaaaaaaatagaaataaataaagtgaactgttacattaattatatttgaattattttctatcaaatagatacttggtgcttgaaaaactgaagaaggaagacgctgaccgaattcatatattcagttcttttttctataaacgccttaatcagagagagaggagaaatcatgaaacaactaatctgtcgtaagtcaaactctgaaaatatttaacagatgtaagtcactcacatttaactaagtgaaaaatcacgtacttgaaagaaaacacaaatctctgcagttctcttgcttactttttaaattctccagccaggaagagaacacactaaataaatcagttccattttcattcttcatgggttcatattcaccttccttaaactaactttgtgctagttttggaattttttttaacaacttatttatattgaggcaatatcatttagttctcttatcagtttacaaaattaatataattcataatattctaatactttcagaatacctggaatttataaatgttctgg

SEQ ID NO: 121534 - DNA, 2011 bp, Homo sapiens
cttatttcagcaattcctaatgttgcatcttagaggtgataacagtcattggttttgaccagtgctcatggctatattgcttcatctaccatcagataatgctcacttttcctactgtcttctccccagttaccctaagtcgtgcttggctacacctctcaatatagttgccaggaccaattctgcagtaataaaaatagtaaagagaagtctaggcaagataagcactagaacttccacccctcagatggagtaacaggagtaaaatatctttctccaaattcaacaatgggtagtcccatgccttcctagtttccatccaacaagttctattttctttccccagtttgtcaaaccattttatgcaactgtttgagctattacatctgaatcttcttaatttataaatcactacatataagctggagcactagaaatatttcagaagcttataatttatctctttcttacagaatacagcaaaaacggcatgggagagtaaaaacatggacccggcacgtagatatttttgagaaggattttatttttgtaccccttaatgaagcgtgagtaagaatttcctttaaaggaaaatctttaaatcatgtaaatgatggcaatttttaaataatgagtatgaggtgaagaattcattttaaaacatctttctgaaatctcttgtgtatattcatatttgtactgcctgttttacaagaattaatgcagtttcacagtgaagcatgtaagatattgaattttagagacaatagaccagatacctttctaatctcattttattcattaatgtcaaataataccatttttaaaaatatggtgcttattgtctagcaagtaacctatagaaaagtattattttatacaaaaagatgattaggtcacataaaggaattggaatcttaagtttaaaatacacttctgtttttagccagaaaggagaaacgatggttggatttatgccatttttcaattaaaaaccatgtggactacttgaagcagtttctgagtaaatggaggtgtttaaagatttgtattattctctcccaatgactagatagtagtattttacaatggagacttaaaagttttttgtgttttattctttcgcttttctatgccctcaatccaaagaacaccagaaatacacttgtagtcggaaaacttgggtttatcacttgcatcaaggaatgacacacaccatgggccactctggagcctctcaataaaaggatgtttcaaagaacctgtgacagaatctgggctttccttgagtgatatgggggagggtctaaagtagtggtttgcctaggtaaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagctagcttctgaattttttttttttaacttttgtagaggtgagggtctcactgtgttgctcaggctggtcttgaactcttggcctcaagccatcccccaacctcagcctcccaagtagctgggattatagacatgagccactgctcctagcaaagctatatatttttaaattcatattatcatagtaaaatttaaaataacatttaaaactagttaatttcttcattctcttcaaaataaggttttggctgggcgtggtggctcacgcctgtaatcccaacactttgagaggctgaggtgggcggattacttgaggtcaggggttcaagaccaacctggcgaacatggcgaaacctcgtctctactgaaaatacaaaaattagctgggcgtggtggtgcgtgcctgtaatcccagctactcaggaggctgaggcaggaggatcgcctgaacccgggaggcagaggttgcagtgagccaag

SEQ ID NO: 121535 - DNA, 1174 bp, Homo sapiens
aaaaaaaataggctttttttttttttttgagatggagtcttgctttgtcacccccaagctggaatgctgtggcacaatctcggctcactgcaacctctgcctcttgggttcaagtgattctcctgcctcagcctactgagtagctgggattacgggtgcacaccactgcgcctggctaatttttgtatttttagtagagacagggttttgccatgttggctaggctggtctcgaactgctgacctcaggtgatccacccacctcagcctcccaaagtgctgggattactggcgtgagctactgcgcccggccagaattaggcatttttaataaattaattggcaagaactttagaaaaaaacattttaattgatatgtattgccaaatataataaacttttctaataacatatttagtcatttcatttgttttttacagtgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacaggtatgtatctaaatgttttgaaagaatgaaaaaattcagaataatctggattttttaataaacaggattaagatcctgttttaaaaaaaaatcaggttaatgactgggtgtggtggctcacgcttataatcccagcactttgggaggccaaggcaggaggatcacttgaggccaggagtttgagaccagcgtgggcaacatagcgagacccaatctccaacaaaaaaaaataaatagaaaatttttaaagaatttacttataacaatatagtaacacaacttacttttaatttatactgaggtataa

SEQ ID NO: 121536 - DNA, 1147 bp, Homo sapiens
tcttaatcacccaggctggagtgcagtggcgtaatcttgtctcactgcaacctccccctcctgggttcaagagattgtcttctcttgcctcagcctccctagtagctgggattacgggtgcgcaccacctcacccgacctgttgagctcttgtaagaaatctcctgagcaggaaaatctggagtagattagtggctgctcggggcttttgggggtgggcaggtgaggtgggtgggaatgtaggaagagagtgatagctaagtggtatggggtttctttttgagatgatgaaaaggtttaaaaattggttgtgatgatggctgtgcatatactaaaaaacattagactgtatgctttaaatggctgtatatggtatgtgaattacatttcagtgtggctttttaaagtctccttttgaccaataatgttacatactttaatgtgaattcaaatgaattaaggtacttgacttaaagcaatgggacaaaagcctagggtttcatatacacaaactccagagatttctagtgccctcacctacaaattaattttctggtcaagtaaaagccagttaaatttgagtaaatagcctcaaaaatcctaatggagaccaaagccaaaaataacttgttttatgtagtttgccttcttaatacttgtatatcccatttactcatttttgaattatagtttgtacatttttgttttgtttttagtatgtgtataccatatcaactatctcttcctctgaaacaaatgtttcacaaaaaatcacatacagtgatttcacatagagtcaacaagtgttgactacttatgtcagataacaggctgtagtaaataagtggaaattaggtttttacagaaaactagggaaataacaatgtgtggaatcactactttcacttgctgttttttcacttgacaccttatgaaatagttgacttgccatggtgcatgaaaaatgtgtacgcttaaactctagaatcacactcaacatcttcacatggtctccttatatgagaagttctcaggaactgacactgattgagagaaccactgatcaagtcatcacctctcaatttactccagatcacttgtttatgggggaattgactgcatcatttaggttatttttctcctgtttt

SEQ ID NO: 121537 - DNA, 1047 bp, Homo sapiens
aatgttcatttttgccctgaattatataattttccacgttttcgaaattttaattataaaattatgcagttgcattttcttttatgttctatgacatgctgtttctgttattggacataggttattttcagactgtcatagctttcattactaaagatacctgacttgcctaacacaaaagtacttatttgtttacacatatacatatgtatatgtatttaagtatatgtatacttaatcatatagctgataactagtttttaaattttaatgaattttagcatctgggtagtggaaacaactgtaattgacatgtcaatccaggtttttaaaataacttactttatgtttgtgatattacacactaaggcagattttgtgttcttgactactgtatcattaattaactactagcattaatttcagcctcatatactatgagtgatagacatggccttttttattatgtaatgtttcttattgatacagatggcttaagcaaaatcagactaaactatagcgatgaatcacctgaagctggtaaaatgcttgaagatgaactcgtcgacttctcagaagatcaggataaccaggtaaaacttaatgcttggcaaaaagttctaatgttttatctaattaaaagtttttcttgctgaacatggtggtgcacacctgtagtcccagtgacttgggaggctaaggcagaaagatctcttgagcctaggagtttgagttcagcctgggcaacataaggaaactccatctcttaaaaaaaaatgaaaaaaggaaaaagaaaaagactttataaagtcttgtaaagcaatttcttcaactagtaatttatcatggcttctgaatttggatcatatcttaaaaaacaaattcagctttcaagtcagaagttgccaggataaatgtatacatgctgttgttgctgctactgtggtgtggactgaactttaatgtaatactgattaactcaccctaactcagctaccaccaccaatacccaccttcctctttcaaagcatttatgggtcatactta

SEQ ID NO: 121538 - DNA, 1057 bp, Homo sapiens
ctacagaattttagtataaaatatagctaagatatggttaagttaatattctataattcaatatttaatatatccatagatatttaagtattattagattataaggttcgtatgtgtctataaggttcattttttttccctcagtagtactgagtcatacaaaggggattttgaaggttttaaatttgattgtttataatatgccacttttaatccttttatgcatttgtaatattatgaagtattcgacttttggtcatttttaccctgcagaccttgtatcctacttatggactcactccgaggcccttctcggtcaaatgttgtcaaaattttaagagagtaagttcacactttatttcgtattctgatggggatgaagaactatgtatatttatatatgtgtgtattcttaatatatatgaattattgcaggtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgaggtgggtttcaatttgttggatctgctataataaataataaaatagtgcatttgactttaccttagtaaaaaacacaataagcaaatattttaaagagtttcaaaattattgtttcaaaaattattccatggagcaaaaacttctaaatggaagaaccttcaaggcataaaaatagtatatttacagttcatcaaatccaaggcttgttgagctcattctatcactgaacaatcaacctgccctctctactagctcttgccaccttaagaaatctctcccatgattcacactgcctcttttagcctcttttctcctcttcatagatacatttcttaagaagtgtttatattcactctctaattctacagattctacttctcaaatctctaaaatctggctttatccttaaccttatgttaaaattgctcttgactttccagcaccctttgacagtgtcaaccatttcttcct

SEQ ID NO: 121539 - DNA, 1663 bp, Homo sapiens
atttggtccactggcaaaccctgatctagactataagatctatgatagaaactgtgtcttgtatctccaatacctaacacagtacttggcatgtgatagataatacagaaatacatattgaatgcgttgttgggttttcttatttttaacttcggaatgtttctgtgattgaaatgaaaggttatttattacagttttctaatacgcatttaattgtattttcagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttg

SEQ ID NO: 121540 - DNA, 1070 bp, Homo sapiens
cagggttgagcagatgaataaacatctggctgagagaatttagcatacaaataaagtatacctctggatataaatgttataactgagttaaaaaaaaaacaaatatgtttcccagcttgtcttttttagagagtatggtgaaaatgagaaacaggtttggaatcaactgaataacacctgtggttggaaaccaaccatttagacattttctctgtaagtaggcttttttttttttaaaggagtgattttcaaacttttgtgggatcttctaaaaacatattgtttatttggatttgacactgatggaatcagtatcccgcaggagatatttgaggctcttagtttttccatgttgtattctttgaatttccttgatttgaggattgagttattccagagagaacttttctcttcttccttgttattttttttctaaaattagatgaaccagctgtgttttggtttgtgggcatgatttgctgtctgttatccttttggtcttagtatctgggggaagaacaaagaacctgtgtgtgttttgaagaagaatgtattagtttctctgctcttcttgttcatcttggttgatctttaagatgagaagaacgaagaaaatactttatgtacttattattcttgtgtttgatatttcaaacaaaactgtggcttgtattggccactgagatgatggagaaaacaggtgaatgtaaagtgaaaaactagtcatcatgtattcaaatggctaattgaagaggtttatgttaaaggttttctttcaggtatgggaggagggaaaagaaggatggaaattgaatgagtttgaccatatgaccagctgtcacgacagatgttttagcaaccaggaaatatttatttcaatcagaatttaattttatattttatagggatgcattctactaataagccttttttttggaaggaaagtgaggataagttaggaatttataaaccaatttggtgattttagtaagtcattagtaaaaatggagatagcctggtggctgcatatactgatgctagtatgttagaaaatgggctgttagaacaca

SEQ ID NO: 121541 - DNA, 1014 bp, Homo sapiens
acaggagctggatcagtttgtagcatcctcacagacatttgtgctggctgcagtatttttatttttttgtgtcatcttcctcaattcattctttttttttttttgagatggagtcttgctctgtcgcccaggctggagtgcagtggcacaatcttggctcactgccacctctgcctcccaggttcaagtgattctcatgcctcagccacctgagtagatgagattacaggcgtgcaccaccacgcccagctaatattttgtatttttagtagagacgagttttaccatgttgactaggctggtctcgaactcctggcctcaagtgatctgcccatcttggcctcccagagtgttgggattacagccgtgagccactatgcctggccctcaatttattcttgagtgttgcattcctgtctttaagtgagacactgaagcttttacattctgaataataatacatataaataaataataagaatgaatataaaattaatgtttcatttaaagtgatgtaaatgagaaactataatagttataaatagtatatggttcataaatacacatgatttacaaattcctttttttttttttttttttgaggcagagtctcactgttgctcaggctggagtgtggtggcatgatctcagctcattgcagtctctgtcttccgggcttaagcgatcctcccaccccagcctctgagtaactgagactacaggtgcgcaccaccacacccggctaatttttgtatttttgtagtcaggcttttgccatgttgctcaggctggtctcttaacttctgagctcaagccatctgcttgccttggcctcccaaagtgctgggacttcaggtgtgagccattgcccctggccacaaattctattcttaagcaattaaattggtggaaatttcttgcatttaaaaaaaatgaatttactacagaaattatattttgcctcccaaaacactttcaccatttttaaaaataatgaaataaggtttgttgccc

SEQ ID NO: 121542 - DNA, 1067 bp, Homo sapiens
aaaatcagagctatctattgtagtacttttttccctcttgaattgtgctttttaatcaaccttcattaatgagtactcactaggtttactcttttagttgaaaattcattacttaaaaatatcactgtaacacacatgtaaactgaatcgcttttaaatcagcttctagggtttacatcagccagggttttaaaaaagatggagttaaatgtaacctaacaattgatttttaggatgagtcaaagtgattcagattaagatagtattgctttattttatttgttttcttcaattctctaatgacatataaattttatgtcttaggttcactaatgtatttaaatgaagccacactgctccataatatcaaagttcgatatagtaaagacagaatttatgtaagtattttacctgtagtgtaagtttttgtggagataattatttcatgtggtactctttgattttgtcacgcttgaaattgtctaacagaaaatcatgcttgatctgagcctcttgaatagagtgtgaggttagtgaggacaaagatttttttctaatttacaactcgaactctaggagttaaagcatgcctggtacacagaaagcacttaatcagtatttgtgggatgaaataatgaattcagagtgtcgtttaatatcttttggacttaaaaatgtccagtttgagtatttttaaaagcactgtaatggtttttggttttgatttttgacttctggtatgtctgtagatatgtttgattcactttccacattgtttggaagacaatgtaaggcagcctataaggaatgtatattgaaattaaaaatttgaatgaggaaaaaaatgtaaatcagaataggaggtagtatctgaggaaatactaagaacacaggaatgctgaccatagagcctaaatagttgctgaatttcattagaccgtaggtactctaccttgaaagtccagaatattcaaaaatgaaagaaaatgctttcagtgtaaatagtcaaggtttacaccaaatcattcagatggatacttaacctagtatgttttaattataattat

SEQ ID NO: 121543 - DNA, 1814 bp, Homo sapiens
ggtcagttggtgctgtatttgcacttaatggtaaatacctttaagtttcattgttactttagatggttgcaggaatatatgtgtccactatgaccatctaaaagctcctttcacaatctaaaacccagatgctgaatttgacttcagcattgagtattactgtatagctagtcatgtaagatattctagcacctgtgttgaggtacggtgcaaggtcaattgtgattcttaggaggctcaaaacttaacaggatttgggtagagacttaaatggggatgtttaaaatgaaggatgaccattataaatactctgtgcttacgtttagttatttgttttttcccctttatttggtgaatattataacctctttgatagacaaatggtattagaaaaggtaaataatttaacattggttaattatattttaagactttaaatgcaaaaatatattttctctgtgttttgttttttagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcgggtaggtcagaagaaaagaaatttcatatagccaggtgcagtggctcatgcctgtaatcccaacactttgggaggctgaggcggatggattgcttgagcctgggagttcgagagcagcctgggcaatgtagcgagaccctgtctctaaaaaaaaaaaatacaaaaaattagctgagcatggtggcactcacctgtagttccagctactcgggaggctgaggtgggaggatcacctgagcccaggaggttgaggctgcagtgagccatgattgtgccactgcactccagcctgggtaacagagcgagaccctatctcaaagaaaaaaaaattttgtataatttttgaaaatataattgccatcaagcctaatacttattttagtgaattttgaaatctacttgttgtgtgtatgtaacttacattggatcaagtataacatgttagaatgaccactgtactgagaagatctctattaaggtgtactgctgagtttatagtataacactgtatgaggaggcacataatggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgcacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagcttttcttttacttcaatttcttttaatgtgtgtttgcaaattttaaaagtc

SEQ ID NO: 121544 - DNA, 1050 bp, Homo sapiens
aaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatgtttaatttgttttgtcatagtatttaaaccgaggctgcactagatactttgctaacaaagaaactgacaaacagattttacagaaccgcaaaagtcctgaggtatagtagaccattgttcataaaatctttaacttaaaaaaaaactcatgctgaaagatgtgttataatttttattttagagcccaagtaagagttctaacttttaggcttatactttaaaaaattaaatattcatctaagtctctgtcacagtgtaatactttatacctcttgttgttatctagtgaagtgacaggttctggttcttctggttgggcatcactgcattgctctcctctcattctgttttcaagcatgaaggtattaaattgcctaagaatcattctcttctagcatttttgaaacttgctcttatattacccacttgagcttaagtatatgtcttttacaatttattgtctatttcaaggctgacgtgaggtttgatgtagacagtaaatagattaagcgttcttgggaagaaatgcttataggctaggcgtggtggctcacacctgtaatcccagcactttgggaggccaaggcgggaggatcg

SEQ ID NO: 121545 - DNA, 1028 bp, Homo sapiens
atcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgtttcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattaaatgaatatatttatcattacctcatttaaaaaaactgtaatgttgattcaagtattgatattc

SEQ ID NO: 121546 - DNA, 1049 bp, Homo sapiens
tgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaatgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcgttatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtcttagcaatttgaaaaaatgttggttttggcaggatatggtggttcttgcgtgttatcccagcattttgggaggctgaggcgggagggttacttgagctcaggaattcaagaccagcctgggcgacatagtgagaccccataaaaaaaaaacaaaaaaacccccaaaacacacacacaaacgcacacacacacacaaaataaattagctgggcatggtggtgcatgcctgtagtcccagctacttggaaggctgaggtggaatgattgagccctggcggtcgaggctgcagtgagccatgatcgcaccactgcactccagcttgggagagtgagaccctgtctccaaaaaaatttggtatttttataatta

SEQ ID NO: 121547 - DNA, 1013 bp, Homo sapiens
cagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattgcccgtttctaaacagtatcttacaaaaatgatcattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggtataaatgccacccaaattgaaatttcttagctatgaacttgtcttttctattaataattgacatttaactttttaacttttatttttcaggctttgtttaaagctttgggcttaaatgaaaatgactacaagtttgggttaaccaaagtattttttagacctggcaaggtaaatatacattttttactttaaactgtaacatcatgaaaacaaatagttggggttagtgaatatcttaaagtatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgcaataaaaatctcataatgttttaagaaagtttatgagtttgtgttgggcctcattcaaagctgtcctggg

SEQ ID NO: 121548 - DNA, 1070 bp, Homo sapiens
acaaagaaaaaaaaaacacccaaaactaaaaaggaagtttgacataaaaaaaagtgtatcacagggacagattataggcagttgcatggagatagtccatagagctggctgtctttctcagtcattaactatattttgaagtcttgtaccacgaataataggtgctttttttcttttaggacatggttcttggagaatatgttcatattcattttcttcatgagattgctctttttggaattcttctgtgattcctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttatactcatcagagtacctgaaatagtgctaggtacatgaaaaggatccagcgaatttttccttatcagtagaaaaggaaaattcttttggcctaatgaaaaagaatcatgctaacaaagattatttttgaggtattttgttagacaattgtgaatatagataaaaagagaactattaatataaaaagaaaaaagatagcagaatcttttccccatcattttccaaataaaatacagaaacatctttattactgtagtttaatacgttcagctttacacattgcattatgataggaaacacattatagtaaactcatctgttacaccattcatttgtggactgtgttctacagtggtaccgaagtcagtaaccgggcagggatctttgcagaatgttaataggaaactctgaaaaaaaagttcaaggtcagatcatcctaggaaattgtgagtaactgaagttaagtagatttctttgctgtaggattctcagaggcttcactcagtatgttcattgtg

SEQ ID NO: 121549 - DNA, 1082 bp, Homo sapiens
ttattttctgttaaatttttgaagagttttctattttttattaggaaacttgagatggaagcaaagagaaaacaagaagaagaagagagaaagaaaagggaagatgatgaaaaacgcattcaagtatgtacttactgggttgaatttctattaaaatggaacctacaggctgggtgtggtggctcatgcctgtaatcccagctctttgggaggccgaggcgggcggatcacgaggtcaggagatcaagaccatcctggctaacatggtgaaaccccatctctacttatacgaaaacaaattagccggacatggtggtgggcacctgtagccccagctaattgggaggttgaggcaggagaatgatgtgaacccaggaggcagagcttgcagtgagccaagatgacaccactgcactccagcctgggcaacagagcgagactccatctcaaaaaaaataaaaaataaaaaataaataaaataaaatggaacctatgaaagaagtgaaaatgagatcttgatttgctagataagctgtcactagtttatcctagagaccaaaggccagtttttgaagtggttatgggaatggactttggagctagggaagtgggttcaaatccaagatcagtcactgacagaaattgtgacattgtacacattatagtgaggaactatgggtcacagttgtctctctgtagaatgtggataaataatagttgcaagcatttgacagttaatacatgttaaagcattgtgaacactgtgtagatcaataaatattaataattgtttttatacctaggggaaagtcaaatgaaaattcacttaaaatgttaagttttaaaatatcatataactttgtagatactggaattaataaattaggattaagagtctctctccacccctagtttttaaaaagtcccatgttgagaataaattgctcatgtatttgaatttctgtttgtcatggctttcataatatatcctaagcataaccaaaactttaaattcctgacatctgctctctaggtgttagtgttaatgggatgcctaagatactcatgtgatgtttgggaca

SEQ ID NO: 121550 - DNA, 1137 bp, Homo sapiens
ataaaataaaaatggcatgagtttaagatttagagagtttaaaaaaagcaaaacatactgttaccaaaacgtagtaacgtttttactcctgtaatgtatataattttttgatgaattctcattattttctatgaaaattctagtaatgtatgaaaggtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggtt

SEQ ID NO: 121551 - DNA, 1139 bp, Homo sapiens
gaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcac

SEQ ID NO: 121552 - DNA, 1597 bp, Homo sapiens
atcaatctcatgaaagggtacaaagttagaatggtccagcacagatgaggctgagagttcaggagtaagggttcctttcttagttccccttaagttcttgtaaacctaaaaaatgactaagtggtttatcattcctggtccctaacaaagaaagtgaaaagataattattatgacatatatctttgataataagatactcccaaactcacgtttattttgtttctacatatacaataagaaatacatatacaataagaaatgttgaactatgtaatacctctatacattcatggttaattaaaataaattgtacatatcacacagatggcagaatgtctgacaataaataaaaaattttatacttcatataagttaaattattacacaaattaaaatccacatgaaacccaatttctcaagtgaacatttgctttaaagtaagactttatctgggctatctccccaccccacaccatttataatgaggtgagtagatattgggagagtctcagggaacagagtccctgtgaacctgttacagaaaaggggtcctagtccagaccccaagagagggttcttggatctcacgtaagaaagaattcagggcaagtccacagtgcaaagtgaaagcaagtttattaagaaagtaaaggaataaaagaatggctactccatagacagagcagccccgagggctgctggttgcccatttttatggttatttcttgatgctatgctaaacaaagggtggattattcatgcctcccctttttagaccatatagggtaacttcctgacattgccatggcatttgtaaactgtcatggtgccgatgggaatgtagtagtgaggacgaccagaggtcactctcatggccatcttggttttggtaggatttagccagcttcttcactgcaacttcttttatcagtaaggtctttatgacctgtgtcttgtgccgacttcctttctcatcctgtgacttaactgtctgggaatgcagcccagtaggtttcagcctcattttacccagctcctattcaagatggagttgtgctggttcacctgcctctgacaaactaaccatggcatgttaattagggttcatgctaagctgccataatgaagaggtaagaatatagtgactttcattcagtacaagtttatttctctttcacttgatgggtaggacagcttagctctatgatgccattcagggacccacacttcttccatcctatagctctgccaataccaagggcatttcctcattcacatggtcaaagctgggtcattggtacatccctgtttccacttgtgagaagcagagaggaagctgagggaaagcaattttctcctaagcaaaagacaccaaagttgcccacatcatattagtgggaactagtcacatggccatccttgccacaagggaggctggaaaatgtgctttctagatcagcagcctctttctatgagaaataggaaaatggatttgggagaagcagcacctagctatctgcacagtaggtgaagacagggaatctctaccccaggccaaagcaatgctaagacaccaagaatgaggctagtcaagta

SEQ ID NO: 121553 - DNA, 1030 bp, Homo sapiens
ttgtctcaaggattaagtcaataaatagctctttgcttccacgatcccttctgtctttcctgtactctctactagcatgttgactggtttgatcttcaatctggtggaatgattaaaacttttattcacaggagatctaagtccttagtggtcctgtatttattagttcctgtagctctcaattatctattgaccatggaagtaccacaggctaacctagtgaatcctctggatttcagaaatagtaacccttgagtctattatgcagtttcttcttgacaaaaaggattaatcaccacttctaactaagtgaccttagtttctgcttagcagcaggaagagcctcaaatagccaaggtacactgtggttggcagaataatgtctcccccaaagacgtccatatcctaatctccagaattgttaaatatgttaggttacacaggagaggttgtaaatggaattaaagtggataataatctgactttatgatagtgagattatcctagataatctaagtgagtccagtgttatcacaatggtccttgaaagtgaaagaaggaggcggaaaggagagacagaggaaaatgtgactatgaaagtgtggctagagagatgcagcattgctgaccttgaaaatggacaaaaggggccggtcctggtggctcatgcctgtaatcctatcactttgggaggctgaggtgggtagatagcctgaggtcaggagttcaagaacagcctgaccaacatggcgaaaccccatctctacgaaaagtataaaaattagctggcatggtggcagacacctgtaatcccagctacttgggagtctgaggcaggagaatcgcttgaacctggaaggcggaggttgcggtgagccgagatcacgccactgcattccagcctgggcaacagagtgatactctgtctcaaaacaaaacaaaacaaacaaacaaacaaaaaaagatggacaaaaggaaccatgagtgaaggaatgcatgtagcctctggaaattataaaagttaagaaaa

SEQ ID NO: 121554 - DNA, 1044 bp, Homo sapiens
taggtatgcccagagggatgctgggatctcagcttggctctcagcatgaacaaagtctaggaaacatgctacctgcctagatagagttctcaggaaaatctcataaatctgcctaaagtgggttgtgaagttaagattactgggcgtgtagggagtgccgaatttccagactgattcctatcttttgtttagtgacatgcatatagagctagctctctgcctagtcttaatggaagaaaacaactgaagtcagcagaacgtctgattgtaacaggtgatctttctactggcgggcgaagaggaaagaattttctcacagcaaaaaagtgtcttgggatataggaaaagaaatagaaagatacattttccttgctcaagagagttgactttagacctatgaattattgacacatgctttttggtgttcaatgtttgcacatctatccagatcaaataatgctgttagcagttatcgctgtgtcaaactttcctgaatttaaatctgcagaatcatgcttgctcagagtacctgaaatatcctagagctgcttatttaaaattatttttaatttgctttaaaatgtattttaatcaccagggtgctttcagaagaatgctataaatctatcattgctaaataacaaagcattgcaaatatactttgtatggtagaataatgaccagattaatgcattatacatttacattctggtttattattttgttttttttgagatggaatctcactctgttgcccaggctggagtgcagtgtctcagtctccactcattgcaagctccgcctcccaggttcaagcgattctcctacttcagcctcctgagttgctgagattacaggtgtgcaccaccacgcctggctaatttttgtatttttagtagagacagggtttcaccttggtggccagactggtctcgaactcctgacctcgtgatccacctgcctcagtctcccaaagtgctgggattacaggcgtgagccaccacgcccatcctacattctgttttaagtgagaagggatatata

SEQ ID NO: 121555 - DNA, 1033 bp, Homo sapiens
aatctggacagttgctattatattacacggtcatttgatattcataggagggaagtggatggatgaagtgtcaggtatgtgccttttcgcctgcaactttaagtagttaatatattcataaatcatagatagtattacacatctatgtgtaatgtaatatacatagatatataaatataacaatatatttatgaatatattatgaatatattcataaatcataggctacaggatgagcaattggttatagtaaaaaggatgagcagttggccagagtgaaaagaaagtaagaaaaaatcaaactaaattaattcattgatgtacatgtttatttagtaaatgtttattaattacagggcacttgtatagagtgcttagggtagtggaggtggagggcagtatgcagagcagtgtaagtagttagggttgaactgagttttaagttttgggtcccgagaaacaaccaacccagccagatgactttgggagcttcctgatcctctagctcacattgctcaggttggtcccctcactcttcttttctgccttatagcctgaggactgaattctcactgttccattgcctccccagttcttgctttctcatcttgtataagcatgtattcaggaaacagtttttagctagactagtggtgacaagagaacagaacaggggcctgacagatccagaatggagcttgccttagtcttctgatgactgttttcctggtcccagcctgctccgcctctgtttcacctctttgtccttctcaccctgttccagacgacgtactgaggaaacattgcaaataactgacttaccgacacaactgtggagctcagcatttataagttggggcattcactgttttacagatgctgaaagagtgtgaaaattcaatgcgtaagcatttctctctcagttcccatataagctttcataatataaattgtctaatacaataatgatggaagtttgtttaaaattgtagttgatttaaaacatacttgaataatacacataaacataaaa

SEQ ID NO: 121556 - DNA, 1098 bp, Homo sapiens
caccccacaacagtccctggtgtgaactagttcaaccattgtggaagacagtgtggcaattcctcagggatctagaactagaaattccatttgacccagccatcccattactgggtatatacccaaaggattataaatcatgctgctataaagacacatgcacacatatgtttattgcagcactatgcacaatagcaaagacttggaaccaacccaaatgtccaacaatgatagactggattaagaaaatgtggcacatatataccattgaatattatgcagccataaaaaatgatgagttcatgtcctttgtaggatgaagctggaaaccatcattctcagcaaagtatcgcaaggacaaaaaaccaaacaccacatgttctcactcatagatgggaattgaacaataagaacacatggacacaggaaggggaccatcagctgattttctaagcagcagctcttattaacaccatgacattcctgaaacacctccatatatattaggaagctgtatattatctctttgtgtcactattttccacagctacagcttccagttgaccaatgagcttagtagggaatagtggatatttttctttctgttttaattatgggaagtccttttaaatttaactatttgaatgttgtggttttaattactctttccactggtcccttcctataaagctgtgctatgttgcatctctgatatagcattttgaagttggtgattccctctagtactgtcgtttttgcttcaatcacagtgatttttgcttagatcatttcaggcagtttatggataaatctgaagatgatggatcatgaaatcagatatttatttatttatttttttgagacggagtctctctctgttgcccaggctggagtgcagtggcacaatctcggctcactgcaagctctgcctcctgggttcacgccattctcctgcctcagccttctgagtagctgggactacaggtgcctgccaccacacccggctaatttttttgtatttttagtagagatggtttcaccgtgttagccaggatgatctcgatctcctgacctcgtgatccgcccacctcggcctcc

SEQ ID NO: 121557 - DNA, 1024 bp, Homo sapiens
gagaagccctgtctctactaaaaatacaaaaaaatagctgggcggtatggcgagcgtctgtagtctcagctacctgggaggctgagatgggagaatccttgacccaagaggtcaaggctactgcaagccatgattgcaacactgcactccagcctgagtgacagagcgagacctgagaccctgtctcaaataaataaataaataaataaataaataaataaataaataccaaaatccagtaagtattagggggagaatgtaaggatttgacatggagaaatagacatcaacagtattcctagtttctgatcattaacaactgggtgcatggaggtgctatttagagatataagaaggcctggaaggagaacagtcttggaaaagagaggggagcccaagttccctttcagacatattgagtttaatgataattgtaagatgactgtaagacagatttgcaaagcaaagcaaatcagtggcgttatcaatatggagcttaaaggaaagtactggcctggaagtaaatttagtctttgtcagaatttagaggctttttaaggctatgggaaaacaaatcagtattagaaagaggaggacctagtactgagcccagaggagtgccaacatttagtggtcatgtagagatgaagaagcctgcaaagaagttaaagaattggaggattaaagcaataggagaaaaattaggaaagtattgtcatggaaaccaatagaagagagtatttcacaaagaagagtatagtcagctttgctgcatgctactcagaggcttaataaggtaagaactgaaaggtgttccaagtcataagcttttcatatgattaatatgtaactgtgataaccagataatttagtacccttgtcacaaatttgctgaagatattctaaaatcttaatgtgctggcagtcttattattacttgcatataaacagcttaattttctgagctaatgctggggaagaatagtataaataatccaaaataataatttaaaattacatgtgt

SEQ ID NO: 121558 - DNA, 1006 bp, Homo sapiens
ttattttattaattttcatgaatatctctgtttttttatggtaagcattttttatgagaaagaacatcaagttgaacaaaatgttaggaatttaatgttgccagtaggatattcttttcatgatttcaaataaaatcaaatcaactcaaatcagaacatttgaacagtaattcatgctacatttaaacaaaatttgtgtatgtccacttatcaatatatgtttactgttgtttagtttttatattttgccagaagatacgttccttggagaataatactgaatatatagcaattatagcaattatagcaatctaatcttaaataattgaattaagagaaatcaagttaaaccgctacagagaactccagtgtgcatttcttcttccaatttttctgctaactgacataaaattggcagtaatctttagcctattttttaaatagtgatgcatgaatcccagccagacccactgaatctctgggaatgtgaagtttctaagtttcacaggcaattctaatgcttattgttcatggagaaccactgtgctatagaggcaactgatttcagaataaatacacacaccaataaataactgaaagaacaaaatatctttgtttttgatgatttaatatgggtactactgaagttttaagatgctgtagtgatcaccggtctctcaatatgatgctatgtattttctaatttaagctgttactgaggagacactgtatcgagcaggcatcacatgctagctgtttcggcaaatgttgggttgacataacctgactcagcaactgggagagactttctgcccatcaacaaatgctatataaaaatagattaatgtatctctttgatgcatttcaagtctatgaacatgagacttcattccttgcaaattaattaaataccaagggaattaatactgaagaaactgtacatccttaggtgcaagagtgtcaattaaagctggcagaacaacaattcaatcacaggggttattac

SEQ ID NO: 121559 - DNA, 1055 bp, Homo sapiens
taggccagctgctgtccggaaaaagcgtatttaagagtatgatcatacaggtgagactatgagcctgataaggggtgaagaaggcatctgcccggtgccagaaaacaaaaagtaaaggcaatttagtcaataaatttcacttgcacttgtttgaacattgatgttaaacttagaattcctaggctgtcatttttataacatgaaaagtaattaaaactcagacttcatgaggctttctagcatttggctagaatcttgctgttaaaggaaaaatacatgttatagactccttgaatttataataatcaaaggttaatacataaatagccacaaaatatacaaggaagtattcaaaaataacatgcatttttcaggcataaaacagcagtatttattcttgtttgtattttggatgttataaatgattctgttttatcttgtggaatccatggtctgtctccaaattaatgtgtttgaatatatcttcttgattagatcttttgctgtgagcaggaggaaaagaaaaaaaaatctatctaccttaaatcagaactgcttatattgaacttgattgcatgattggatattcaagattatttaattaaaactcaattgcagtctaattttcttttaacatttgattaaagctgtataaatagatatcagagacatcgttccattgtttgtagatgatctccagtattagaaaacaaatatatttaaggacacacatgtgtttactagtttggcatgtagttaacaagcatagactagtatcagattgtcaaaggtcttggtttgagtcctgacttcatcatttatttgctgtgtgaccttgggaaagtagttcacctctctgaacgccaataattttgtaaaaggtgaataatcataaggtgattctgaggatagaaagtccaatctagagagaatgcttaaaatactatctagcataatgaactgtgtaaagtatgttttgatatgtgttcatagaacaaattttatgagagttcatatatagaggatgagataatttcaaaatattccataaaaga

SEQ ID NO: 121560 - DNA, 1084 bp, Homo sapiens
agttgatcaagacttgtctcagatactttttggtttacgtacatatatcatatggattgtgttctgtgcccactgtaccaaatagtgcgagctcatttcttcattttaagcctccttaagaggattactgtgactactgtgtaggattgaatggccccttggtgttactttttaagctctttgacaaacttccaccatatcctctaacccccacaagaaagggtgccgagtagagtgcactatctccaaagttgccctctcctccagcaaccaaggcaatcagtcacacagacaggctttctttcttctgagggttatattgcttatcactgtgaggagccagatgttaacaaacttaggcaaattataactaatatccgagatccatgttattaaaggataatatctgtagccatggcatgtgagcaataataatattcttcaattgtttatctgttctattggttcctggtcattaaagggcataacattaaatcataatttaatagaggcatttctgaaggcaaactggccaatataggtcagatacactttttagtagtgatctaaggtgatatttggctgaaattagagatgtcagaagaatgatgagttgactttttcttttttgttaaatattggttgtctctgcctgtttttgataaggtgttggatgatattcattcacttgttcatttgccacagacatatctgaccttgctaagtatgagaacttagatactaggtaaagtctgagaactgcaataatgaaggcatgtgctggaatgttagggtcactagtaactggtactgctgggttggaactttagggagtattgaactctctggcaaatatctaaagtgtttatattatgtagtaatagcagaggatcacacattttggccatctgataactaagcagaaaaactgacaattgtgaaaattaagaacatgacttgaatccttagaccaagaaaaaaaaaaaccaaaacaacaacaaaaacttctttgcagggtgcttataggcagagggttatatgagtgcttataggcagagccaattttttctcaaaaaacgaatgt

SEQ ID NO: 121561 - DNA, 1050 bp, Homo sapiens
ttaaaatgaataaattatttctgtattaacattcatagattttgaaaaaaataatgttgatctaaaaggaaggatgaagtatctgagaaggagagctacccaaatataccatttttttacaaattgtaaatgaaaaataatttttacaaaatataaatacaaaacaaattataaatacaaaacatgacactttcactgcgtgtatacttttaaaaatttatttaaaaaatacagaatctgtaatgtttttaatttatgtattgcatgtcctcaagatgcatgttttttgcattgtaaatatttttatatagaaaagaaaacatctctttaggtgtcagacatgtattgatttaaaatgaatcgttaatttttaagtgatttttcacagaaatgtttttctccgagatgcagttcatacctctatctaatcagcatgtttctgcgtacagtagccaagctattaaaaatgaataatgcttttggaatattgataagcacaggtgaaatctgaatttagagtattacatgcatacttatattaaatacttcagagacctaatgtttacaaagtagattaaaattctacattaaaatagattttaaaatttggaagaaagcatattagcaggagaaatctcaaaagttctgcagcctacatcaggaagcatttttacttttctctgttttccttgtaaagtaaaataaaagctaagcaattcattaataaaaatagaacatgcaaattaaatattctgaatctggaatgagtttatacatttacttctctaaaacaaactaattttctatatcaaggcaaaatatagcaacaaaataagcatttttaataagataaagaaaagtaatcatagctctgagcatgaaacagttcacctatttcagttgagagaggaaccatattcttttctgaaattatacatgtcttgatcatatctaagatctacgaagcctggctcagtcagcaatcaatccatcagagagaatagaattataatttgcatcaaactgtgctcaagtagacaaaatagagat

SEQ ID NO: 121562 - DNA, 1107 bp, Homo sapiens
ctctatgcaattttatatcttaattttctacattcagttatttaatatatttggaaagtgtattaatccatggagtgaggtgggacactaagtgggaaaacattcagcttctcagttatttgtttagcaacactaactttttctttttatttgggatatttcttttattatgtacttcattttcacatatattgtctttgtttattgatctgcctgccagtttgtacactgctatggcactaatttagttaatctacttttattatgtattttaatacctaattatttcaatggctttttattagatgttcttcctgtttatatatctaagtggccttgagaataattttttcaagttcaaaagtaaaactgtgtagattttcattgagatatttgttgagtgcactgaatccttaaaacagaagtcttgttttttttttttttcttttaagctgaagaaacattttaaaaattatgtctttgaaaagaccagtcattgtggggtttatagagctccaattatttatatttattatcttttctcattattttcatttcttcttttctattacatatcaagtgaatttctcaaaatttttcatcatttactcaattttctataataattcttgagtttatcttcaatatgaatttcaattttgttttttctttttttgagatggagtcttgctgtgtcacccaggctggagtgcagtggtgcaatctcgtctcactgcaagctctacctcccgggttcacgccattctcctgcctgaatttcacttttcttattggaattttaattcttttttaattctgtcctcagttcatcacattccattttgatttcactccttatatatgtttttttgtcattcgatgtgtttatctttttatcttttattggatttcagctttttataatggacatgtatcatttcatgccactgaacatgtcaaattatctcctctggttattctcgtttctttagtaagttattttcagagctttgccctgctttattgaatttagggcattattccttgtatcatttactgtttctcataggatctgtatcattgtttgtttaattggcttttttcctt

SEQ ID NO: 121563 - DNA, 1037 bp, Homo sapiens
tattgaaagtgtcactagctaccaacaggatgtgtgtgtgtgtgtgggtatgtgtgaaaatatatatatattttatatataagtgtgtttacatatgattgtttatattttttctaaatctcttataacccttcaaagttgtgttgaaacatatgtcattgctcagctttttatggccaaatattcagaaaacaatcttttgacagttgaaatgccagttttcagaaagaaggaaaattaagccatttccctcaagcatcatctagctgatggttgctgacaacagattttctgacacttagattttccaacctttttgactcacatacgtatctatgtagatggctcatggtacaaacttgaataacaatcttaaattgtgatattcagaaatgtcagctctggccctttacaaaatgaatactttgaaattgtgtctctctccctaatagttttgttttggaggggggaaaatggtgtgctccagaaaccaagcagtcagccttttttttttttttttttgaaaacttattggataagcagcccaagaaaaggcgctagaagatgtgagaatgattctccctcccttcaaaaagttttattcttattgagacacaataagaaaataaaaaacaatttaagtgagaacaaaaaaaaagattgcttgtaaaagataatccatggtatgactattctgaaaactgcattggtacttttcacaagggaatacagatgaccaagtcataatgagttgaacctgatgaaaatagatgggcaggaagtatttaatgattctcagtctttaataattaaaatataattcagccaattagtaatataatgtgccaaacaattcacttgcagtaacaagttttgaaagattggtttgattcaggtactaagtagtcatcagaggtggcattgtgttactgtggaaaagctgatttccttgggtttctacatacatttttctatttggatcagataaaataagtaataagtaaatacataaaaaaacctcttgatattaaggcctc

SEQ ID NO: 121564 - DNA, 1588 bp, Homo sapiens
gctaacaatttttgaaggccgtaagttaaacatgttaaaaactgtagctactcactcagccgacatctagtaaaaaagatgcggcaagatcaacaaggcatatagcttgcgcccgccagaagttccgcggcctccacacccatcccggcatactttgcgccgtgcacaggcaagccctggtgcgcattggccccttcggccgccgtcggccggtagttactatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggtgagatctccgcgggggaggaaataagagccggaagacacaaaagggttggcagatggtcgggccccacaggcccccctagcgggaagggagatgtggagggtctggagcgtttaggacgcgtttgttgcaaaggtactccgggacgccaggacctggcagagtgaatatttgacccattcttctcctagacgaaggtaattattggcctcaggcaaattaaaaataaaagaatgcaaattgggtaggtttttatctggggatatttgcttcagtgattttgtttttaaatttaaagtgatgaaatgttaaaacttgaaatgttagttgtaaatacttgcccacgtggagtgctggacactaaatattttgttttgttttgtttttattccgcaccatggaattggcaagtgaagagcacgacctgcttccttccgatcatgtaaaactttgcatggaatggttcttgagtatgttccgcaaacagtaacgttgggaagtggggaagaagttgcgtccattttcattttataatgattttcattttatagtgattcccccaaaatttcttcggccttcttaggtttaacttaaaagaaaaaatcaagccagtattgtggataccacatatacgaaatacttctacttacttaacggagatgtccatgagacaaatcactaaacaaatcttaccttaagcctactcctaaggcaagaaaaaaaatgaagccatcatttaatccacacaatagcactgttaggcatgttttaatatccctgttttccaaatttaaagaggttaaacaatgctctgaactttaggtagagcaatatttgaactcatgtattcctgaaaccagaatgtaagttgcttccaattctgccgataattagaatgaaagaaaattagaaatcatagggatcaacgatttcagttttctcattttatagagtaggaccccaaaggccagagatgtaacttatccaggatgacattgagttggtaaaagtgcaggcattgttacttcc

SEQ ID NO: 121565 - DNA, 1068 bp, Homo sapiens
gtaatataaactaagaaatagtttaaaatggaataaaaacagcaagtgggaaatagcagttaattgccactaaatacaattttagtactgtcatcacccaatgtgcaggtgacacctacaggagagaaatttctttttagataaaaagcaaatcaagtcataacataaaggatttgaaatgcttttcaacattcttttgttttgcagtgcaattttaccgtattgtgataaatattgtttaaaaatgaaaaccattcaacctttatacaaattgaaaagaataaaactattttcaaattataaaaggagtgacatttatgaaattttaagcaaaatcaatttctgaattcattttatgtcacttttaggaaagttttaaaacatcaggcaaagttctttttgcatattttatgtttttctgattttaattagtgtaggtttctaatttatgttttagagtaattgcatcaaatatttagtaatcatactcttggactttttctgtttcaggcagaaaatataactgtgacaaaggattttaggagagtggaaaatgcttatcacatggaagcagaggtatgtacttaacaaataattggaagcagcatgattttgtggagacagtcatttttattcttgaactgaaatgaatggtgaaaaatgcttctcatgatattaatagaagattatttttctcaaaatcatcttggtgttatatatctatttcggcttttaaataaacttgagatttaaaagaaagtttaaaatggaataaaaacagcaagtgggaaatagcagttaattgccactaaatacagttttagtactgtcatcacctaatgtgcgggtgacactacaggagagaaatttctttttagataaaaagcaaataaagtcataacataaaggatttgaaatgcttttcaacattcttttgtttttcagtgcaattttactgtattgtgataaatattgtttaaaaatgaaaaccattcaacctttatacaaattaaaaagaataaaactattttcagtacactcagttaatgacaacatttagttcctgca

SEQ ID NO: 121566 - DNA, 1054 bp, Homo sapiens
ggccataacatttcaaattaagcacatggagtgatttgtaattttgtgttaatttctccctaagatgttttgttaaaatgattttgtatataataaatttctaagttgaggaaggaaggtaaaaaaaattcctgataaccttttctttatgaagtctgctaataacaatacctagtatatacttagaagaaccagccaagaaaaattacctttcagcaaccactctttacttatttctcttttgtaataataccaattttatgacccaggattccccagtatttaacggaagtaagattaaagaccaaagcacaaaacctctgttccttgcaatatagtacttcgtgtttgtaatcaatgtgtggtaaatttaacacatttaccacttactgattagtctttgggaaaagaatggtggaagtcattcaatgaaatacctttctacctaattggttagacatactggcagcacagtgtaatgaactggcctggagttgggaaatgggaatttgaccttcattcctgacaggaagtagaggaaccccagcaaagtcgtatctcagagcttcattttcctcatctgtaaagttttaaaggttgattaaattatctgtgaggtctaattctgttcaaatagccagtggtgataatctcatttgtatactgtcctctgtattcatggctcaactttggcttttatatttagtccctaaatagaatacatcatttaatgtgtagcttccagacaagctgtgtcttgcggccatgacctgattgttgttaagtgtgaggttttctgaacccttagcagaaggacttttaatgtttttacaacacactattgtattgctataaattgtgaattgctttaaaagtacatgtttactaataaaaagaagtacaggcacactttattttattgtgctttgcattattgcactttgcagataactggtaaccatgcatccagcaaggctgtcagtaccatttttccaacagcaggtgataacttcatgtgtcacattttggtaattgcgatatttccaacttttaa

SEQ ID NO: 121567 - DNA, 6522 bp, Homo sapiens
tgttacagtgggatcttaatcatgataatggtggcacacatagtgattttgattgatatatatatataatcagtatttcctaggattatagtcatttgccatttattacacaaggagataggacttttcaaagcctgtgaaaactgccatttagttgtttttaaatcctctttaaacagttctaagaacaaagtttttgaccaagagtaacttatttctaagttaggaataagaaacctttagtcatcccagctttatactcaatcacaatgttaacttagataagtcacttattttctatgagctttacctccctcatgagatcgttaagaatctgtctcttttaattagaaaataaataagatcattgaactattagtgttttctaggttcttttttctcattttaataaaataatttggattatgtcattacatataagtataccaatggggccttactgacaagtttgagagtcaaacaaaaaaagaaactccatatattaagtgtactgttgttcccttttaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaaaaaaaaaaaaaacaaacttacgagacacttcacttctttaaatgaatatatatatatatatataaatatatacatatatattttaaatgtttgctatttattgcccttagataggttatgcattttcacattcatttcattcactgtttgaaacgaaagaaattgatctataatgaattcctgatttatttatagaaaagacaattctgctacactctttaggagcataatattcctagtgatagagcatttcatgttaaaatgaattatttttgaccaagtgaggtacatttctattgatacaagtcatgcccctaaaagatagatgttatacagagtagcagtgaattaagaaatgtttcctctaaaagataaatataaaatttccaccatttgataccctaaacagtttaattttaattatagaatgttcatctacaaagtatctagaggaggcttttgctttattccatttctgccaaacaagagaaaatgtactgatgaagggaaacatatccacattggaaaacatttgactgtctaatttttcagaccttgattcttatatcactcaatctctgtttattgtgccaaagactgagaatcagtgcagtggaaagcctgtttttgacgtcaggacagcatacacttttcaatattggaaaggctatatattctaaagagcaagttattaaagagttatgctgagatatatctttttttggtactaatagaaaataatgcactggtgggtcctttgacagagatgttctagaggaaatgtttaagtggttaaaggattcaaggaaaatacaggaaaaaaggtatgggatttgatgtttacttgttgatctggattaatgtcatttctaaactttagacatatctaatagcctaaaatgacttacaaagaaacgtgtctgtgtgtgtatgtgtatatattgataaatgggtataattaaatatatatacaaacacatacttatatactattacccaggtataaattcttttttcaggattttttagatagcagtagaataaaaataattttaaaatgtcatactttatagtttaattttaagggggaaattggttattttcaattattaaaggttaaaataggccaaatcactttttatgcaatcatgttttatacagtggtctcattgcacattgtgttttttctgcactttttacggtatccttatcatgctggtatgtcaatatacaccctaaagaaaaactccatttaatgattgtgccttgtattctattattttttgcatcattagtaaaattaagttgtctattgtaaatgataactatatgacttaggagaatgtattgctatatgtactgctatggaaaaggaaagcagttatttatttgtttatggtacagttagttattttataccttaaaaaccaacatacttaccatttctattgtttaaaaattactgtccatttttttaaaaatttaaagaatgtagtattttctgaggactggtatggtacaaaaatgtaatcaaaattttcagatactacatttttaaaaagtgaggatggggaaaatatgtatcagcatgaccctgatgtagaaaaataaagtctgcaattgaaccttggcaaaatacattacataattatttctgataaggataaatattagctgtcatttaactgtcgtgaagaatgaaaaagtgatacatttgggctttttagatcatttgtaactaaatttgtacagaaattctcctgtgaaattaagtaaaccattttccagatcttgactgcattgctgagattttgcagttgaaaaataatttcaaatttttcaggttttttgtatatttatttttttctaacaaatatatttaactataaaattaaaattcagtagttaaactcttcataatgcagaaatggatggcttgattgtatagaaaaatgagtctttcagttacaccattcttgaaaataatagtgtatgtttgaaatttgtcattaattagttgcttttgaaggcaatctatttgaaatatgtaatttcctgatgttatctgcattgtgttaagaaaaaaataataggctataaaatcaatttttgtaaaaaaaatgtacagttttaagttgtgtacagaaaaaggaagagcgtacacagtcttagagtggaatatacctctagtacagtgtatgtgttaattccaactcaagcaaagaaatgagtatttaccatctttcctataacatgtaaatgtattattcctgttctacagacactgtatatttatgaccttatttggacattattagacactggtttcttagtaaagcacagtaacttggatcagattctttgtaaccgaaacacttaaacatgtattagtaataccaatatatttagattttatatttttataatttagcttctatgcattacagaagttgaattaagaaatttaagtcatcaccatatttttgttttctttaccacttgggaaaataatcctctttgaggcagtaacactatgtatgtactgttaataggccagaaagaaatattggcagttgtcttaggtaagcaataaaaacatctccaatttactgaaagttcagaaatataactcttacatgcatggaaagtgtaaaccaatttaggtatttctaagtacccaaccctagtattctctccctcaactccaacattctcaagtcccagatgaaaagtttcagtggagcattagtttaaatatttagtctaatcagagactcacagccctgggcaatagatacatagctttttaaaattttatcctttgtgacctgctatagtggcattggactattttctgcatgtattataaactaaagattggccttatttcaattgtttttattgcacaacttcactacaaatttaaagactgctggcattattataaaactgtcttcctccaatccaagtaaataagtatgtggaatatttgtgagctggattaggtaacatctgagacttgggattgactaaatttagttatcacttggaaatgaattacataagatacagtaatcagagaaaatatctttatgcagcatgtatgttaacatctagaactgtccctcatctgcagtgcagtagaggaatcagacattttaagaaatgtattcaaatatttttatcttatatgttagcagcatttacatgttttcagatatgatttgtaatataaattaatttctccagttaacaatgtttacttcaattctgacattccattttatacatatatacctactgtatatctctctcaaatgtcagctagaagcaactttttcagttttctatctaatgaaaacggatatattctgaatgtttttgttacctgaaatttatttttgagtaggttgaaaggaccaagatacttgagtgattaaaggactgtaagtgttctgcttatatgcaggagttacatgattttaaaagtcataataggggaagtagttttatcatctgattactcctattaacctaaaaagtatttctaacataacagattgagcagtggttttgttacacttaggcaagaatttattttcccattaaaatttgaaaaatacacttttctttgcttctacccttgcagtttcccttagttcccctaatttccaagtgatctgaactaaaattaatattacatttactaagaaactatttttgttaattatactgagcaaagtttgctccaaatgaaaagtcattacgaactatgtatagtacccaagaaaaggtcaaattgagtcagaagactgtaagtaccacttttggcgctccagagataaaccttgtacacactgcagtagaacagtgagtagaaaatatgagctataaatagatattatttttagttttgatagctctgtgttgaaatacttttttaatgcagataaaaattatcaggaaattaaccttatggcacagaccaaatacttagtgcatggctgagtttctacaattcaaggagccaagaaaataggttcaagatggaatatagtacatgcatataaggcagatgcacacatgctggttactttaagattgtgtgtgttgattagtcacaatgatagactataacatgagacaatacaaagttacatttttggaccatattaaaactgcaagaagacaggggtcttactgaagatcttttagaaaacttaaatcctgtcacaggatatttagacatgtgtagaatgtagctcaatttttaaaaagtaactgacctagagggtgaaagttgaaactgacacattttcaaattaagattatgcttattttgtacagaaaacaatgtttaaacacaagcagatctgttgtatgtaataagtaacacagagttttaaaacaaattaattatttagctttattgaagtttgtttttttccttccgaacctggagtatcatattataaacagcagtttcacaccagaatagcagtgccctttctttttgtacatactgattggacctttctttactgttacgtggacactttctatgttagttttgatgcataattctttgaatccttttatacaaactagaatgtatgtgtaagaatacctgtccctgcaatgtagtaactacaaacttatttttaaataaatagaaaacttgtttttctaagctattttgtagagcctcatgatttattatttgctttttaaagttttttggcatcacataaagcacttagtacataatctcaacaagctgcttaccaaagtggtcatatggcagataccattatgtaaatgctggttcattagagtttccagtgccctgtgtgttttgcaaagtgtgaaaactgtcagttaaaagatatttgggtgccgaaatgtaatttaattccaaaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgcaatttctgggaaaaaaggaatgatggaaagaaggttattgcagttttcctagaaattttgtcagattggcatgcatttttattgactaagaatcccaattttagcatgaagaccattagatatgaatac

SEQ ID NO: 121568 - DNA, 1048 bp, Homo sapiens
ctttactattccctatattgcagaatgataatttgacatgcaagttcctatgatgtggaggatttttaatcttttaactaaagctatactagtgtaagtgcttaaattcaaactgctaaatctatacagtaaaacagcatttttaggatagtgatggcatcatgctttccgtcatataactttagcatttacagcgatccttcactaaatattcactttcaaaggctcacaatcatatgaaatccactataaatctcatattttaacatatttcataatagtacaaatattgaatccaaaaatattataaactgttttattcgttcacatagagctataagagtgactgacaatactattttatttacagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaagtaagactcactttctaaattgaaatgtatatgatgattttcttaatttaagcttttactttgccaaatgcaatatactgagttttagtaattcctagcagacactgttgtttttgccttctttattaatttcctattttaaaaaaaagtttttaataagaagaattaaattgaggtttaggtcattatagactaatgcttaaaaatggcaactctgatctaaactacctgaatttaaatcacagtacccacactagctagcaatttgccaagacttgccttcgaaattttgaaatgatgggacagcttctaaaagggctgaaactattaagagtttctagttggatacgcctttttcctattagaaagtagctttcctaagaaagctttaagcatccttcaggttttgttgtcttgg

SEQ ID NO: 121569 - DNA, 1050 bp, Homo sapiens
cagtgtgtaaaggaaataattgctagttaatcaactataaagtataatgacatctaaaatgttttatgaatctggtaaattcttgcctcaaaggatgaagagaaagatgctgatgtgccaggaacttctactcgaaaaaggaaggtaatatagttttagttttagcagaagtactttatatgaattaaaatgtattaagagctttctttatttttttactcttagcattttaaaagacattaagtatttcaaattagtttcaattacaaaatgtatgttttttagaacttggtgaatattttcttttgtttgaattattgtatattacccaattatctaagactacattaaaagtacaaattttattgtgtaagtgctcttttattaatatatttgaacacttttatcacaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagtaagtatttttgaaaatattttctttacctgtcagtttgctacataccttttacatgacagttggctattttagttactttttatgattatagtttatttctttattattttatacatgttctcattatccatttggctacatagagaatccaaattttgaatagtgtggtaaaatggaaggagccctgaatgaagacactgtaagaattgggttattctgttcctactagttgtgcagctttgagcaagtcccttagttttctcatctgaattttttttttctttttttgtcttccctacactgattccatgaatttattatggcaattatctagaaaaaaagaataatgcctacgtccttacaggattatggagatgtaaagagaatatataaaaatagtttttaggctgggcacggtggctcatgccagtaatcccagcactttgggaggccgaggcaggcagatcacgaggtcaggagatcga

SEQ ID NO: 121570 - DNA, 1112 bp, Homo sapiens
tggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggtatgtaatatttcattattattaccatattgatattctctatataaaaaaatttacatattgtagttttcaggtaaaagctgttgtgaa

SEQ ID NO: 121571 - DNA, 1851 bp, Homo sapiens
ttgagataaagggatacgtttgagaaagtcaaaggttagatttgaatgcagtatgttacagtgttaataatagaatggctttgccaaatatagattcaggaatggccaactgtcaattacggcaatgtatgtgtacttattaggtctgatatatgtatatataatttgtttctttctcccggtgaacctatgaataaaacaatacccctagaatttggcagtgtaaatgtagacataataaaaagtgagactctttatgtcagctacactatattgtttatgaaaagacagtggcagactaatgattatgtagattaggactttttaagtcttaattcaagcagaattcttcttgaattattttaggcatacaaaaataaatttacaaacttatctatttattttagatattgcctcagcatttgtggcccccgtggatctgcaagcctatcccatgtattgcacagtagtggcatatccaacggatctaagtacaattaaacaaagactggaaaacaggttttacaggttagaaccatttgatgtagctactatcaaaggaaagctggtgatctttccacccatttactgatctttagcagtgtttctcaactttttgtatataggaatgcacataagattatggggattatgttaaaatgtagaatcttattcagtagatttggagtgggacctgagattctgcatttctaacaagtcccagtaatgtcgatgctgctggtctttagacacttaaaatacaattcctagatcctagatacagtttttcctagaggctgacatgatttgatattcactgtctttatattgtattttataaagcaaggcaaggtatttcattttctcctagataacattaaaatatttgttcattgatttttaatataatatataataaaaattttgtattcgtattatgtattttgttcttattttgcctgtattcagcttatcattacttataacactgaaatttgaaaatactcagtttttcatagttgtagtttagcatgaaaaagaattagagttaaatggcccaggcataatttcaattaatttgcattatctaggtaattttgatgaatgtctttaatcgtcagtaggctttattattacctaaaatgttttgtcaaaaaatatgtttatagtttttaaataatggaatcctgtttttagttttaatttttatcatatgacctttgcttagcagtccaacaatttaatttgtgtaacattgcattaaaagtttttgtgaccagttatttattactgaagtcctttccgttattcttctttttaacatagagaagctttattcatattttgtattaatatttttctatataaaatgtgcctttggttctttttatgacttaaattttatttctgtatctcattgtgaggggctatcctgtgcctgtacccactagatgccagtagcagccccctagttgtgaaaaccaaaaatgtgttcagacattgtcacatgtcttctggggagcataattgtccttgattgagaaccactggaataaagaaaactaatatattagactttagtttctaaagatttttctgatcttcttaggtgtacttgctgttgcttccttgatatttgtcaaaaagcgtagagataaggagaagtcctccctgctatgtggttcccaaccatcccaccctcaaagcattcttcaagtctttttcaatatcaggtgttggaagtttaagagaaaaaaaaaaaaaaaaggaattcctaactatattcctctttctcccttgaccccttaaattgctaaagattggaaattaaacctagtgcttcagagatga

SEQ ID NO: 121572 - DNA, 1063 bp, Homo sapiens
tattgtaatccaaagtcagagaaaaaataactgttggagaaaataacccagtctcgtagacctcagaaatgagaaaattgtcatactgattagctaagattagttctctgcaggaattatcactttgaaaatttaatgccaataatatatttttttttatctcactgctaaattagagctgtttaaaattataaaatatcttaaatcaattggtaaccatgttacatggcttatgtttttgttttgtttctctcatttattaaaaagaaagtttgaatttgaactcacattgaactgttgtgaatatgatagcaatgcagccagttggtgttataatgccttggatattttttaaatgaataagtgatactgattcactgttttgtttcctacctaaatatattgaagggtggttactgttgttgttctatttggatacacattcatacgaacctatagagtttaatcgtagtttgtgatgagaattttgattgtacacaaacagtggcgtattttctagagtgtatctgccaaaacttagtctaaaggaaaaattacctagcacgtttctagattttgggttaccgcaaccctctagtgattctctcagctaaaactgttaaagattcaagcatgcagaaagcataccttcataatttatgagtaataagcataagcatcatttgtcagttttcataattctctctgttcctacattcaaaaattgaagctttgattgaagtatttctagaaaatgtcactttagttcagttttaccttgtgtatactttatcaaagtaaacatggcaattatgaagtgattcagaaaactttgaaatttgcatattttatagaaatgatttctgcacatgtacttgattacagagcagattttcaggtataattttggagaagtaattatttagagaattacttatagtatcatttaaaaattaatttaaattttagtgacccttaaaacatactttcctttgttaaaataaagagtatatttacaaatctatacaaaatatactttaattttgtgactgttatttttaca

SEQ ID NO: 121573 - DNA, 1639 bp, Homo sapiens
atatgtgaaagtacatttttcatttcaatgttttctgcatatgtacaaactacttgctaaaaaagttaacaacaaaagtggacaataaacttattagtcaacgttattatgcaacatagattaacttattttgattttaagaataaaatggtgaaaccagaaaataacttttcatcttaacttataagtgtgtattcaaagtaatgttatttagaacactttggttatgatttagtgatgttaagacaacttgagagaaaggaggagggagaaaatattagaatttctattagctgaaaaggcattagattttctctttgcaatttcagctgataccctgtatattggattaaaggaaacacatccaggttgtaagattatgactttattttttaggtttattatttccgacaaggacatgaagcctatgtcgaaatggcccggaaaaataaaatatatagtatcaatcccaaaaaacaaccatggcataaaatggagctacgggtatgacattgatttattatttaatagccccaaaaatacaattatggaatttggagaaaattgtatcaaaggttactattaacacaataagaaactgcatcatgaagataccttgtttaattgaagcagtcctagagagtaggaggtgtttaattttcatccagagaaacacaagatttgactgaatttatatactccaatgcagtttatgggttgggtacaaaatttagttatagtgaaaattaggtaataagtctaaagtaagctttgtattcgtaaatttgatgcgtatttctagatttgtcatcagtagttcagttaccaataggtctttggaatggtgatagaaaacttactttagtaactatactttagtaaagttctccttatttttttttccttttttacgttttaaaaatttcattgtaacttgcatactataaagtgcacaaatcttaatacagagctcagtgaatttttacatgtacacagtcatcaccatccagatcaagatttaaaccaagaagttttttctcaacaatgtttagcagtctattttgtggtttattttgtaaagatggttccttatattctctgtctctctcaggaacaagaacttatgaaaatagttggcataaagtatgaagtgggattacctaccctttgctgccttaaacttgcttttctagatcctgatactggtaaactgactggcggatcatttaccatgaagtaaggactgttgaaagaggcaatggttttcttagtattgtagattgtttttcaagattcagatacatttgaacatcttttaggtatttttaggtatgtgacctaatcaatttgtttctgtttgtaattagataccatgatatgcctgacgttatagatttcctagtcttgagacaacaatttgatgatgcaaaatacaggcgatggaatataggtgggtaatttatttagaagctatcgatgtttgatgtggtttttttttcttagtaagtgatttactatttttcataattgagaaaaagattatcagagaaatctttttgctatttgtaggaatgttaatagcaaagtaagatactatgtcagaggtattgttaagttttgtttaggaatgaaaacagtc

SEQ ID NO: 121574 - DNA, 1050 bp, Homo sapiens
attttttctagaataagtgttttgttgcttaaaggatagtcatctctcagtagacacggaggattggtcccaagacccctgcagataacaaaatccagggatgttcaagtctcttataaaaaatggcatatagtatttgcatgtgacctacacacagtctcctatatactttaagtcatttctagattatttataatacctactacagtgcctacacatcattttatttgtgtggattcaacatagtattcagaatgtagcaaattcaagttttgcctgttggaactttgtggaattttttttccaaatattttcagtcaaggttggttgaatgcatggatgtggaacccatggatacacagggccaactgtatataatattgtacaatggtgcccttccccttttatttaattatctttatagttattttaaagagtagatttgtggattaatgcttttttgattattacttaacaattattacttaaattttgtcagagattggctgtgggagaactaactgaaaatggtttgacattagaagaatggttgccatcaacatggattacagataccattccccgaagatgtccatttgtgccacagatgggtgatgaggtactttaaaagttttaaattatccatttttcctcacatagttttaaacattttttaacagctcttgaaatagacttctggaaaatagaagcagttttgtaaagtatctcattctagatatttgtatctatgtatggagaaagtacaattaggagtgaaagtctaataatcttctttgaagctgctgtaaatctgaatattataagaatgaaaattttgttagtgttttaaaaagaaatgtatgttttagtaagaggtttttattgccagctttctttttctttttaaattaaaatatattcatttatcttaaggcttaatgtataacatgttaaaggaaaaatgaaatttagcaatttgttttcatttaattttatttcaaaaagtgttagtgttttgtttacccacagtgttcacagttcattagatct

SEQ ID NO: 121575 - DNA, 1018 bp, Homo sapiens
tcccctgggtaggaacacttctgactctgccagttcaatatccagctaccctgagagcactagtactggaccataagagttcccctgtctggaactcccacctccccttaaaaaaggaatccccatatctccttaatgttgacaccttctgtgctctccagggttatctttttgctgtcaatagaactgagaaaagtgaccccctcttatttttatatgctcacagaatttgtaacatatgcaacactcagaagtcagtatttttcttaaaatcttggaaggtacttaaatttgttttttcacttaaagttgtgactttatgtatcttcaggttttgggggagtttttttgcgatatttaagtaaagcctatagaatttcaagaaacttttgaagatgagttgaaaattagggaagtttttttgtagtttaagtatttgttctgtcatttctctttattataatctttcttttcgtttttataaaacaagtcttaaaattttatcttgtgtgttatctaataatcccttctctccttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaaggtttggtttttaacattacaaatttggtgttttctagagaaacagtttaaagcacacatcttgaagtacaattgatcacaaacattgttgaagtgtatcagcaaataataatagaaaaaactcagaaatacacagtagtaaaaaagtttacctaaatatatttagtttattcgagtttttagatatttaacatgtaaaagtatttacttacaaaattgccatattctaaacattgaacatttaac

SEQ ID NO: 121576 - DNA, 1017 bp, Homo sapiens
tgtattttgcaactaattttttaaagagaagcagctgactcttttattattttattattattatttttgagacagtctctggagtgtagtggtgcgatctcagctcacggcaacctccgcctcctgggttcaagcaattccgtgcctcagtctcccaagtagctgggattacaggcatctgccaccattcccagctaattttttgtgtgttttagtagagacagggtgtcgccacgttggccaggctggtctcgaacccctaaccttaagtgatctgcccaccttgacctctcaaagtgttgggattacaggcgtgagccacaacaccctttgcaactaatttaaatcaaattttaaatatcccaatatgactgatattataagatatcactgatattttctgtaatcataaaatgttattttataaaattatgcaataagacatgtattcaacatatcttaggaaggcgaagtagttgctgtcagtggtggaacatccgaagaagaagagagagcatggcacagtgatggcagttctaggtaaatgaatgctttttatttttccaaatgttatataaagtctttagaaaggtgtttttttttttaaccagcaacacgtttcaaagtctctgtaagttcaaagttcttcagagagtttttgaagttgtatgaaatgtagattttctgatatatgttctctatagaaaataattttttggtgattgcaactagatctgcaaaatgatgcttttaactttatcatcttagtattgtttcttctgaataccgttataatgttgaattgcaaaccagtttcattactggttttgaaaagtatgaagttaagaaagcaatgcaagcctcctgagttaactatcttatatagtggaatttatggaatactaatgataagaggaataagctctcctttttcttgttatgcctaccttatttgaccagaccagtgaggattccttcaactccttatactggcgattcacattgttgcagagctta

SEQ ID NO: 121577 - DNA, 1050 bp, Homo sapiens
gtcttttatcatgaatccttatgtctgtcattaattagaaaaaaaaaaaacagcatttttgtaactaatcaatcagcaagtaaatatcagcataaccatgataagcctttaacttgatgaatgttaaaatatttgagttggtactataacctcatccatttaagtgatatcttaaatatgaacaaatgtttttattgttgttgtatgttaggataaattgtctcactttgtcacccaggctgtagtgcagtggtgcaatcatccctccctgcagccttgaactcctaggctcaagcaatcttcccaagtagctgggactataggcatgcgccaccatgcccagcttgaatttttttaattaaaaaattttaacttttaaactaaaaatcctgctctttaaacaatctgtgaataaatttaatttatttttttctagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgtaagatatcagcacattcataaattagatgtcatttttacttatttttttaaatatgagtttcattcttcgcatttattgatatgtttgtagatgtagcttaaatatggcattttggggtcttatgatacagcttttattttctaaaaatctatttctaggcatggcacacatacacataatttcaaatccacaaaataaactcgtgaattaattattctcattttatagataaggattctgaggctcaaagatatttagactatacagtcacctattaagaggtagagcagggattaaatgcaagtttgttttacttgaaagccaagctttttaagtggtaccatgaagctgtagtgtagtgtaagtataacaacaaatcaataagtatttgacaatttttgttagtttttaatctctgtaccagtttacagctttctcagtgtaatttttaaatattcctcatgcgtcat

SEQ ID NO: 121578 - DNA, 1528 bp, Homo sapiens
tgagttttttcagtcggtgaaacctgacctccctgtctctggaaagagtgtagttctttcagggctttccgtgtaacctcagggtctgttgtattgaatttttaaagagattccagctatctatatggaacagaagattatcaaagcataggccctatcctaaaaaaaaaaaaaaaaatccaatttctcactcttggaaaaattaccctaggaatcaccacattcccagaatctaatacttggtttgccagagaccatagcaggaaccagtagtatcaagttggggtagacagagtttgtctttccattatttcagtcatttaatgccggatgtcctgagcccacaacctatgaaattaaacttagaaatctttatcacatgcttccatcttaaaataaaacatcaggagtagcgttcctttcctgatacctaacattccttttggaggaaagttatgtgtaaaattctagattaatgcatatggcttttgtctttcagtaggcaagaagaatggagaactgcaaagggagaagaagaaataaagacttacaggtcagaagagaaaagaaaacacttaactgttccaaaagagaataaaatacccactgtctcaaaggtacatattaattattttgatgtttaatatttgcttcttaagtatagtgaccattttaaggctccattttgtaatttaacatggtattataaacaggttaatgataaaaattaacatagtaaatcttggttatctctggattatctattgtttactatttaaaatttttaattccatttctgctttgtagcataccctttcccaaagtgccaattcttacatactcatgaaattctaataaattacactgaagcctcatcaagaactttctttagctcttcataatcttgtgtgccatctttgtacagtctaaaaatagcattttgttatgtttttctatgtgtttttgtggtgtcttgcatctattcattattctagataatcaagtcagctaatgctgctatagataatatttctcattttcttcattaagagaggtagattgtccctaatagttttgacttattggcttttctgtcatcctactctggaaaaactgttgcacccagtagatttcaattggtcatggcctaattgagagagatacgtacttcctgagtgtgaaggaatcacaaatatcgctttttcctttttttcttttcttttcttttattttggagaaaaacatcttagcttgaaagcttcagagccttagagtctgaaattgaggaagcctatgtgaaacttctttttaggtccaagtcactatctaaagcaattattgaaacaaaggaaaaataaataactggccttcttcaccagcttcgtgttccttcctttttttcatttgagttttttaaaactcctaaatcagtcttcttctctagaattcacttttctgttttattactcatctcttcaaaatactcaagtagtccttttttctttactgagtgtatcataccctggga

SEQ ID NO: 121579 - DNA, 1079 bp, Homo sapiens
tgaataaatgaggcagtaaacattttttttaagaaaatgggtaatcagatgtgtcattttaaaagaaaccatgatctaagtggaaaaccttactattgccacttattagatatgtgacttcgaacagttattttggttttctcatctataaagtggagttgtttatacatacctaatggagttaccatacggattatgagtatctgagtcatgataaacacttagtaaaagttagcaaccatcctcatcgttatttttgataaactaagatggacagatgttttctttcctttttttttttaactcccatcatttatagttgatcatttaagtcttttacccaagcaacatttatgtttaattctgaactcataagtgaggttggtgagtaaaatggtttgaatagtagctaaaatattcgtaatattttgtgtggtattgtataggactgaatcaagttttaagtcagcaagcaaaccaggagatcagcccactggacagcatgattcaaagactacaacaggagcaagacctgagacgttctggtgaagcagttatcagtaataccagccgtttaagtagaggtaagcaggtattctattttaagtgaaatatttaaaaatttgaaacagcctaaatctcccacagtgttaagtggtttaaaaaaattatggtacatccgtaaaatgaaatattaggttgccaaaatgatcatggttttgaagaatatttaatgacctaagaaaatggttcataatgagatttcaagttagagataatgagtttttaaatgtgtatgtcttccacattttctatagtaaacatgtagaatagtcaaagccacattcttgaacatctcatcacccttattgttgtatattattaaactttaagagtcaaaacaaatttatgaaccattaatactcttgggtttgtctagtttgcttcttatgaagttttctcaaaaatacttagcatttttttaaagtaatgattttgtatccttggggcttaatagtctatagttatgattcattgacttatctaatcaactgaataaccatgttttgttttcatta

SEQ ID NO: 121580 - DNA, 2027 bp, Homo sapiens
cagtaatgggtgggtagcatatctagacaatgtggatatgctggacaaagggatgatttgtgtcccaagtgagatggcacgtgatttcattatgcattttggaacagtgcacagttaaacttatgagttgtttatttctggaacagcatttttggagtcaggttgaccacaggtaactgaaaccatggaaagcaaaattgcaaataagaggggactcctgtgtataatcccttacttgtttcagagaaaatttaaagcagctacttttctgatcataatacttaaggtagaaaattaaaatacctatttacaattaattcaggaaaataatattttaaaaattgttgcttaataccattattcgtattcaggtgtttgctttctattagaaatgatgtagactttttttctacaatgatacatttttatttttccagtcttttatggacttttctttttgcagatagcagatcagatgttctttcatagtgattatcggccacttattcgtgatgccaacaattttgtattagatgaacagactcagcaagcacctcatcttatgcctcccccttttttggttgatgttgatggtaaccctcatccatcaagatatcaaagattagttcctggccgtgaaaattgcagggaggagcaactcatccctcagatgggagtaacttcctcaggtaggtgctcattttcttagacaatcaaattttcttcttcccaccgaactgttaaaattgctaattgagtaaaactttgtttgcagttgttaagtggataagaagtaaaagtatgttttatacttttatacaggtctttgatcatgcttaaggattacaagttaattatggaacatgggcgatttacagtaataattttgatttattatccatttgtaacccctagggatcaataaggtagttcctgtatttggtgtgaaacaagtgaattaatttacttactcagcaacatttattgataatctcttctgtctctgacacctgctaagccatggctattcagtagtggattaaacaaacatgatccttgctttcatggaatgggttagtagattaataaacacagttcattagaataaacaaatacatagttcaaattgtgatgaatgttactaaagggaataatagcatgatgtgagagagattgtagattgcctgttcacattgaagatgttttaaaaagttaccaacttttaaaggtttataagaggattgacatggaaagtgttgagagctgttttagtgaagtataatggagtgttgaagaattaaatgagagttaaaatggagtcaaagtctacaaactgctttccctcttttgacaagaaatgcagcactagtgtattaagtaaaaataaggaaaggttctgtaaagaaggttaaaccagttttgtcattatgaatacttctactatatttttagactagaaaaatatttatgaaaatattttaagttctagacttcaatcgacaaaagcttctaagtagcttttgtgttgagtgacttttaaataatgaaattagattctgtaaggagcacagaaaaaatcaacctcaaacgtgcatcttatttttcttaaaggatttagcatgaagttgcaataaagatggacatactggatagaaggggctcctcttggaattagacacgtccacttagaatggagggtgagaagaagcattagaggaatcattcctgctgctactcctagagtagtgcagtccagtggacttatctggagtttgtgagattaatgtgtctcagtacgtggacacagcatgaactcaaagaataagtagtattcgagaagtatggacagatactcagactcagattagataagtttcagtattagagaagttctggtcataggactgaaattaagagaaatgtcttcagtctctcggagaggaattggcaaaatcagattgttcccaagcctcaaaatagatagctactttagggtttcagacacagggaaataaggaaaagactca

SEQ ID NO: 121581 - DNA, 1771 bp, Homo sapiens
gggtagaatttttacctctttcagaacactgctaaagaagttttcaactggaacatagtctgaagaagcactgagagcaaaaaattcagagtggtgattggccacctctgtttgattgacaggttgcagggaggaaacccattcgttctggattaatggaactggaaaacagaaaacaattatcaggtaaaaaaaaccttttctttaacctttgaaattcaccatttaaaagacgagtcagactaccagggaatttattaccaaaaataataaaatctagtgtcatttgagcaatgatctctggctactacttccaagaattaccaaaaaatccgtacagttgctacatgtcagcttttgcagaaagggcatgattgaacggagatagatggagtgtaagacataattatgtgttaaatctgagtttaaaacatgaagcagaattctatgggtgggggagttggtattcttttatttcctgaattgtgtttggtctgtggatagaatactttatttttcaaggctattaatctggcacttttcatgaatattcataaattttattactgtacaatgcttgttttacttaatcttcacttcattaggatgtatgcttttatcttaaaattattgtaataatagtgaccaattcttttcattttaatggtagttttcttactgttggttaaatatatttcagattgaaggccaaggacatggcgcagtatttgactgcaaatgctctcctgatggtcagcattttgcatgcacagactctcatggacatcttttaatttttggctttgggtccagtagcaaatatgacaaggtagagtatgatgactatatatcatgtccttatttttttttaatgcatgtttaggggttgtatgtttttggagtgggtgagaatcagcatctttacattcaggataaaattcgaagaatcttgtgttaagtagtctggagacttagtttcggaaaggaaggtgaagacagcagttaaatctcactttaatagggcttattatttgaaaatctgcatatttcaggaaaaaaataactcttagcctcctggggcaatctagattggaattcttaacttggggtatataaactggagatggaagatgttatccatagtgggactctgaaattatgtaaaatgtttttttaatatagataatacgtacttatctagggtacaaatctgtggctttcatgtggctcttaaaaatgtattatattacctgattgtagttaatgttttttattaaagatcctgtccagtttttggggggcttttttttacagagtaggggtgaaatgtctcactatgttgcctagactggctttgaattcgtgggctcaaacaatcctctcatttcagcctgctaaataactgcaggtggcactacaggcatatgccctgccactttgctcagcagttaaagaccccaactttaagattagtgactaaaagaattaaattgcttacttgtggtggaatggtataaaaggttatgatagtaaatattgagtagtttataatttagtttaaaaaattgcaaattaaccagtgaaattttatataataaaatttatgtcctggttgagtttatattaataattttatatcatctcaaaacatttagagaaaatgcttattaacccttagaaaatcttatgtgatttttatagtaatattacacaaatcatacttactgtatacctaaggatttaagataaagcatggtagctctgtggaagt

SEQ ID NO: 121582 - DNA, 5896 bp, Homo sapiens
gattctttaatattgagaagaaaatcattgttttttccttggaaaatgtcgattttatttctagggtagtacatagtgaccttgaatcacttttgaaaatgttattttgtgacctagccatgaaaattggaatgtttgcatataaaattctaaaaagcccataaagtttcagaagttattagaatgctgcataaataaagatgaatgctgtctttttaaacaagatctctgggaaaagtgcattttggtaaagcatgtatgatttttctttgggggatcggattccttttaatacaggtttgtaagtggcagtcgtgatgggacagcacgtatttggcaatttaaacgaagagagtggaagagcattttgttggatatggctactcgtccagcagggtaagaggtcaaatttgaaatattatgtatatattgattttttaaagtatgttatagtgcaggttggtgactctcagcctataaaattatatatcatgttaaaattactacttttctgcgataactagaggtacaattggagatgagcagtgttgatttttatgaaatgattcattggcatatttcaggacattgcattaatttttttaaggagatgataaaagtactgtaagaaaagttttaactttaaatatttttttcagaaaccagaacatattatgtttcgtttatcacagagggacaatattttatgtccaatggtttcttcaagccaagataaattaaactgcgtgttgtagctgttattttggttttaatatttttctccacttgtatttgtgtgtagtcatctcagatggatgggaaagcagaacagtcagcaggggatgacagcaacagtaaaagatggagagtgagcagcatggcacagaattcctggatctagatagagttatagcagtgatatttatgcaagatcatcttactaatggcttagaagtgctagaattctggaaatcctggatttcctgactcagtgcagggatttttaccatcattccatgttgattcaaacttctcagttactgttaagtgatagttattatgttagtgaatataaatactaattatagattatatgttttggtttttgttgtgtcagtattttaatagtcagtgtaaaacacttcctcactttcagccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatggtgagaaaaaattctaatctttatttgatataactgaagctgactatagaatgaaacattctcattgaggaataaagtcttttatgttagctaaaaactcttgcttgctggggtaacggctttgtgagtgattgggaataattttaacagtgcagttaaacaggtttggcttggaaatatatagtagatatttgctgtttttttaatatgaaaagatccatccaccaagccctggacaatgatattagctcagtttcattattatatatacatgacaaatttgaagatttttgccaatttaatacttcttaaaactccatttctagaaatagtgccatattggtatttcattatgtttgtttttctttcttttttaatatctatgattctttgacacttcaaaaatatttcagggtcatgaagatgaggtatttgttcttgaaccacacccgttcgatcctagagttctcttttctgctggtcatgatggaaacgtgatagtgtgggatctggcaagaggagtcaaaatacgatcttatttcaatatggtaattatcattctcttcattttatacctactaaagatttgggagctttttgacaaaggtactctgcatgtcacaaaggaaatccatttaaaaattggttcattattttgactttaaattcccatcaataaagaatgatttattccacacttttattgacatgctgaatttaaaagaaaattaattgtgcatattacagtgcctgtacattgtgataactgatacagttttatcagttttagcagtgaaactttggaaattcacaagtatgaagatacaatatagagaagaaaaaatacttggaaaaccatgtgaagaaattataaataaatactcgtattattgtacttgtttaatagtcttctagcacaatagaattttactcaagtacactgattttaaaattaaggccaaagaatcaagcatttcttgcttttaatcaattggtagtatattaaatatttgagtttatactcttctcttcacattttgtttcttagatgttaacataattggccaagtatttgaattacaatgttttaatatatcacatacaacttaccgagcagtgtttctatttactgtatgaagtattaaggtctcctcaactactgcagtttgtgtagtcatattttttaaatgtctactttctgtatattagagatacctttcaacaaagaacaaaagaaaaaacagtttccactatttcagcatgtttaaatttttttaaaaaaccaattatagaaatctttagtaatgaaccataaaacaatacaattagtacatgtggtcagaattattttgccaaataaattatttcacaaaacagttgtgaaacatggtttgtgaaaaaattacacgaatgtgatgctatgcttgattgataatcagagtaaagttatttctatgtcgtgagtaagcagatataatagcagattttttagtgagggaaatagctttagctatctttaaggctgtgccttagaatacattaggtaagaaataaggtttgtaaaaccctctatttctagaaaacagtgttaattatttggtgtgcacttgttagtgatggatggatttcctttgtgattgtattgagatttttttaaaaagccacctgtaaatatgctagtaaaaaatattttctgcttttctatccttgtgtttctgatttgctcctttttggaatatctgttgaataaggaaattagtcatttctcaatctgtctttatagcttaaaaaaaataatatgtgagctatatatatactagtggcttcatttagtagttttgtatttccaaaggacattattatattggtagagtgtttggagggaaacttttctcccataattgaataccgctttaacttttcagttatataaaggtgaattttcccttatcaggtaagttggtcacactaatattctaccttttcagtagataacaaaaactgcagcaccttgagagttaagtgatttgctcttagaccattaaaaattagtaatgtaaccaggagtagaagtcagccataatatattgtatatttttaaaaattagctgagggattggttacattactgccttaaaaattgtttattgttaaataagagtgttagatgaggatatttttctggttctttttatggataagagataggaaaactctaaagagcagaagaaacaaatacatgtaataagttgaattggatagtattcatagaattgcagacagtgagcaaaacataaaccaaaaaagctaaaaaacagaaagtgagccacccttcatctcattaaaataaagatactacctttaattttttgtatgatgtttaatggtttccaaaatgctcccacatattttacctcctttgggtctcatgaaaaccttgtaagatgatcaagatagattttattattcttggtcttaggaatggagaaactgtacattacagagataaagtgctttgccccaatttactgagttcacacagctattatgcgggcacttggagcataaacccatgactctggttgtactcaaatcttgtcatggttggctttttgagcttttgtcaatgttactgcatagctaacttttaacaatactcagttagtgatatgtctatgaagaaatgttttcataatggtaataaatctgagtggatcttttgacatcttactctttaacttgattttttttcctgtctgtcttttatgagttatctaattgccctaattctttttgctcttcactcttttgttcttttcattgcttgttttatttatgggcaaatggaagataaagcatccagcattgctattaagaaaataaagagaaacaattcgagggagggcctgcgttctcactgcttgctatcatgaatgttgagttttggctataattatagctatttggctctctgtagctaatcaataagtttttcagttactaaaataccacgatacttgattgcatacaaatttaatccctaatgttaagttgtagtagtaatcacaagttcagtttagtaaatattttttgagcaccatgtgaagggtctagtcatatatagtgctttggtctattagaggatgaagaattctggtggaatactccttttttgactagaaatggtgaaagttatgtgaagtatttttaagattaaataatatttcatgtgactgttaaaactgaagtttataaaacagataagtaaactcaccattccacctacagctagaaaataaggaatgtagactatacctttagaataacagttttagtacaaatttcttaaatactggtttttatcaagtatattttaagaatactttaatatttctcctgctttttgaataataattgaattttccattggaaatttatacctttgcaaaagataatggaaatcatgtaacatataatttagtattttgtattcatcagcattttactgcattttttgtgtaattatggaaatgtaaattctttttttgaaattttagaaatagccaaaaatcctgttatgttaaaaagcctttcaagtgaaaaggtgaactttcaaatgcctgtttgatacatagtaattacattttaataatttttaaatataagattataaaacattaatattttaatattgcactgatagtcatcattgtaataagtattctaatttttttctgtatcaagccatgacttatacttttaaaaatttcttgtgctttattttgggaccatctaaatttgtcagcaaattaaagagtttgagattgggaattgagataaagctatttagttcttttatgtttaaataatttacttcattctgaaatcttataaatggattctcaactttcaagtagtattctccagagaaactgaggggtttatttttcttgtttttactgctaactttcctcctaatagaggatctcaatgataaaagcagttggggagtgggtgctgggtttgtttttgttacttataagaagtatatgacacgtgagatgatgttttaaaagaggctaacatagggcatgaaatggaatagacagtatatgtagcttgtactccccctaccctttctgttgtctcatctttaactaaaaacttttaaaagcacttattgggaaagcctttgtggttctttttgttgttgttgtttttcttttttaagtgaacaggagaagaaaccaaagagaattttgtagaaaatattatgagacaactttattctttaaaaacaaacaaactacattctaggccttcagtacttttatttctttacgaatcaactgaacagtccttacataacttgagtattcagaggaaatgtagtatatatttggatattttactgaagcaagtagtgtatattaagaatattccaaactataatagttgggtataacttagtaagcccacatttgtttggcattggcaggaggtaaacatcagaatagctttgttttgatgagagttgttctaaactctaaaggctctatactcccattaaatgctaaaaggcagat

SEQ ID NO: 121583 - DNA, 2525 bp, Homo sapiens
ttgcattctgtatcagtaaaaaagataattctctttgctcagaatatatattaggttggtgcaaaaataattgcagtttttgccattattttaatggtaaaaagcttttttttaaaaaaaaggcaaaaccgcaattatttttgcaccaacctatagctcagaaatattttatgtatatacttttttccagtaaatgatcacaaaactaaaactgctctaaatttgttatatattgtgaaagttatataggcttaagctctaattatttttgcatttcatcaaatagtgtagaagaactatgccaaaatgtacagtaagtagggcttcaaatataatcagtatattggaacattacatacacattgttaaatgtattagagctggtgtcatgataaaaatcttcattttctctaattggttgactgtaacattaaacatttaatatcagtagtattgatataaaatatgtaatctgtaatacagttaggcaattaatgtaaatacagctgtgtgtaacctgttttctgtagactgctattttgaatgagcattcattgtagttgacgtaagagtcaaagtatcttcagattttcactaggttaaatgtaatatccctactttttggggtcttaaaagacatgttttatcacattagtaggtcaaagaagggaaaagcttaattaatgtaaaatactgaaaaagttcagttattgatggtatacataaggcacagacagcacctattttgctaatgtattcatgtttgcgaatagcttagttccttatatgtttgtacgttgctattctatatgaaaaactgagaacatgttaaatttgattagaagtaagtgtaactagtaactgcatgtctggtgtgacagtgaatttggaattgttccatgtacgtattgttgtgtaataaggagctcctacaaaatctatatctagaatttctacaagatcttctgatttatgacacataatgatttctaagttgtttttaggaagggagccatctgttgcttcttaattttgtccttctgggattattttttgaaacagattatttctgctgctactggttcctttaggatatttttaattctttattttttgtattacagcccaagacctgcaaaatttacagagcgccctcggcctggagttcaaatgatctgttcttcttttagtgctggtaagtttccctcattctaattttcgacttaaagttgttcatttagaagccttatagtggagtgtgtaatatttaggaaaatatttactgttgtattatcaatcatgttcttatacatatgccagagctaataagtaactgagaattattataaactaacttagaaatatttcatttatgcaagagtttagtttatataatcacatgactgtttttctttaagaagactataatgttctagtaggagagaataaatagtttcaaaatcgaccctgttaaagaatgaatgtttaaatagttgtttcattgtaagaatggtattttaaatctggtttatgttttcatggattttgaaggtattctatagttaagtaaaataaatttgattcatatttgtacatctttatcagttaattcgctacatattgttcttatttgcactttaaaaagtgattgtatagcagtgctaagattccaattcagatttgtgtttatgcagcagcattttgaatggatgttagggtatttttaaacaagttataaaaaaaatctggttatttgtagtaaattgataagaaaattaaatgaaacatgagtagatccaaatagtgtctaatacctgttcctcctacctttattttcagttttactttttccgctcattttataattgtggataggagtattacctgagataagggatagcaaactaatgaagtgagtctgtctttgccatactaatatccaaacatgttcattttctaacttctagatgttcagtgccactgccatggattcagtattccttgtagtagtcatacaaatataggcatcatacatgcatccagaatactctgaatttttactcctttttcaaggacaatttgatttttttaaggggttagtgggtagatcatttagcaaaagtacttaaatattttattatatacaggtattgttttcaatactgtggaagagtgttactcttgagtacactgcatatacaaataactgtaatgcaaggtagaatgaatatgctacaaaacaaagtcttaggggagttctgaagagagcagcctcatttaattgcaaagtttgtaaagaaaagttactgagggagttgggccttaaaagtttgataagattttgacacatgggaaatgagacaacagaaaaatttcagcagaattgcgagagaaatattttctagtgaaggtgactgataattttaacatggtatggttatatattcacttagtgaaattattttttgagcaaagctttacttctataaatattgaaaaattcattctagtcagatatattcata

SEQ ID NO: 121584 - DNA, 1880 bp, Homo sapiens
gcctgaggtgaggttaagggtatgtgataagaatactagacaacaatatggatagttgaccaaagttaagttttactggtctttatagtggttagtaacccatttattttactccaaagcttaatcagaggaactggttttatcgttaattggggggtgttttaggtatcattggcagagtctgatttaagatacagcatttaacatactctgtttggaaacattaatatgttatatttattgtcagtatgatgatttatatgttatatttattgtcactatgatgcagaaagttgtctgaattatatgcctccataggtcctctgagttctttctaatgtcagatatgaaggtgtttctttaagaattagattggaaggtcgttaagcattctaacatgaacccttagtaaaactgtatcctgtaaaatattcagtaattttgcaaaagtgtgtgttttctcttttaaccttgtgttaaagactagaaaatgtggcaaaaatattaagttttgaatctgggaagtagatatatggggattaacgatactattctttctactttcttatatatttaaaattattataataaaaaataaaaatagagtctgaatgttctatctctattttggctatataaaatgggaatgttcatttgtaaatatagatattcataggaaactccatatcctttacaatttctttctggacttacactactatggcagagtaaacaagtaattatgtatttttattgacttcatacagatgagattaatttttttctgataactggctttagataatgtcatgtttttagctgaagatcagtgataggaaactcacagcttcctgagagaaaaagccccaaacaagcttacttttagttttgtattacaaaacaaaatagataatattagtcaccattgtagcttgcatttgttttgcagctatgatttttttttttttatttcagaagttcaatttcttttacagaaatccacattgagggtactttgatagtagatagggaaccaaaggtaaatattaattatcttatcccacttgtcttatttgctggtgagtacacaagtgctctttttaagtggtttaataaagagctttgtgtaagctaacacaagtatttaacactttttggtatttaaaaatatacttgttcagaagtggacagaacaggtagatttatcagtgttaagattttgaattaaaatttatggggttaattctattaatatccattcttactttaagggttctgatgactgtcttgtgaaaatatgggcaacagatgatgggaggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacaggtaattgtcttaatccctatacattgttgttgttgttgttgttataatgtaaagtaaatttaatgaagtcacttttggttattaaattttaagaagttacttttataatcacctttataatccagtatataaggccaactaaaatgaagacaggagtatgtctgctttctttataaatatatggactttaaataacataaccttggtaaattcttgccattttctaactgttgttgttagttgctatttgtatggcaaaaagtagattttattttgactgtgtcactcttgtaaagattttttttctgtgattgtcttttcagttctcaccattgtgcagtggctcaaagagatatctatcttctactggggcagatggcactattt

SEQ ID NO: 121585 - DNA, 1056 bp, Homo sapiens
attcataagaatgatatgaattgtatcagtattgtgaagcataacatgatgtcatgattttacttttgttatatggtctacctactgtagtgtacttaaaattctttgtgtactgaatgcaggtgagaaccaaaattgcttcagttttgggaagataaccaaatgtagtgaatatgttgattcaatttgtgaaatgtagagaacttaatttgaatgaatgccctaaagcattttttttactcagcaaatccctaatgtgtttccgatgtgcgtatagaccagctttctgggagtcatagtctgctacagctcttccttcacttccaacagataatcagtgatgtgctccttatcccttttattccccaaacagctgttataaccatgtctttgattattcttttttgctataataatttgtgttaccacttattctctcctgaccatactattttaacaactttcagctggtctcctttctgtcttagcctaattcacactgatgccaggatgatctttagaaaacacaagtatgatcctgatactcacctgtttgatatcttcagtgaccctcattacacaccacttttcttagtaaaccgtaaaaggcctttcacaaattttttttactttttcatccttatgccttcacctcacactctaaattaccttgcaggctgcttgcagttctatgaactactcacattgtttcacattttcatgcttttgaccatactttatagtcacattatggaatgctctttttaaaataataataatgatattattaaaataagaatatgaatactgtcaccagcaaaagcagtgttagaagataaagctgtaaccatgtgtcagacactgtctcatctcttcaccctcatttagttttgtgacaatcctatgaggtacgcataggtgagaaatctgaggcacaagaagtgtatgtaacatgtccaaagtcatgcatttgaccctgaaggctgtcctctaagctacattacattgcctcttcttgcgtgagactctattcaagcatcaccacttctgggttcc

SEQ ID NO: 121586 - DNA, 3472 bp, Homo sapiens
ctagcttaataaaatttaaggacttccaataatccaagagacatttcctttttactcaaattaattggtctcttattaatttctttagaaagtgaataattgccatttgcccttctgccataaaactataaattaaattgaaccatcttgtatatcttattattaaggaagatttacttatatacttttttaatttaaaaggctctatactcaagtttgagaaatataagagaatttttgtctttaaggtacttaagatctgataggagagatagacattttccaaatggtattataaaaaaatgggagttcatcgaatgtgagtcctagctcatccttctatctttataaaaattatctacctatttgatatggtcaagccttcctcaaattcaacctcttcagttgtacaactactgaactatacttacattttctcctttaaatcctatagttagaaagtttgaaccaccaccttattacctgggaatctacgtatgttctttctgtatgtcttattttttagtgctgttaacacaagtttgtcaatgtttgagagccaggactctgctaagtaccttttctttcagaatatagtcatagtatagatagccaatagttaattggtagctaagcattacaaagggtagtgtggaatatagttttagctataaatatgtttcacctaatgtgattctggaaaatgttgcttgaaaatttgactgtaaagtaactttgaaaaggttattcttttttttcaattggcttccaaaatgaaaatagatttaatcccagtttaggtcaaagattcagtaaaacctgtgtttaagaagcagtaacattttcttttaagagaagtagtttttgcttataaaatactttatcatctccgatttttagatggtctttataacaaatttatcttaaaaattcttacctatatactaatgcttaatcatcgagaaatgggtcttgatatattatttccaacaatgatattttcacacctgaacactgttagtttcctaaaattcgacattttggaaattttggatagagggaattaaagtacaccttggtaatactatcaatgtttttgtggcatgtcatcacttattttcttacaacagacagctgagtctgagatgtgagtgatccttggtgtttggataagatgattttaattctcatttggcaggaaaattgatgtctatggtttttgtgtgattcttgcattaaataagtttggagccaaagcattggaggatgtcttttaccaggccattcctgggcgtgaagaaaatgtgtctggggtctaagctatgattgaaacttattgagtctctgttaaattggtatataaccaacttaagcctaaatatgctaattgacaactgtcaaaccttgttttagaaattcccaagtgttggggtagattgttgcatagaacttacatgctaacagcaagagaaatactgtatcagaatataaaattattgctgtgatgaaagaacatataagcatagtgtaattattctttgaaatattactgcttaggaacctgtaaaggctatatatctcctcaccaggcccaaagattttttgggggtttggggtgggggcagcgggagtgtggagtggttggaaatatagtgtgagccaaacatttattggatgtgaataatataagcaatactgagattcttcataatacaaccaatatatttatgttttatcaactttagggcataattactgggctctgtaccttggctaagtagtattttgtatatatatttagttttctttagggctaaattcgaccgagaaaccctagtgctaattacccaatgtagatggcagtcactgttagaaaaaaaaaaaaaagcctgtattagaagatcatctgtaggttaataatgtgcctgcagatcagtcaacatatatttattgagcaccttctttgtccataagttaccagtatagaaaataagtacagtagtaatttagatggaagaggacattttcagctggagtcaatgtatcaagctttgggacagaagataaacttcagtcagatcttgaataatgattagaatgaatgagttgaaagggagaactaagggagagctaatagattccagagaaggaatcattatacaggtgtttggcaagattcccagtttaattattattttttaataatgcaaatgacgtattcctttatcttcacttgttataaagatgtttttaaatatcattctgcatgtcagatttcgagtgttcaagtgttactgatttatgaaaagtacactgggttccagttttaagtgcctttgtaagaaaaactatttcatagacagcttttaaggaaataacatataaatgctttaggtttttaaagagcactagccagagagtaaataaatctgagctttaatcctagcttcatgccttactttgtgatttttggacaggtcatttaacttacaaattaagttataaagtgagaatgatagtgcctgacttatttcaggtgaaacaatgtttttattcattactttaaagacttttaactagaagccatatatatcagaaagcttctttatttttacctgcacatgacaaattggagtatgtgaattcttaaaaggtgatcatgtaagaaaattaatttccagattacatttattttccttctttttcttggtagcggatactctgttttcaaggaagctgaatgggaaatacagacttgagcgacttgttccaactgcagtgtatcagcacatgaaaatgcataaacgaattcttggacacttgtcatctgtgtactgtgtaacttttgatcgaactggcagacggatatttactgtaagtaattgctaaagtattatttatattcatatatgtaattgaggaaatattgcttataggtgaacttgaagtaaaaccttgcttttttttcttttaataggaaaccggaaattcaggtggtttcacttactctaacagaagagtttagttaaatttggactttatccaaattcagaaagtttctaaatgacatgttgcagcacagtcacagttattatatggttgtacatcatgaataagtatggttctcaacatatatcaaatacacagtttgacattttgcaaaatggcataaaataattttaattttgaactaaggacatctaagtatgttgagagattattaaatgtgcctttttataattgtatgagattattgaatatacctttttatattatctgtagaaaatcacttgcttgtctatgagaaatttcccttaaaatagtgattttaaaaaagctaaaaaattctgagcatatctaatactcttattacctgttattcttaacagttcattcttcaaaatatctgatgttttgtttatagagcctctttgggtttgtttatttgttattgtttcttgtaacctgttga

SEQ ID NO: 121587 - DNA, 1050 bp, Homo sapiens
ctttatagccattttctcaagggtttgatgcctggctttaacgtaacttctgttagaaaattatgattagcaatttttttttaccctcatatttccttttcattaaaacacttttgtggatctctaaaatgagcaacatttcaagtaattttatgccttattaaatactttatgccacacaatacatttatctgatagaaattctgaaatcaccaacaccatatatagacaactatttggacttgtaatgaactaatgaacttggagggtcatttttatagacattactctctgatgtctagtcatgaatatagcattattttcttggaaaatctaattatcatctaaaattggagatggcacatatgaggggtaaatcagtttggaatttgttttcatgtactcttaagttactcaattttagtgtcatggagttccaaactgttgttttacagtgatagttattaatcgtatttgtagaaagccaaagcctttattaatacagatggtggagattaaaatgaaacctgttactgattatttagaagttactcccttttatattttaatttaggaatcatttctgtagttgttaattataaattataattacttttgcattttatttacagaaaacctgggagctttccttccaagtgttttctttaattagaatcacagaataaaactagtcaagaccagccatggtggctcacgcctgtaatcccagcactttgggaagttaaggcaggcagatcacttgaggctgggagttcgagaccagcctgaccaacatggtgaaaccccgtctctactaaaaatacaagaaaaattaggcatggtggtgcacacctgtaatcccagctactcaggaggctgaggcatgagaatcgcttgaacccaggaggcggaggctgcagagattgtgccagtatactccagcctgtacgacagagtgagactctgtctcaaaaaaaaaaaaagtaaaactagtcaaaagaggataaaaaatgaattaagtaaaattaatgaaaaccttctcataaaata

SEQ ID NO: 121588 - DNA, 1512 bp, Homo sapiens
tgagggtaagtaccatgtcttttctttttccctcttattctctagcccatatttggctcatataggtgctctataaatgtttgttgactcaaaattgagtgattaaaatgtttgacattaaaaaaaaccacctaacttaaaaaatgtttatttaaaagaaaaataaattgttattaaaacaactgtaaacattttaaaatatttaaaactgaaaacattatgtcattgtgtgttttctacttgaactagcatcagactggtttccaggaaataaaataggaggaagattaaatactattcctaataattatcatatctaccctttttattagtgctcttaatgtagttggttcatgaaattttttgcttacttcttggaatcatcattttctgtattttatttcagtttagtatttgggttttccttttcagacattatgcatctttatggtatctgctaaattttaaaaacatagtatgtttcaaacaggaggtgcaactacacaccaaaattgaatatctagaaatctggaaagtagctgctgtgcatactgattattttagttatagtattaaagcgaagagagaagctatcatgggtgctatgttgctcaggtgactatttccccttactcttctattcccaatacctgccctcctttttttgtagacaaaaaggtgactacaagattatctttttatattgcaacccagttctttgtactttaactgaaattgggactatcattcattatagttactattacggtgatttatttgtcctgtttctatgttggttggttgctacttgctggtacagtatgatgtagagaccagatggtactgtaggagtaaaccaacctgtgttgaataatttcccagattaattctggccctcgaattatgagtatttggttgtcattacttccttgatacccgtgttaataacaggtctttccattgtggctctatagtgaattaaacattcctccttatatgattccctccgaaacaaaattgaacctgaactatctttgacatgtttctctttttgtttaaaaattcagtgggaaagattacacaaacaaatcttacaacaaagttgatggcctgctttgtagtattatcttacagctttcaaatcaaaactgatgtgaattatttctttatagcatatcattttttcagtccattttcaaatacgcaattgtcattctctatagcataatatacattcatacactgtaatatgcttaggcattagtgtttcttttttatgattaaataaatttaaattccttgcatctttatctctaggtttatttttgtcagtctttgaatttaagctagtctctttagatattttagagttttcctactgcttttttgaattccttgaggtagattgagttataaaaaattagaatgaacgtatgctctatagagaaagtttggaaaacagaacagctcaaaaattaatcagtctcactccttaactgctgtacatacttt

SEQ ID NO: 121589 - DNA, 1045 bp, Homo sapiens
actcagttatattcttttttgtcttggtctttgttttttagtgttttccctgaatgatcttcatatttctatttgacacaggttttgttgttttattaactattttctccctagcccctcccctgcctttctatttcctcccttttttttgcctcttaaaaacaggttagctgtgagagacttgcaaggtgtattagcattttttttttttttagggaaataatgttcattatgccaaagtatcagatgtacaaaatatatatttatttattttttcctctgcttaaatttcttttgaaattaatggttgacaaaaaaaagggggcaaaactttgaagaaatgaaactcccttaggtgagtttaaattgttgcttttgtagctagctgtgttttaatttcttctgtaactaataggataacatttgtttttaggttatagatgtgatgagggatatcccctccacttcatataaaccatctggcaagcaattccagtagtaattaggaatcactagccattttcccttttagtttgcatcacatatttttccagagtgattattgggtttgattttgttgaatactcatatctgtgtaggtgaagcaaattatgatattattttctcataaggtcatgactttttattttgaatttcttcagggatcctttaaagttacgtattcagtgttttcttagacatcttttggacctgggaagtccatgatcagatcaggctgaatagatatttttataaacaaaggaataatttgttcagctccataaggaagcctcggggaaaattgggctccaacaaaagtcttttaaaaagtaaaagaaaactatgttcagttaaattaacttttatggcacatgaagatttgattgtttagggacagtccatatcaatgttagtataaaatacctttgaatttgcaaaacattttgtctcgtctgttttctatagcaactctttaagataaccctacatttttaatttaattttattcttttgagattgagtctcgctctgttgcccaggctga

SEQ ID NO: 121590 - DNA, 1003 bp, Homo sapiens
aattatgaagtaatacaatagtatttttttccaatataattttatttagatagtgaatattgtttatttactgaaagactaataaaaatattagcatttcatgtcatggtttcaaatgccggtataaattaagcagtattttgaagttgttccaaaagtgctcaaactttttatagtgggtagctttattttatgattgaaagatatttaaagcagcagttggaattttgcctttctctctgtaaggtttttggtaaattatgaaattcagcatagatgttaagtgttcttaaattttttaataacaaactatcagttcttaattcttaattattctggagatttactttacatcaaagacgcaaaacaaaatattttatacttggatgaatttttttattgttgctcaaagattttgaaaattaaaatgataaactgaaacctactatatttgtcttttacataataggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagtatgaaaattttctcataggatttagacattatttatctcacttttgtttttgtgttctttgtatgcataaaaatacatgtgtttaataggctgcaagcatgttgtgtggaaaggatctgctctggctgcgttgcactgtggaagaccacctgagtcaccagttaactatggtagcccacccagcattggtgagttgtttgagttcactagtagttaatagcctcttggtaaagagcttttgaaaatgaaaaggttttttagttactgtggtattagagaacttcatattatgtacatctgcattcaaaaagaaaaaaatagattttttttcttagtagtagttttaatagtgaaaaagtcatgtataatgagggattgtgc

SEQ ID NO: 121591 - DNA, 1053 bp, Homo sapiens
catgtagatgggaaggagttggttgagaggaagttagtgtacatactagaatgtggaggtctaatttatagtgtaggatttccgtgcagtcagagaagttaggattcaaagcataagtagagggattggatcttaaatatttattaagagggacagttgtgttaataagagacagaattggtacaggtgtagataggtttacagatttgatagggaagaaacaaagcttcagctttaaaaaaggttctcctgtaaagtaggttaggtcatctgctgagaaaatgaggggtggggaagaggattcttgggaaagagaggataatagcattgtttgttagtctgtttccactgttctttccagagaccctttcatggtggtacctcagggactgctaagaggaagcaagtagagagtcaagcattgagatatgtgttccctgatgccacttaagtaagatactttctgagtacctttactttaatctgttttgtctaaaatttgtttgaagacatgttctaaggctttctttaaaaagtgttttaaaactgttagaattggccggacgctgtggctcatgcctgtaatcccagcacttgggaggcctagggggcgaattacttgaggtcagaagttcgagaccagcctggtcaacatggcaaaaccccgtctctactaaaaatacaaaaattagccaggttaggtggtggggcgcctgtaattccagctactcgggaggcgaggcaggagaatcacttgaacctgggaggcggaggttgcagtgagccgagatcccgccattgtactccgtcctgggtgacagagggagactccgtctcaaaacaaacaaactcaccccaaaactattagaataaagaattataccatgtaaaaaaattttactgcatctatttttatgtgctgggataggtgctaacaaaatgttttgggttttttgagagtggggaagtcagtcgtttctgcatattcttaaatcttcatatatccaactagaactttattaagcacttaactataagtactgcattaggtat

SEQ ID NO: 121592 - DNA, 1379 bp, Homo sapiens
tcattgtataagaattgtgttattttgagtactgtgcttgaaactgaaacattaaaaatgaaactggtcattcaagattatttacattggccttagtataagcagttaaaggatgtttcgtccttaaattaatacacagtaacttttcatcagattcctagatttgagtttaacgttttactaataatgctttaaagagaattttaaaattacacaaattagcacatatgacgacttaaacatcaaaacttgaaaatttgttattttaagcagttaaatgttgtcattttgttgtattttaaattattttttatggagcatccctactttggtttatggaaacctcaattctgaatagagtctcttttttttagcaagatgtaattggtttatgatgaataaaatttggaagcgtagtattgcattttctttttttgtttgtttttcttatagtattgcattttctttaaatgacaaatttgtgttggtatttgtattgataatgtaaactgaattattatctaaatgaattcttaacagttaagtaaattctgaatatgacatattctttgaagcttgtttattcacaattacttgagcaaatagaccatcaagatttttacacttaataaggttctatattaattttattataattataaagaaataataggcatctaagggtccttctgagaatagttacccaggttagaggacttgacttgtactgacttatatgggttctattaagtttttaatcaaatctacgtgtcgatggggagaaaaactaaagttctaataaggaagctgtaacataataaaaatatcagtaaacttggaatcaggagacctgggtttgattactatttctcctattttccaaatgtgtgccctcagacaaactgctgcctttgaacttcagttttctttatgtatgaaatagggagagtagttaagcttatgtgcttatgaagataaataaattttgggaacactcagcacaaagtaagtactctgtttttctgtggagaagctattacagttaaaaaatcagaaaatgcattctttctttaaagattatagatataatttaacccacactgttagtaacagatttataattgtaagcttggatgtttttagaattttaggggctgggattttaatataggccttacacagtaattatcacatagtatttctataaatttatatttatatattgtatattatatattataaataataaaatataattaatgtatatacaatatattgtatttctataattttgtttatatgctacagtagtgtacaaataagaactatattccaataaactggccttttagaactcaaaaacataatagagagcagaa

SEQ ID NO: 121593 - DNA, 3684 bp, Homo sapiens
ttactgtgggatggaacttggcctatgaaagttgtgtttatattgggacatattttgtttaatagcttaaaaaccttaattttgtgggttgtcaaaatgagtattttaggaatctttaaaaattgcttttcagaagtggatttatcacttcagtattgtgattggaagttactttaaaggagctatattttctgtaacactttctcctaaactgatacaggttcgttgtgtgaatatgtgtgtggggcagttaaagcagtcgcaccggacccaccaagcctttgaaatttatgtagtgtgttgattttatgaggcttttgtaactgttttgagatagttatgattactaatgttacttcatcagaacttctctaatgactaggaagtttcagcgagcttagaatgagtgtcttttgtgaggtgaaagcaggacatgattataatggcgctttttttggtatgtagtgtatttcctaacttttgtgtataaatctcttgtggtttaatataagatgttgataaccgctcaaggctgttgaaataagcaagggtactgaggtttaatacatctaatggagatttaacagtgtattagtgtattcattttcacactgaacgtgtgttaattttcaaggagtgatttgggttactttcattcaattcttggccaaagtgaatggagctggaagtaaactccaagatttactaatttgaaattaatttttaggtttacaaatacttgatagaagtcttcagtgaatttacatgtcttccttgatatttgaaaaaattatcgcaaagattataatactccatttttaagatggggcaggttttacaaaactcgtctttgcatctgcttttacatctgtgcatctcttaaaaacccacaaaccttaagtcactgaggaatgctgcattttcttaatcttttggtaatgttacattttttaaatgaagcagcttaatgttatctggctaaattatggtaatggctaatcctcgtaggaatatcattttgtttttttgttttttttttcagtaaaaatgagctatcaattttgattttgagttaatttaatttttggggggagggtggggggaggaattattagtaaagtgaatttctatccctagtctgcatcgcagatttaagatacagtaagcattctttctatctatgtattatgctcaaaattcacctattttgaatggaagtggtttttcttgcttggagttttctccttactagaacaggaacgttggcatactcatcagacagtttagaaatcttattagaacttggagttctttgactcgttttctcttttcattcattcagcatattgcttactctatatctactggatgcaaggtaccatttgaggtgctttctcatccatcaaactgtatatctaggtgtgtgagttaactttattttacctttttagttgagatttagttaggtctaaaaacatttggaacactggatttttttgttcaatagttgatctcgctgtttaatatctaagtcagcacatgcaaagtctcttgtacagtattttctattttaattattctgacttaaaaagttttacgttgttgtatatcgagttgaatttatttaacattgatttgaaaattacttgttgagtcattagtttctactctacctggaaatgatttgttgtattaactaataaactgagcaatattttaaatgggagaactcatatatcacatcgcattgaaatttctaggaaacctcaaattattgctgcttaaaatggggtgtaatatttgtagatgtgaatttaaaaatagtcactgatcatctgtagttagtctagttacaatcgcaatggttgaattttaatcaagaggaaagtagaattttaagagcagttttaaaagtttgcaggttaaaattgatgcgttcatttcaagtgtgattgagaaaggaaatggtcgtatcttatggttgtttctgtctctggtataaaacatgactgattatcaccatctaccttaagatttaaaacatttttaacaaagtaaatggaattggataggaagctaaaagttgtttttggtactatggtatacgtttaattagattttacattttttaaaatatgagatttattttaaagaaaaggggcactttttccaagtatcagaattcttaaactgtagaataaaaaactttttttggacgaaaggaaagctttgtcatttgtttatttcttagtttgaatagtgaatctagttagtttattaagtctgctttctagttgtcacttaatgatgattgcatatttacgagatctagaggcagaattttcaagcattttaccgaatttggcactctcttgattacattttttcttgtaagacttctcttttttccccccaagaactagttcatgttttgccaatctgttaaaatgatttaattttttccttgtaaaatagtgatacttgcctttcttaaaattattccactttattagaaatcttttttgtttgtttgcttgtttgttttaagtgaaaggattgggagtcaggagatgtggattgtggttttaagccccgctgacagttaaactgtaggtaatcttgggcaagtcatggaatttctctttgtcccagttatctcatttgaaaaataagtggattgaaattttttcaatctgaaaatctgtgattttgaactagaaatagcagtacattgtatttaagaactaagctttatttcattcttagagcttagttttccaaaacacagaaaagtagaaatcacataggttacaaaattatataaatgcttttcatagtgccattctttggtggtaatatcatttcttgttgcaaagatgatttgagacactaactacgttgtaaaatgccccaaaattaccatgatttccatcatagtttaagtactagttttcattattgttggtctcaaattcagagatgaataggaatgatggataggatttatttaagtatatatcttaggtatacatttatttagtgtgtgctgattaatgtgaaagttaaggtataaaacctagagacaactttcagggaaaaaaaaaagatatcatattaaatgttttagaagtagggattcccattctatattgaagataacatagtttcaacacttgattattataattttttggggttgggtgaacatgtaataaagtaaatgtgtgtagttgtagtagagttactatttccttttttagtagagtatcaatgaaatagaagctttgcgtggtagtctctaaaacagctttaatctcatatggtcgttataatgatgaataaaatatgttaggcgtgaagggttatatgatgaataaaatgttaggtgtgaatatgttgctgagaggctgaaggagcattcttcattctttcttacatatagaattattctattgatgcttataccattttttaaaatttgaggcatttacaaactttttaaatgcaatacttactatattgttaatattcttaaatagttgtaaagcggcatgagcataaagcgggagctggaatgtccctttcccaaaccataatggtttttatttgattgttgtgaggcagaatcgtattgagggagtctgttttccattctgtaaaatgggctaataatagcttctactt

SEQ ID NO: 121594 - DNA, 1036 bp, Homo sapiens
gagttggcagcgtggaagacgggacggcgccggggcgtccaatatggctcgtccaaggtcagggggccaccaggtcctccccagcgactggaacccacactcggttggggaaggcggggtccgcgcgctatccgcccctctgcgcgtctagcgaactggagtcatttttgtcttgtcttccgccccttgcggactgtcctcttctgcgcaggccccggacaccaactactacattcagggacacaaatctccctcggggtggggcttcgacttgtcccggggagggaagggaaaggtttcctcctccctgagaaatcagtgaggatttctcagctggttcctaagcaagtgctttgcaccctcccaccgccagcctcagtgtttccaacagtgtcaacgagtgtgggtattaaatttgaagcaaaattacacctaatgtcttgctttatcaaagaccatggactaatttgtgtgtgagagtgactgcattattttaaaatactgaagttttaaaaattcaaaagctttccccttcttatatgttattactaaaaattgggtagaaacttgtctcctaccccactttttaaaaataattgaaagtgtttaaaagtcttagagtttgttgtgcacatactgtgtccctcacgctgtgcagaatttgacttgcattatctcatttaatcctgaaaacagcttgagcggtgttacccccattcagctgggacttaaagacataaattgtcctgcatctcaccaaccaataactactagtaaagatttaatcagatgctatagatgccaaagtcttattctcacccatttcgtactcacttacgaaagggtgggtcaagaggaattaaggaaatccaaaggtactcccagtttaagaagacagatggcatattaagagcactaatacttgagatttattatttaaacttaattttatgaaggtattttctagccctgttttactagaattaggatattaagtgatgtcaccattttcagcattttgactgagggttaatga

SEQ ID NO: 121595 - DNA, 1020 bp, Homo sapiens
tccccttatcagctcatgggtggttatttcctttacatgtatatcacacaaggaacaatttggggattcccccacccaccccgaaaaagaatccagctccaaaggtaaactgacatctccgttatcagagacagaaaactatcaacaatttttaaggaacctgttaccagtttaaaagaaaatagtactatatatacatatatatagtgcatctttaaaagaattaggcagagtatacatatttaattttaaaactatgatgattgcttcctgctcctctcctcctccacgggctccctggagtccttgcaagctggccaggatgtctcaggctgagtttgagagagctgtggaagacgttaaacaccttaagaccaagccaggggatgatgagatgtgttcctctatggccactacaaacaagcaactgtgggcgacataaatacagaatggcctgggatgttggatttcaaaggcaagaccaagtgggatgcctggaatgagctgaaagggactaccaaggaagatgccatgaaagcttacgtcaacaatgtagaagagctaaggaaaaaacatggaatgtaagagactggatttggttgccagccatgtgtttatcctaaactgagacagtgccttgtttttcctaatactgcagatgatggaaactagggaaaataaccagttaacccagctcctcaaggctgctcaccatagggctctaacagattaggggctaaaacaattactgaccttctctgagtagtttttatctgatatcaattaaaagtgtatttgtgttaaaaagagaaaactataatgaacgcaggttttggataattaagaagcaacctcaacaagtttctgagatccattattatagaagtatggagtaacaattaacagggcattctagttaacagaagcctgaacacaagattatttcttgtatttattatgtatttgcatgcacattgcaagatcttaagaaattcactaagtagtcataacctttgcttt

SEQ ID NO: 121596 - DNA, 1033 bp, Homo sapiens
gagtgaggggccagagaaaacaaggaaaggagggaactccaatatgtgcattcattagtgaattgataaggacattctgaggattgtactgaatgtgtcttggaactgtctcctcaaaagacaaaggggagaagtatttctccattgactccttctcacaaatcctacttgagaatccatgagtactgagtatgactaactctttaggtgagctgccctgtgcacaaaacagtttgcaacctatatggaaatatttgccacaaatataactggaatcagagatgagaccaagaggatgtgaggtggtacacaggaggcatctgatacaattccagtgtcttaaactgtgattttaattacctctgtgaccaggtggttaagattattttatatttcggttccatttaaaattttattttgtcattgtcttgtattgttaatttctgattttatttttatagttagagaatatggcaagtagaattgttactttttgaaatttattgagattctatttggagcttagtatatgatcaattttgcagatttttttttaatgaatacatgaaaagaatgagaactctctgtagaatacaaatttcagttctgctctttgtccttttgctcaatttaagattgaaagagagcattcatttccttttaaaaatgttattttgtcagccaggcatggtggtttactcctgtaatcctagtactttgggaggccaagatgggaggatcacttgaggcctggtcaacatagcaagaccccctctctatttatttacaaataaaaatgaaaataaaatgtgattttgtcagtttcttcttatatatttctttaatgtattttcaataaagttaatggtccccattttggaggtttggagggtgttaaatactcacaactctttcctttccagtttataaactaattgagaaagatactcgaattggattggatcggatgaaatattagcttctttgcatgctacactgaattaggggacttctctaattcaggactgaattt

SEQ ID NO: 121597 - DNA, 1107 bp, Homo sapiens
cgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgac

SEQ ID NO: 121598 - DNA, 1034 bp, Homo sapiens
catccatccccaccatacagcattatattagttataaaaaataggcaaagaacctttcttccccaccagtatctcaaagaacaaatttttttataaatgagaatcttaaatgcaatacgtattaaatatattattctctaatcccagaatatcaagtatagaaatgaaatttatgatgtcttttctcacttgatttataatacccaaattaaatatggtggttttatgaaagttgatagttttcctatttaaaaatattgactgttacaaaatcccatttaaaaaatttgatttcatacagaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatga

SEQ ID NO: 121599 - DNA, 1025 bp, Homo sapiens
ggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggtacaatttctacagcttctaattgtactttcttgggatgtttctcattgggcatttaatgtgctctcttaaaattgcttattgcagtttggtatttgcttggaaatgaaaactatttttagtactgttttgggaaaatttggattttatatttaagaggaagatgcaaaagattgtgtacattaatgagctacatgttgattgacggatcatagtcattttgggaaaatactctatttggttatctgattgtttctctaaaattggaaatgacactaatagccatagtatataaaactgacgttttggggccactgtgtaagagatgccacatgaacaatgacttctgtttttatatttatgcacattatttattgaagattaattacagtacatctttttggacatggaatgcacctcctcccccgaatgaaaaatctgttaaaggatgggtgggagactgttgactgactagtctgagaatacagcagctcttttaaaagtatttctttcctgaatggagagaggaaaagagtcctatcccatgatttttacacagggcagtcagttgccaccttctatatatatatgtatcaaacagaagccctgagtcaggttctgttgcttaaaattgacaagcagtttggaaagcaaaggtacgaaaaagtatggc

SEQ ID NO: 121600 - DNA, 1221 bp, Homo sapiens
cttctcccgcactcgccgtcccgccttccagttccactgaagccaataaaaagggccgtctggagacagaagccaatgggagctcgggtagagtcatcatgattggctgcggtctcttcgtagtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggaggtgggctttgaagtgggcgtggagacggcgggggaggtggaggtgcgaggtgaggctgggttgaagcgtctggtagctagtgaaggggcgttcgtggatgggggcctgcgggtggttcttaaagcagggaagatgaagggattagggatgggggaggatgtagggaccgcgaggagaaggaagacctaggaaaatgagtaaagagctcggcttctgagagggtcccgaggaagggaggttgaccggcactggggggactgggaagttaggaggagaggagctgggaaagggtatttacttcctgggaccgagaagagaagaaagggagcaagcggatctagagaagtggttgttattaaaacaaacaaaacaaaaaccccggaggcccgtggagactcaagactagagaggaggggcagggccaagggccaagacggaaaaggaggctttggtagctctcggataataatagatgtgttattattaaaactgtggttagagtggaaagccgtacttgtccaggctgtgatacttctatacatccttcagggatgggatgagaggagtaaagatggttagaaataaaagaaaaaagaaagtgcctttttggcatactcgagttggagtcggtactcagatacgtgatgtttacgttagatagaccgtgggatagtgtttaacagtgaagagccctggtccagttcatctgatataaaccccttttttgttcactttgttctttggaaagtatacttgggcacatacatatttattcccctcctttatcttcacgttaagaacttgcattagagatatctttgcaatcaga

SEQ ID NO: 121601 - DNA, 1035 bp, Homo sapiens
aattgaatgtttcccttctggttcatgacagctttgcagtggaatggaaagctgaactcagatgccagcatccaggcagatggggccccacctccctacaaacttaggcacttttaggctggcacagcctctgggacaatttgggaacaattttgttggtcacctttgttactattgacagcttattcccaaggggatctactcttttgagctggttgagtatttggcagaactccaaggggttgtttcctggagctgacccctgaagtggaaggtatccggcagggtgtgtctgctttgctgtggggtcttggtgggccctctgccagcattgcttctcagctcttggagcagacagggaacgttgggtgcgactgagggcagggggttctaactaatttaggatgtgtttgccatttcctactgggtcatggcccaaatatgaaatgactttttgtcatcttcagtctagtggctttgagagtggaggactgagagtaagagacatacaattaggtgacttgattgacaggtcagttcagtggtatttggtaaatgcaaatatagttaaagtcagcagctattgctacatactgatctaatattaaaaacaaaacaaagcaaaacaaaaaacccaaagagcaataagcatagcttttgagttagcttgttttccttctgcatgttccacaagacgtgggagtgtggtcttcttcattcatgacattcccatgtgtattaaagctcagtggttctctcacccttttgtgtgtgtgtgtgtgtgtgtgtgtgtgtgtgtgtgtgtgtgtgtggtttgttttaaatcacagtctctgcttatctttcactggttctcttttaataattatgttcattagcgtggtttcttcaaatgggaattggccacctttataagcctgggcccttcattgatgggagtttagatttcactgttcttttatgagaaacaaactgcttactagccaaaataaatgtttgggttgagtatgcgctgatttctttaattctggagtc

SEQ ID NO: 121602 - DNA, 1150 bp, Homo sapiens
agatgaggtttcactatgttggccaggctggtctcgaactcctgacctcaggtgatctgtccacctcagcctcccaaagtgctgggattacaggcgtgagccaccgctcctggccttaggctaaacttaatttagcagtttatttcacaggtttggaaatggaagctaagagagatgccaagtaatatctccaaggctacccatctgtcagggtcaaaattaaaaccaggacaatctgactctaaaatatatacttcccccggccccacctccccccagttttcctcattgtcctctgtggctcatttgtcttcagataaacttgtttcccattattgttcttattcaatctcaatgttaaaaaaactcttattcaaattgattatgtctctttatttcctagtgagtcccaaggttccagcatcagctagtgagtcccatggtgcagcatcagctatgtataccctggaattcaaacatggctagacgtgtctggaagcctatggaaggaatctggcaggggctgcttaattatataagttaactgggatcctcccgggaaagaagtaatcctacaagaagagagtagaggcatgcaagtttacttagcagtcagtgccacagagtagggggttaaggctgagtcacgtgcaaggtaattatttagcctgtcttccaatcaaatccctagggactctaggagccaggaggttgccagtgaaggttccaagtgtcttcactaagatttccacgggtcattgagtcttcatgcggagtcaggagaccccgcagcttactccccagggccctgtgggggtgagtcacgagggcttgggtgcaggcattggggtcctcaggagattcacagatctggagtcaaagggtaaaggcttatccattcagtggccaacaaggctgcttcaaagcacatctgagggaggagtttgcttcagagctcctgaagttagtgggggggagtggttgagggtaatagagtactaaggtcgtaatgggaagcagattcagggaaataccctgaatctcaattgccatatttataaatgtatcaacaatttaataaaaccatttgagcaaaacaaaacacttcttgttttgttatgcacttgcaactattaaaattaactgacaa

SEQ ID NO: 121603 - DNA, 1856 bp, Homo sapiens
atagaggagggtatgtaatcctactttactaaatccctgtggcttaagggagaatgacacaaatgtcaatatccaagggaacctcttaatacattttaaccttttcatttcttccacttcacacttgtctggcaaacctattagagaaataacttttccgtcttgtatttttcttctaatttgtgtgtcctgaaaataactttgttaacatagtgtgcctacctagtaaaccttctgaatgctttaattttttgtaagtctttcattcttaattgatcattttgtttaatataaaagactagatttaaaaccaagttcccccaggaagtattgttccattttccatattctttgtattgattggaagacttcatgtctgctagattagattcttaaaggtaggttgctttgcttctttttctggaaagttttagggttttcttggagctttggaatttcatcagtatgtgcctttaaaaaacattctgctcagcagttaataggactgctcaatctgaaaactagtgtcttttttcacttgagagcaagttctgttatttctttgccctttttcccccctcccttccattgtctttccttttcatcttcaggatcttttttccttttggatgaagttttactcttatgttctaactttcaatactcttgacttatctagtaatttccatctcttggtcttgatattctgcattctgaaaggcattcgtaacttttatcttctagatctctagcctggtttttagctctatgctatcctgctttttattctttttatctactttctaatttggcagtcaaacttaattttcaggagctcttttgtttcttattattcctttaaaaatagtggcttgttcttgtttcgtggatgcagcattttctttaatctctccaaggatattaaaaagcatttttttaagttttgtatattctgtaagttatctctatgttctccagcattagttctagttgttagtttttgtctttcttaggagccagcttggcttcccccagtaactcacagacctgctttcctttgagcaggagggctaaataagactgtgtaggagagtgggggtagcatgaagcagactggaactcctcaggtgcccgtgaaagagccacacccaggcagcaatggacttcagtgcgtgtccctccagggtgaacttcctttccatttttccctttctgtgtctgatgtggggtcagggtgaccacagactgtgctggcctctcaggcccctgaagcctcaccaggagttttcagcatataggcagcgagtgttgtttggagagcacttctctggagctctggccacactgggaaaaaaactgtctaagccattacaaatgtacttcttttatacattgattgccctgccatagcctgctccagattgttgtgttcattgtctcaggcttgtgatttctgtgcaagctccttgggaaggactgttcttctattggtttgggctgtggtttcccctgctgtgttttctctacctgtttggttgtattttatgtattctgggtatttcttaaaattttatggctggttcctgttcctagttttttttctcctccagtttaaattggctcttgggtaagaggggaggtagatgtatttgcttgctttgttgtcttgaacctgtatggtcagaactattaaacatgaattaggaatttgagattctcacctttggatttgctcatatttttgtatttggcataaaaattgccaaaatgaagctgttttagataactgcatcttgtctatcctgccaggattggaattgtctactgttttttgatttctatagcaagatttcata

SEQ ID NO: 121604 - DNA, 1033 bp, Homo sapiens
tattacatgttgaaattgaactccaaccttcccttcagattgttttttctcgtctttttcatcaagccagaaagttcagagccactttaattcttatttctccctaatcacccccatcaaatccacaaccaagtatgatcacttctacccccaaaatgtatctgcagcctgtctgctgccctctgccgtcagctcggctgccaccattgcttactgcaattgccaaagtactcccctttttcccctcctttcctttttgctgccctttttttgagccattctccgcacagttatttaggtattttcttaaaagaaactagatcattttgctcccttgctcaaaacccttatatgatttcttttggtacttaagataaaattcaagatcattttcttggtttacaaagcccagcatatgtttatccctgtccaccctgccagcttcacacttcactagtgctgctccctgcccaagaatgctcccatcccagtccttcacttggctaactctattcatccttcagatgtaagcttaaatgccagttttcaaagaagacttggccaaatcgctcttttcagacatgttgctccttcttggcttggtcaaggaaggcctttctttagagctgatcctaaatgacagaaggagcagcctgtgaaaaacctgaggctactgccttccaaaccacgagactcaattgctaaagcttttggagaagaggatctgtacacagaaccaaataattcaaagattttttaatcagacaaggcatgcgttgcaggaagcgaatctctacaagtctagatgccgttggcttggcttaacaatggattcattagcgctcagtgactccagcacacgtggtgccccatacttggtttccttttgggcaggatgcaccctagagtacagaaagtgtgaatttcaaggtcagtgaaacatgagcccaaatatcagttctctcacttattagctgtcaaacttgaacaacatatttctttgccttgagccagtctctaacccggcaggctg

SEQ ID NO: 121605 - DNA, 1019 bp, Homo sapiens
catcttgggttgctattaatgggcatctctgcaggccctctgagcaaggtaaccccccacccagccatacacaagtggaacagtacctctgagaggaatctcagtaggtcattgaaaacatgcggctttctttccacttttatatttggcaggtcgggtgggtgtgatttaaatctgggctctgatgctgaaacccaggattttctcttatcaatcacatggaggtgatctgttatgatttccaacatctctgttcctgacatttaaaaaacccctgccaagggtgaattttcttgtcgatgtaatgcaataactgacttttttttttttttttttttttttttttttataggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttact

SEQ ID NO: 121606 - DNA, 1097 bp, Homo sapiens
ttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataattt

SEQ ID NO: 121607 - DNA, 1241 bp, Homo sapiens
tttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgag

SEQ ID NO: 121608 - DNA, 1049 bp, Homo sapiens
tgcaaatattccaaagtttaaaaaaatctgaaatcagaaacacatctggtcctgagcattttggataaggaatactcagcctgtataggtcttgttggttcttattcaaaggaaattttatatagccttgttaatgttaaagaggatctaaattcatagcttggccaagatctgcctcctgtcttttcagatgcctgtagattaaggatgattcacattgttgagcttgatgcagattattcctctgaggaggatccagggtacaagtcattatagtatagttcaccttgctgctttccattgtcatattatgataattggcagcttaggaattcatacatatattattgggggcccagtttaaaacaatacagttaaaggcaacttctgtaattttaaaagaaaattagtaaatctgaactgacttagatcactttatgacaaaaattaattattattacatctataccttgattaaattaatattctgaaaagaaagaatgtcattgagtttgactgactggaatatctctgtagatttatctatattaaatgaattattcaatgtgtgtagtgctgtcatattttaaactatttagaaacctaagaaataagtactgttttgttgcagatatatatattggcacatctaaaggcaagaatagtagaattaaaagtaacataggcaacagttctaagggcctatttaagctcactggagtactccatttgaaaacctacaactgtgaaagtcctttgcatttgaacatacatttttatttatatggtaaaacctcaaatctaaactttaaaaatatctagcttaatctgaagggaaaactttttcattagtactactttatatttttcatttctaatctgtactcaagattaaatattaaaaaataatgtgtattcatttattgtacatctcagtggcttactgcctaataaaattttctgtatcttgtaattacctgttgtttttctaaagcattttttggagcccagttgaattcctttatccatgtgattatgtactcatacta

SEQ ID NO: 121609 - DNA, 1056 bp, Homo sapiens
agtaaagcaggcgaataaaggaattgttattcccattgccaaacgaattctttatgtctatgtcactaccagaatccaagcaatctttatgtgtatgtcgctaccaaaatccaagcaaacactctatcatattttttttaagtgacactaaatttgcagatttctacagtgtgacgtcattgatgttatattgggggaaaaagtatacttggcctatgaaaccttggtgaataaattacaaagatgtgtaccttgttgttgtgcacttacctccattaatactagcctaataatagctgcatttagatgtgttcacaaaacgaatgctttagtcgtctgggttctaaaaagctagtgcatttttttctttgatgctagttaaagtaggagttatgactgttcagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacaggtgagtttttcttttcttttaagttagtaactgtttgttgggtatcctctaaggtaaagatatagtactaatcactttatttataatttactcatgtgtttattgtctttctcctccattagaatgcaggctacatgatggcagggtttttgtctgttatatccacagaactttgaatggtgtctggcacatggtaggtaggcacttaaacatttattgaacaatgattaatgggtgaaaatgcccagagtttaatactctagctcttctaaaagtattagctcagaagcctgattctttactgtatttcaaatggttggtcatttgaatggtgacctttggataattttcttacatctatactaacctttaaatagatgaggaattgaaaataaatggaagaacctgtgatctaatcatggtggctgactgttcactttgaaaaaacctagaaaatgatagttttagtgttaagcaaaatcttaatggagtataattg

SEQ ID NO: 121610 - DNA, 1727 bp, Homo sapiens
aggttatgttaggactggagcagtaggtttaatgaataaatcattgatgggagaattttctaagttaattagtacaagtggcagtgggagagatttagttttctatggataggtaggatgctaaaattatagttatcctgcaacagcataaaattttcttaaactacatacaatttttaaaggctacttacaaaaaaactcacttatttccaaatgttttctttccttcaaaatatatagcttttggataaagtataccttcataaaagataaatacacgataaataagttacttgtatttatatgaacttttacaattttaaaaagtattataaggactttatgtacattgatactgacagtacaaatgtttgactatattttgaaggaaaaatgcaatttggcatttgttttatgtcttttcttgtgatatattttgttccccttatttagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagcgtaagtattagcattttaactatgttcaactatgttacataatatgtaactacactgcaaagagagaaaataaaaaacatggcagtattgtgagaaaatattaatttttttaccaaatacttttgcttatagttaacaagagactaatgtaaactcttttctatgcacgtttccacaacagtttacttattttaaactgcctaaaaagatttttttaaaataacttattagtatttaattttacccacagaaaaaagcaatatcccatgttttttggaaaattgaatgaagcattatcaaatttaagtagctatgttctttttcttaaattttgactcaaatcttttattacagtattcaagagccagatgatgcacgtgactactttcaaatggccagagcaaactgcaagaaatttgcttttgttcatatatcttttgcacaatttgaactgtcacaaggtaatctgaaaatgtcaaattcaaattttaagtaaaggataacttattacaacttacttcctaatattaaatcatatatatgaagtggaaatttgaggcaaaagacattaaagttgatcagatgagaatatggggagaaaatgccacctaaatgtaaatgcagagaatatctgttatactagcttttccatgtataaagagtaatccagggaaatgagcatgaacattgtgtatgtgctactagttagattcaggaaacatctaaaggaaagtagctgcttcactgagtatttgtaggaagaaggatatcagatatttaagctagagctttaaatatctagagcttacataaacttttcttatgctatggtttcatagcaccaaaatgtacattaaagtgtagctatgtaacttggtggtcaagtaaactatatatctgtgtgtgtgtgtgtgtgtgtgtgtgtgtgtgtgtgtgtagcgttaattggtagttctttaaaataaaaaagtaaactgctgtagaaactatttcttgctcacttggttcttcatagtctggatttttttgggtaggaccaagacaatctctt

SEQ ID NO: 121611 - DNA, 1049 bp, Homo sapiens
cacaatacatgaaattctaccactacttagtaaatgtagatgtaagcactatcaaagatatttttaaaaatttataaactaccagaagctagagatcatctcttaagcatttttatacgctaagtaccaagtgcatagcatagctcaatggctcccataaatgttgataatattctgtaagatatgtgatgtatacatttaatatttatatgtcaaatgctaggggtaagtttaccaatttttttggtaatctgtccatactcagaaaggtaattatgatagttcctcagttattctgcattctttttcaggctggtatagctgagtgtgacagctaaagattaatctgtatttattatgtttttccccgaaaatccttttgatggaagatgctctttaacaaaagatgtcatccttcccttaactaaatgtcattatgaatgatacttattatagcatgttgtaagagactgatgctcttggcacttttgtaacatctagaatgccctcctgtttctaactgttgtgattggcctttgctgtcccctgttggtaactgctttgttacacttctgttacttctgaaagtggacagtggtgataaactaatgcaaaattacgtcagctacatattgcaaggaaactatttggtatgcattgttatcagaagagagttggttatctgcataaaaagtgagagattgcttacttgcctatgaaataaaatacatgagccttggaataaatatttttgcttaagtctttttgatttttttttctaggtcctgatgaatacgtatctgggtggtctgggtggtgggcattttactgcctaaaaatgacaattatcttttgctttgttaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcaggtaactattaaggtatactaatactttctgtggtaggtagt

SEQ ID NO: 121612 - DNA, 1041 bp, Homo sapiens
tgtcagtgggatagatgattattcttttgcttgagtctagtgcttcaagaagtgggacaggttaggtacagatgaattactgttcatcacatccagtgtgttctccttccctcaatttgcttgtttattccctgttaagaaatgggaatgtagcctgtagctcagctaaaggagagttattttggcctattcttaattctgaccaacatttgtaatatttatattggaaaaggctccttacagtccagagaatcattttgcaaataaactttagaaatacgattgtttttcattactatcttttataattacatttctattatatttagacttgactaaatattgacattaaaagaacattttgtttgtcaaggttaagctttaaagtcttatcactatgatttcatcttgttcatctctatttcaaatacctagctcaagaataaaggagattttcttccgctccaaaaaattaaaaacaaaaacagaaaaactgcagccattttcttggttcctgttatcgatagacaatgctaggtactgtggaggtccacagaagtgctataccctggttcttatcctttagctatttgtaattggaaatgtagtttcatctgtatactttgcctttcccacagtctaaccctaactccaattgttactgattagataatgaagaagtaggcgatcacctgtgtcacttttgtcattgcccagcacgtaattttgttagctaagtcacttttgtattggaattatgtcactctaaaaaatgtctttttaagagatttttttcaataaaaagtatgtatattattaaaaatccaacttgagatgaaaaaatacattgaaaattttttttttcaaatttaatgttaaaattattttgtttcacgggtaaaagacaaacctctagatcagaatgccgagatttggttgtgcctggatctaaaccaagtggaaatgattcctgtgaattaagaaatttaaaggtattttaattctatatcattatataaagcaagggttcctgatctggga

SEQ ID NO: 121613 - DNA, 1367 bp, Homo sapiens
ccaagttttgttttttgttatgtttaatcatatgattttggtaagacatcttaaaaaaaaatgagagagtaaattgagttagggcagaggtgaggacataaataatcctgacctcctgacatggcagagcaactttgtgtggacttaaaggaaataattttagttcctggtacactgtgatttttagtggttatactattattataattgagttaaacccctggcatcatgatgtgggtcttttcaattttatgttctttgtaatgcctccctctttcatgacctatgctttaagtattaatttttcctaatcctggctgtcctagagaacagtgcataattgtgtcaaaaagattgttctctggatttagagtaactactctcttaagttatgcagttactagttttgacttatttttggtgataaaatagccatcacagtaacaaaatacttaaatcttttttcttgtcatgaggcatactctatgttgaattcaaactttctaaccctttccatctttaagtgaaatatattttagcaattgattaatacatccactgaaagcaaattggccagatttatggttatgacccttcccatttctctaattaataattcaggcagttaacctttgctgggggtttgtgagtctacatataattataatagaaaattttatgagcaatccatgtatagataagactttagtatattgaacagtaagacagattagtagtactactatttatgggactttatttgattttctttttcatgtagtctgttcaaaatagtcatttcaaggaacctctggtgtcagatgaaaagagttctgaacttattattactgattcaataaccctgaagaataaaacggaatcaagtcttctagctaaattagaaggtaagagtaacaaaatcagtagacttgtatgtttagttaagaaaaccacttgatagcttaagaaagcagactagccacctaagaattatgatgtgaaactgtgtctatgttcttttatcttgaatttccgttcagttatatagggtatatgaaaagtactgaatccgcagcaaaggaaatttatttacctaaaaggtgcataaaagaaagagtggagggaaaatgcaatggaactgagttttttttctcagttggcttgacaaatactttctggaagggatacaaaagctgtttttatatgacagctctcatcttttatcaagcgtttggttttctactgcatgggtactgtgatacatgttctagggatatataagtggataaaacagtgtcccaaggaggttgcagttcagtgtggaagatacacagagatatataaatgcaatgctgaatagaatgtgg

SEQ ID NO: 121614 - DNA, 1519 bp, Homo sapiens
gtttgacccaaaatctatttgtaagacaccaagcagcaataccttggatgattacatgagctggtaattactttggccccttgcttgattggcagggtggtatgatagaattaacatgggcttctgggccaaataaatctgggattaaatcctgctcttttactttaaagactttccatcttcatattattttttcagcatcagtgttttcatctataaaatggaaagggggaagtggttgcaataatgcatatttttaaggattgttgtgcatgtagtttctgtcatatcgtaatctgtacctacaacctataaatattctaaggatgtaaaacgtcttgataatcatgtattgccatacagatatctctctattaagagagagattttaaaggttagcattcttagagcagataaagagtagatgaattttttcacataagtggtgttaattggaaagtgatagcttctggaagagattggtttttacagttcatgtagttctggaggtattcaaaggtgtagtatttgagtgaataggaatgatggataagtgaagaagttcgatgatgagtgtgctgatagggaacacaagggatactacaaaagaaaatgaatgacatttcagagaaaggaaataaagggatgcgatacattataaccatcaaccggtggctatatctttaatgtcttaggggatagcttaaatccgtgttgtcttttgcgtttcattttcataatgtaatccttgatcttaattagaactggtcttaaagattttataacccagcctcttacctacttaatatagttttactatatattgcctcattttattatatgtagaatattctaaagaatgattgctaactaaaatagcgataatagatatttcttgtgatactaggttaattattgttaacaaatatttgtggagctcttttgtgccaagcattgttctaggtgttgaggatatattaatagcaaaaaggcaaacaaagcacaaatgtatactggacagatttaagctcaaaggccaaactcctgtgatgtaattggctttctgatatttctagcaagccattatagaacattattgtttaaaaaaaaactcaaaatctatggccggccacaagctgatgtttgctaaattcatataaaataaccctaaccactttgtattttaaatgccatcttttcaaacaaagatttcttgtctgcatacaaatatttactttcagaaagaattccccaaaattaaatatccggtggtggcatatctggaataagtgtcagctatatcatgaaaactaacttgggttctgtttgatgtaacacttttaagtttatatcagtctaaaatacatgaaactgaatcagacttatttgttaaattgtaatgttttaaataaaaatatatatatatttcctagttttagaactccagttgtaaagaatgactttccacctgcttgtcagttgtcaacaccttatggccaacctgcctgtttccagcagc

SEQ ID NO: 121615 - DNA, 2197 bp, Homo sapiens
cgggtgactacaacctctgcttcccaggttcaagcgattctcgtgccttagcctcccgagtagctgagattacaggcacgcaccaccacacctggctaatttttgtatttttactagagacagggtttcaccatgttgctcaggctggtctcaaactcctggcctcaaaccatccgcccgcctcagccccccaaagttctggggttacaggcatgagccactgcgcctggccagcgttactttttgttgtgttttgtcagctgctagtgagcagcttcattttgtttgttagtatacaattcatttggaaatgtaaattttcaaaaatatcagaatagcaatatgaggtactgctagaatgtattatactaataactaaactaagaggaaagattttttgctgatgaggcaaaagttggtttctagtaactgtcctagaggcagcttaatactggtagaaaacatgggccttggagacactgggcatgaatcttagcctcactacttacagtctgtgtgatcttttgcaagttacctaaattttcggtgcccatttcattatctataaaattagtaaagctaactacctcctaggatggttgtgaagattaaattagttaatatagacgtaactcctaatacagagcatgacacttagtaaatcagaaatgttagtagcaattgttatttaaataaaacaataaaaaacccatgagtaattaactataaaaatcaactgataaaaaaattagctgacagaataagaacagtggttgtcagggaagggaggaagaatggggagttactgtttaatgggtatagagtttcagtggtatttgcaccaccatccatcaccagaactttttcatcatcacatactgaatgtacttaatgccactgaattgtacctaaaaatggttaaagtggtaaattttgcattatgtataatttgcacagtttgaaagaataatggacaaaataatgagctgacagtagatactaactggaaagaggtgatagtgttttaaggattgaaacaatataataaattacaaaggaaaaacaaaaatgatccagtttgttcatgcattgattcaaaacacatttatttagctattactagtgtcaggccctgtttgagttgcaatccagaagacgagtcacagatgacaagtgaaggggcttggtggagccttctagaagaggccagtgtcagaagagaactgaaacgaggccacagtgtggctagaggtcaggaaggggaaggagtgaggcccaaggtttgctgggcccttaagttttaccctaagagggtgggaagctttggaagaggttgaagcagggaagtgaaatgatccaatttgcattttggaaactctaaccacagtgagtagggcatactaagggggatgcgggaagtcctgtggaggaaaccagagttcacattagtgttgagtcagaaataagaattactttattctaaaaactgtcagcagccgtggagaaaggacattgaactgctttcttcccttggcaatgttcacagttttaaatatgaaaggaagaagacagagaaggcacaaaaggaggagtggggaaaccttgatgaaattacaacacatacatgtttagaagcccaatactttgttacaggaaatatatatagacaatgtatctcaatcctagaggtgaaaaaattagaatacttatctttttatttaaataggagattacatgagagattctaccatttggaacctaaagcaggccttagttaaattgaggtttattcagaccttgtttaacttggttaatcagctaatcaggaggtctttttgtttcaccttctttatcagctcagaataagtcctctcagcactccatctgttcaaagcatttataggtacacagagagatcctccaatataagggaaggaatgatggggctggttgtatagtacatcaactgaaagtttgctggggaagacgctgaggttctgaaaaattaagtaacttgttgaacatcactcaggacaaagttgggggctgtattaatgagttcttacactgctataaagaaaagaggtttaattggctaatggttccacaggctgtacagtaggcatgatgctggcaatctggttggcttctggggaggcctcaggaaactttcaatcatggcagaaggtgaaaggga

SEQ ID NO: 121616 - DNA, 1053 bp, Homo sapiens
tctctgcaatattgaaatgtataatatccaattattattttcagcatgctatgctaatcatctaaaaaaaatcaaacttgtttctcctatttgaggctttgtatcccttcaccaacatctccccatttctctcaacctccagcctttggtaaccaccattgtcaaaggtagtatgagctctgctctatgagtttaatttttagatttcgcatataagtgagaacatgaggtatttgtctttctgtatttagcctatttcagttcctcctggcttattttaacatgacatcctattttcctctagatatcctcatgtgtcttctcagttaggccttccttgcccacactgtaaaacttcaactcccacctttcaatcaccagtgttctccattccccaccggtttgtttttctctgtatcttaccttctaacatgttctgtaatttacttatttggtttgttgtttgtgtccctctgcacttgaatgtgagctccatgaagatagggatgtttttctgatttgctcagtgatattagcccctgcatccagaacagtacctagaacagatagggattgaatttattagttgaattgagtaaactgtctgtcctcagctcttttgctattgtaagttgttaaggatgacacattaaacagacattgttggactcattttaagttttactgtaatttcctaatcccactaacaataattagaattgcataaggctgtcttattaacttaccaaaaataaggtatgtgcattaccatgtgtatcaactcttcaataaatattggtttcattatacatttccttttatcaatctatttgaattacctaatttaattgctttcgtagaaattacttggttaatatttattatttatttgttttttggctatattttagtagtatcaaggtattgagacttaatagaggtatttatttacttgtatgttttcagagaatgtagagtagtcttaatggcattttaacatttttttccttggagtataatgaaggtgtaagcttacttaagtcaagggccaag

SEQ ID NO: 121617 - DNA, 1446 bp, Homo sapiens
aacgcaagagttactggaaaaatatgttagaggcagttcacacaatccatcaacatggtatttaacagtttttttatatttgtaaggttaaaatctttgttaatagtgtcatcttagagaaatatacctataattttagggcattggttattggtgtctttaacgagatcaactaaataattagaagtttatttaaagataaaggaacaaaaccatttcttaaaacaccgttaacccaaaggatataggacatcaactcaagttccgacatctgtaatacaaaatgtatttttctcagtattaacgtagtctgtcatccttatctccaaatacttggattatagcaggtctaagactttggggttcaggcatcctgaaaatatgagatgtttactttattcattctcctaatcattttgtattgtatgccctgtgtgagaagttggtttttttgtttgttttttactgttaggcctaccttctgggttggtttttacttgtccttggttctttttagggtttttctctgcctttaccttatcctatatatttttttgttcttaataactgttatcctagttaattgtaatttatctcctcctcatctctctctcttaaattatcttaaaagataattcaccagtgatcaagatcagggctataggggtggagatgtcaggagcattagggtcttactgtctggcagtataatttgtgatgctctctagtgggcagtgaatcacagtggttaagaggatagattctgaagccagactgtctggcttcaattctaactgtcacttaggctgtgtgaccttgtacaagttacttaaactctcattgccttagcttccttgccttatagtggggatgatgataatacttcagcattgatgtgaagattaaatgatgcagtactgtataaacaatgaacttagaacagtgcctggcacataacaagtgctatgtaaatatttgcagaatatataaaaaaattattgaattgggttcactaattgaaggaataaatacagcttgacctgtagactgtgaattttttggtccttagaatgttttgcattgtttaatattacagtggatttttattttaaaggcattgttcacagtgatcttaaaccagctaactttctgatagttgatggaatgctaaagctaattgattttgggattgcaaaccaaatgcaaccagatacaacaagtgttgttaaagattctcaggtaagacttaatgttggttctctcacagtagagttcaattctttttttacctgtgaagtattatattgcaaatgagtgttatatttttaatcacctcattcttcaaaggatttgaagtcttttaataagaatagatttaaaaatataaaccatgatcattgtaatgtagaatagaaagtcaagatcaaatagtaatatctccagcaa

SEQ ID NO: 121618 - DNA, 1034 bp, Homo sapiens
aaaagtatggcagatcaatgagttgtaaatcagcttgacaatatcttccatgtcaaggccctaaagtagatatattctgtgtttaaagcaaaccatgtattttagaagaaaatgagctcattgtaaggttggcatatcctactgtagaaactcagaggactactgtgagacaaagctagatggtatttttgtttgtatattggtgggcttatttaaaaaatatatttttttaaagttgagtatgttacaacaagaaacgaatggtaagtccctcaatggcctcaaagtttatggccattaataggattttagcctggagagtttttagggcaggctttactagttgcccagtataatcatagaaaaagcacagcattctgaaaggagtcactttgctgattatgaacccaactcgttttgctgcagttgtgaagaaatttgatatatatatcttaacgttgtcagcagttatttgaaatttgcaaggatatcattgaaatttataattacccaagtttccaaggatctggcatttgtatttttaagaatctaaaacttaaagtataataataataataataataataataataatctcaaaaaaaaatctaaagcagaattaaatattttcattgatttgtgttttctctgacttggcatataggttggcacagttaattatatgccaccagaagcaatcaaagatatgtcttcctccagagagaatgggaaatctaagtcaaaggtactgaaaagattatttacatcacaattatctggcaacagtagggaatgcactattttctgaataaacttaccagataacaatttctttaagttctaaaactttttaggccattacagagacattgctggtttttttcgtttccaattcttactatttttcaccacttattcgtttgtgaattctacatttccaagtacagctggagaatgtaattgttttctggcctgccactggctacttttccactgactttatctcgctacctcgatgagtttgcgttagcctc

SEQ ID NO: 121619 - DNA, 1023 bp, Homo sapiens
gatgtattttgtactatatgacttacgggaaaacaccatttcagcagataattaatcagatttctaaattacatgccataattgatcctaatcatgaaattgaatttcccgatattccagagaaagatcttcaagatgtgttaaaggtaatattaatttcatgtaactaattatttacttaaaagaaatagttgaaataattggaattatgtaactggcttagatataactgttctattcaaaagaattgctaactgaattagtttttttactttgaagatgttttaaagcttgtaaatacttggggattttgcaaaagtgccttgggagaaataatcttgtcataatactttagtgggatatctaaaaagtaacttttataatataatgtaatctggaaaaatactttatcaatatcatatatgaaaacctgctttgtttttcttttaaaatatctttgttttaatagtgttgtttaaaaagggacccaaaacagaggatatccattcctgagctcctggctcatccatatgttcaaattcaaactcatccaggtactacttctttaaaaatttgtttattactagattggtagtataaacagtctgttacctattaatataacaaagacagaatctaaattggctaccctttgtcagcctgcctttttccttaaggaagttccattattataaatagtaaagtaaataaacttttttttctttacttctggtatttatttttacttattccagataacgggttataatcagtgataaattataagaatatcactttgtgctattaaacaaaatgtgtatttacaatggacttatatttttcttactggtactagtgtattattgatttattttatagttaaccaaatggccaagggaaccactgaagaaatgaaatatgttctgggccaacttgttggtctgaattctcctaactccattttgaaagctgctaaagtaagtatgtctattctttacattaatttttactgttttatatagt

SEQ ID NO: 121620 - DNA, 1108 bp, Homo sapiens
tacacttcacagataaagactgtgaaacacagcatagctcagtgattgtcccaatgtcacacaagttagtagatctggtctaaaacccatgtctctggaggaactgttatgtttcttttctctctcctcatgagaatatacagctaactgggtcatgtctctttttgctctatttccagaaagttcagagccagatttgaagctcttgtgaaagaattacaacttcttatcatctgcatatttatgtcctttttgcattggtcttaaacttttacttttttctatttttcctggtcataattatttatttctacttatatttctactcttatattattctagagccactatagactacactggacaatttgtagaagagacgggagtatagataaatgcatgaatgtaaagaaaaggaaaaaaaatcctcacaacactaaaataaagcattgcttcttgggaagaagatcagataattagctgtaatgagcctggctacatttagaaaatctctgtgtttggattatatatgatttaattagtatttggacaactatgattaatgagaggacaaatctctagaacactattgagtaaaaaggatgattttagattttaaaacttagcaaatcaaaatgaccctagttcagtatgcctcattgtgttacaggtaaagaacagccatccagtgaaatcaactactctggagcggcctggtttttgagcatgaaattaagacactgagtgtgacttctgtcctccatttgttatatggattgtccttcatattggatcatgtgtcctcgacccacctgtccagcttcatccctctcctgccacttcccatctggcatctgacattccaccgattcacaaacttcctagctaatacccacactgagtcctctgatagattccctttcactacttccccttacatgcccagttcatgtcatctctcttaagaaactttctttgatttcggctccttattgatcagattactcaatcagaagccgtcttctctatgcttcataagattttgaaaatgccacgattattattggcttatttgtctcccctgatagattgtgaactccttaagttt

SEQ ID NO: 121621 - DNA, 1055 bp, Homo sapiens
acatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatgcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttctgaggttatgttatacttaaatccaagaacccatacatgttccatctcacttattgggaacttccagcttagtcttttcttttccattt

SEQ ID NO: 121622 - DNA, 1005 bp, Homo sapiens
aaaaagtggatgttcctcaaaactcaaaaggaaactcaaaatcacttcaggaacatcttaattctgtattcaacggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacattgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttcagttttatctttgtagatccccttctgctattgtt

SEQ ID NO: 121623 - DNA, 1592 bp, Homo sapiens
tgatccaactgttagcatttgatgtgttttttcccttccagatcacatggactctatctttctgttgtgaatctctcttgtggaggctttagcagttagttgggcagggtcttgccttgcctgtcctcttctttattgtgcacagccatgagtggactgttgtccatcctctggagcatacacacaaaagcctgtgttgatggtgcagtaacaacatatggatcagtggtccttgcctttgctaacattgtggtatcaggagtgcttgaggggactttcccccaaaccacctcatccatacatcaaatctaagtaaaaacaatgggcttgctatgaacatgtaagtttaacacaagcccactggcttttgtttccaactagaatggttctttaagctgctcttatagatattttggagcttctgctgcctggcaactcaactctgtcagtttcatttagttgggtcagttttatagtttctgcagaactggaagctggccatttaaaatagccttggttccactgacacatgtgatgtgattgctggaccaactgttcacaagttgtgaagagattacaagacagtagtgggctgaaatatgctcagtagagaaaggctggtgttgactgataccattaccacattgaccagtgggtacaggaagtaggtagttactgttgaagtataataaacaccaccaggctttgtctaggctaaggcacttctttagtatgccctgggatctcttgggttattttcctggttacagagaccaatttattagctctaagagcttgttggagatgccatcctaggaaggtagatgccttccagttgtgtgtatgtgtgtatatatgtggaataaatatttgaaatgggtttcagacagctacaacactgtttgcttcacagcactgcttccctaccttgcccatatgctgcaatactgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgacagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaaggcttaggaattggcaacatcaagtacttctgggaatagggatg

SEQ ID NO: 121624 - DNA, 1004 bp, Homo sapiens
ttccaaagtacagacattttatctcagaatcacattgagcatgcacggaagcaaattttagcttacataaagttaagaaacactagtagttgatttattattagttgtaatatatcttctatgggcccatagccttatcaaaactagcactgacaattcctgaagatatctggggctcttggcatggtgagttggtcctgtacttccaggttcatgctggtacctttgtggatcatcatgtctgtcatatggaccttagtcaaatgttatggcaaacagcacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgagcacagtacatgcctagtgagatcttccagctgatggtctgggatccttaaagaccatgcaacgtcctcagtacttctcagtgccaattgtcaggggatttttggctgccacgtgcctctcaact

SEQ ID NO: 121625 - DNA, 1035 bp, Homo sapiens
tattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctagg

SEQ ID NO: 121626 - DNA, 1031 bp, Homo sapiens
gagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaatttta

SEQ ID NO: 121627 - DNA, 1059 bp, Homo sapiens
ctcttagtctttttaacaagtaagaaatacattaaaagcaaaagtgttatccctgtgactttgaggtaaatacagactaaacaaaagatttattaaaatcaccccatcatcagttaagtgagaaagacttaagttagaaagaaatataaagctttgaaagagaggggaggtaaaccaactatgttcttggtcttattctttgaagtctataaaattaatcaatgccagagtttataaaaccagtcctccttcaaaaagaacttgctgtaaaactgggcattggatagcatacttaaaagaactgctaacctccccttcttaaatacagttaagttcacataaattccaagaatcctgtttgttttctttcctctagataagcatagatattaaatagaatgaatcaaaatggaaacatcaaatagaaatcaaataaagtacataaatgaacataccttgattcctgggcaatgggcaaaaaatgcttcaggactctgagaatgatagagagccccatgaccaacacagccccaaggggaccggatagtgaggcttccacagttaaaaagatccccagagcgatagcgatacttggcagcttcattaacaatctgagggtcagaaagaaagacggggcatggcacaatgagtccttcccttccaatctccttccgttcttcctccctccctcccttccttccttcccttcccaaggcacaatgagtctttccctccctccctgcctccctccccctcttccttccttccttcctgcctgcctgcctttctttcccatagcacaataagtctttccctcccttcctttctttcttaagacagggtctcgtccctccctccctccctccctccttccttcctttcttccttcctttcccatggcacaatgagtctttcccttccttccttcctccctccctcccttccttccttcctttcccatagcacaatgagcttttccctccctcctttcctttctttcttgagacaggatcccatcactccctccctccctccctccctccctctcttccttttctt

SEQ ID NO: 121628 - DNA, 1058 bp, Homo sapiens
gtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgt

SEQ ID NO: 121629 - DNA, 1100 bp, Homo sapiens
atttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaatt

SEQ ID NO: 121630 - DNA, 1011 bp, Homo sapiens
tgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtg

SEQ ID NO: 121631 - DNA, 1250 bp, Homo sapiens
ctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactc

SEQ ID NO: 121632 - DNA, 1009 bp, Homo sapiens
ggagaggtaccatcatcagcaacgaagagagtctcaaatagacccaaagcaatcaagaagctggctttcactgtcacaaccggatgaaagcatcccaaaacaaaacaaaataatgacgctaataagtcagaggtctgatgcatcactttctcattcagtagagatcgcttgtctcctctttcatctttcccagtaggatagagccctaaggaaaatggatctgcattctaggatcagacaaagatgcgaccaacagatttaacacagtgatgcaaaagcaaactgctatcgatgtaaatataaacaacttcacccttctttctgcccctaactctactctctttgcttccacggttgccaaaatgaagtattagtatacttgtgctttacaataagctgctacaaatgctttttgaatgtttaaggtattatttatatatatatagatagatacgtaaataaagttctaaaagtgcttgccctgaccatatgtgaatgccctccgcactgcgccatcataaaacatcatatccccatacaaaagcaccatctacactaaaaatacaaaccccaggataagtggtggatatatgttgcaaacaagaagacaactctagtttaactataatttggaacgtctggctatttgaaagaaaacccggtgtctgacttgatttgaaaatgcctgcaaaaagcgttattttcatgaagctatgaataactcaatctgaaatattgctcttaattacagcaactacaaatagaatggctcgggatcatttgtaagcatgtcaagtgtttagatggtgtcaagtgagtcttcacaaacatttactataacaaatcttacatcttctactaaattataaaacactcttcacctaaaaacatcctaggctatacttttacagtagtatctgcaggttattttcatgtaactaacccaagaaagagcctgtaaaagctatgaaaatgccaaagctcttaaaagtggtaaatataaaatgcc

SEQ ID NO: 121633 - DNA, 1023 bp, Homo sapiens
catgcatgctcactaaaaataacagggtttatggaaagaaaaagtgcgtgtagcaaaccacttaaaacagcttggtaactagagcgaagaagggtttttaaccagagtcaggaaggattgagcctgttgatttatggagttcagggcaaatgcatcaaagttggggagaaagatgtaataaacacttctaaatcagagcagatgggccagcctgagccaagagacatagtgcatggtactatatttctctgaggcttgagtcagcgctgtggctctgctttgcgttttgctttgttcctaagtggcataaaacaatgtgctggggcagattgtacatatgccaacacgactaggttggttgccgccacttctcactggaaacacatttcatacttgtgccaggaaaatggacttttccttgctcagtccattccctcatgtgtttcactgctgagttaggttttgtcggtggagcctgggtcacatctttatcttggctataatggaggctggaaaacatagtttttttatattctaccttgggaaagtggaattcataattaggagaactatcaaaatgtggagaatatgttaaaaagttttagatttttcaggaatcagaagcctaccacacgcacatgcactcatgcacacacatgcatataggtgtatacacgcacacgtatgtgtgtgtttcaatgtctgtaacttttgatttataaattttaacataatttattcaccactatgacacataacagtttagtgggcttgcattccctgctgtcttcatctcatatttcctcagttttgagttatgatattacctgtattttattttttctactgattacctctttattgtaatttattttaatttctatatcttactccattaactttgcttagaatcttttgacctctcactatgtaagaagatgatgttaatgccctctactcctatatccactgttctttcctcccttccaattcccattttctgtcagctgattatttttacat

SEQ ID NO: 121634 - DNA, 1070 bp, Homo sapiens
ctagataaatgagttcttgttggtttctttctaaaagctgcagggtactggtgctttgcttctaatcattaattttcctttggttacattcacattaataataatgtcattaagtcatcttctgttagggcatttttctataaatttctaatttcttatgtcagttttggaaaataataaaatgacccctttctcttggctcttactattttttctttaattattttaatcatggaactacttatgaatttttctggtagaagccttagtataccattaattctgatactattttgcattaactctttgtgatattttctagacattgctttagctggattggtgggcaggaaaaaaggaggcgattaatcctccatttctgtagattgagattttgaggtgtgacagatacgatatgtagtaacagtactgcaaatccctgtgctggggcttgaaactattaatcttgttgtgaatcatatgagacatgtttcgtatgtctctccgtgtggttaaactcttccaggggagcttgggctggtggtgccaaagggtggagggggattgactaatctgttaaatagccttttatctgtgagtctagtttctcattagtatttctgaccagaagaatagatggttggaaatgtggacttttgtttttaattagtccctctagggatgagaggcttatttggaagaatggaattttaaggaagcctgacaacctcagtttccatgtgattgaaaatgtttggcagctgaaaaatgtttcacaattatgagttagagccagattttccactggctaagctgttctttgggagttagatacagggtaactcatatttccactttcaggtctcagtggctccgtttagggtgctgttcatgggactctaatgctccttccttcccaatggcccagaaggctcccatgaggtttattcttctatcatgtataataaactgatgaaataaccatatttcatctcatatttatgcattttaatcaggttggttgatgtttaccacagacatatgtctacaagcatttcattatctataaa

SEQ ID NO: 121635 - DNA, 2029 bp, Homo sapiens
ctcttgtatgtaacttgcctttgaatattcgaagacagcctcctcatagtcctcttatatctaggttaagcattccatccgttcctttcaggtgttatttaaatctcctggtttgcagatgcaccactattctgactaccattttttggacatagtctttatctctgatggcctttaacttaaaatggcattaaaatggtcctttagatatggcttgagtagctgaatgcctagtagagctgttttcctagaaggagatatatactttctatacttctgttttggaatacctgaaaagatagtttcttggcattggatatgttaagcagatgcacatatgttagggatgttgtagacaaaaagtgaataaaaagtatgttgggagggtggtgtccttacaagaataaatttaaatggctgttaatttttaacagcactattatgaaatatcaactataaaatatagggcatattacagtatataatgttggtaataatgtctgagtgaatattcttttcttagaaggtcacttaggtgcttttgttttttgaacaattcctgaataaacttgttagagtactttgtatctgtgaaagattgcatcccttgtcaaaaactttcaatttcacaaaaattccatcaacattttcccttcacagcaacatgatagtgctttaattttctcaatgtttggccacattgttaacttatttttttccccacttttcttcattctgctccttcctttgaggcagtgtttacttgttctttatagagttaacatttggtgcaatacaactagattgttagaaacttttaaaaaccctactcagtattgttattagcattgttttgtccattaccaaccattcacctgtttcctttcctaggataatgttaactgtgctttattagatgctctcagatatttaccaatgacatttttgtaaatggaatattgtttactcttaatcctaaagtttactcttaatccttaatcctttggaatgtctgttgaccttactgtaaatttaaggctgtataactgatagatttcagcaaattatggcagtgagagttttgatggtatctattttatgtcaagtaattcttcagtgactatgttaacatttcactgcattgtgtagagtcttattttgtttttccatgaggtaatttttaaaactacagggctattgagagatatttagtccagtaatacattccatataggggcattcaacgagaagattcttgtgttacaaggaaaggatgttaaaaaaccagaatctctcagtaaattgtggtctgtaacaattccatccctggggaagggcggcgcattgaaacttccatgactattaatcttgagagagagcatgcattgtcttgttggactgaagcctctagccatcttatcaagccagagctacaaaagtaggataactttgcatccctttttggcccactggtgaaaatgaaaatggtaggagtggatggacaatagattaggttctttgacaagtaagtgttgagtgacagtcatgaatatttcccatttcttgattttaccaattgtgtctctaaattcactcaccagaaatatacaataagaagctgaattttcttggattacttaacttgttttagtgaatgggtgagaaaggtttccagctgtagctgtcaggtttttttctgcagcaggcgcctgccttcagcgtttttgaggataacacgatacactctttcttcttttgctaccattaagcatattatgctgccttttgtaggcaggccaccaggctataagtcggactccgtagtctggttatgagctctgaggcatggagagggatctctggccctggcttttctactggttgctggatgaccttgggcaagtgagtcaacctcttctttatcttctttccactttgtaaaactgagactttctttttttctctagtcttaaaaaaaagtttgcaaccattaaatataaagggtaaacaagagtttcttgagtaagtt

SEQ ID NO: 121636 - DNA, 1033 bp, Homo sapiens
acaccacgaaggagcagcacttttatgtcatggcccttcttttctactctctgtcaatttgaatgaagcagaagagaggcaagtattatccagttagaaataaaagagagggccgggcacggtggttcatgtctgcaatcccagcacgttgggaggccgaggcaggtggatcacttaagcttaggaatgcgagaccagcctgggcaatatgatgaaacaccatcactacaaaaaaatacaaaaattagccaaacatggtggtatgtgcctgtggtccagctactcgggaggctgctgtgggaggatcacttgagcctggaagggggaggttgcagtaatctgagatgactcccctgcactccaatgtgtgtgacagagtgagaccctatctcactaaataaataaatggatgaatgagagaaagacattttaaaccaatatgttaagaatcacactttaggataaccttgatattgtaataatttatgattctctaacctgtgaaaattgtaaattgttaagcaataaagagaaaatacacttgtggatatgcagaaatgtgagtttctcagtgcatgggaagcattgagagaaggaaggtgtccatccagtctgtggtcccctggtcgtccctcgcctcccctatgtatcttgtcttgcttaggttttgacctttgtcttcatgttatcctgcattgctatacaacaattggggcatcttgtggttgaagttttaaggtaaaatgaaaccatggttactccttgctgtttcattggctggccctgcagttcttcatgcttactagcccccttcctgccattgctactacaaaagccctccagacctcctttggtgggaggagacatgagaatgtttttttatctcactgacatcctactgaaatcagggaaagacagggcagtgtaaagctttcagctcattctaacctggcagacttcttcaccattgcagctgtatgctgtctacccaacactggcttacagaatccaaaatggctctcccagagggctt

SEQ ID NO: 121637 - DNA, 1043 bp, Homo sapiens
tgggatatggtatgagcccagaatgcccaggcttctggcttgactacaggatcagtggtgctgtcattcaccagggctgggactgctggaggtagagctgaagtggaagggagagttggggcagaatgagtggatgatggacaattgctgttagctttgcatgtgggaaagtttaaggtatccagtggctggtgtggtaccttagagaggctctcactccaagtggcagatctaggtatcattagtataaatacagtaattgaagccaagggagtgaatgaaagagaatggagatgaattctctgttgaatgatcaccagacttgccatgtttttctatagatagataccctggttggaagtttgtgtgtgtgtgtgtatgtgtgtgtgtgtgtgtgtgtgtgtgtatgtgtattgtgtgtgtgcatcccagaatagccatagtggtgtggaggtgtgtatgtcttcagtgtatttggtaggcttcctggaaactacagttttaaaaatgattgacaaccataggctggaacttcttaaccatgttaacatgaatttatagtttgtttattgtggggctgttctgtgcattgtaggatgtttagcagcattcctgatttctacctactagatgctaataagttcctcccacccaatcctcatccccagttgtggtgaccaaaaatgtctttaagcattgctaaatgttccttgggctagataatgccacctgaataagttcttctctgaatttatttacagcattttgggaggagccacattaacttttatgttccagaatgcttgaaaaacacattcatgtctgcagttatcctgactgatatttaggaagcagtttactcctccatcctggaggatcaattgagtaattttaccattaaaaaaaaaatcatttgctgcacataaaagtacagatagctgctagatgcaaattaaattttgttttactttatatgtgtatgatatataaatgaaaaggggtgaccaggacatgttgtactccaaatagtgaaatagcctgta

SEQ ID NO: 121638 - DNA, 1084 bp, Homo sapiens
tcagggtggtatcacttctcacagatgaatctttacttctggcatttactcctaactctcaaaaaattgtggtattaaatattttatatgactcctagaattgtggctgtaaagtcccagcctctgtctcaatcttctgtcaaatgaaggaagaagaaaaagatgaattctagcttttgcaacatgtattcagtccacgctcagaggccaattcctaccttcccaaaccgtgatcacagcccttgattgacagaaatgggagggaaaagggagagggagagaagagaagaggtttttcatcttgaagacaggaagagtcatatctggagagctgaggaaggtgggaggcctcctctgtgtacttctgttgtcacttgattggaatgactaaggacattttgaaaccagaaactgcattttatcactgaatgcagaattgggtttaggatcatccaggcttatacaacatagggggaagatggagtgactatcctgtggtaagaatgaatccatcttataagagtccatggcacagtggatatacagcatgcttatctaagcttaattactggttccatgtatgtacttcggcaagtcacttaacctctctagtcctaaccccacatctgtgaagtccacttagggttatgaagatttaatgtaattatgatataaagtgcttagtagttatagaagcaattgctatggtttaaatggtgaataaacagattgtttattggctcaggaattatgtgataactatttaagaattgtacttctggttgtcccgggagattaggattcttgtttggcttcactactgactagatagtattaatagttaagtcatttaactttgtagaccctggtttccttttattcacaactgttgaagttgaggatctttcatttggtaagcttgggaattctattttgttttgctgtttaaaaacctaggcctcttgttgttaacaatacctctattaactaatttgagttctgactcatctgctagatctaaatagccgtgggaatgtgaagcttttcacaaataatgctatgatttttcagataagtttttgct

SEQ ID NO: 121639 - DNA, 1035 bp, Homo sapiens
gtatattaagaattaaacatagtcactataactaacataaaatatcataaacataatatcaaaataagatcctgaaattatgtgataattgtcagttgcaaaaattgtcaatgagagtatcagaatataatcgtatttatataataatatgaagacaccaaaacaaagcatcttgtagcactctcagactcccaggaatgtgttcatagatcctcaggtgtccctagtctatattttgagaaatattgatctaaaccaactgcattctttttacagatgagtgtcatccagagtgtttgtgacttacccattttataaagacagtggaatatctgggattagacaggagtcttgaataaatgtaaagtgtgtgcacatgcactcttaattcaaaatcccctgccttccacgaggaagataatagaagttttggacccgttatacaatgttctgttgttcatggcaaaattattcaccagctaaccacagaatgacttgagacaatagtgtaatatttgatggaggaattatatttaatattttggataatttgagtttggatttattaatatgagaaatttgaaaggtacacagtgtttttgcttaattcagattttatttgcacaaatagaaagtatagaaaatgaattttagtaaaatttagtgagcatgatatccataaatgtttgcctgttatggcttttatctactgataaagaagattagaaaaaaaactagacacttgaaaaattttttttcattgataattttcccatataattttgagtaatctgagtaataaaatatacctttcagtaactctttcatgcagatattcaactatgcaatatcctgtattgagcttcctctctatggaaagccttgttccatattataagtgaaacctgtatcaaattaccagtgccttgggttgtttaaactgagatcacctaagtttgaggtacaactgctttcaccacttagcatgattcatatttctctatttcttttttggggtatattttttaaggttaa

SEQ ID NO: 121640 - DNA, 1050 bp, Homo sapiens
gagaattgctaaaaagctagtcacagactgcaaaacaacattttggtcaacaatggaccacatagaagatgttggtcccatgagatcatagtggagcataaatagaaacctaataatatggtgcttgatgtgggcattgcagatcaagtatgggaaatgattgatatttaatgctgcttctgggatatttggttttccatgtgaaaaaatatgtatataaataaaaatatatatcatctaggtttgtgaaagtatagtctgtgatgtttgcacaaccacaaaattgcttaatgcgtttctcaaaatgtattcctgtccttgtgactcattactgtatgtgattaaactaggtgagatttgacggtcttctaaaccaaggacatgggagtaggttagagaaaggtgaatttttcagatagtaggagagagaatctgaatgaaagacttgctgactcacaggagtggggtggggattgaagtggatgagggagaggcagacagaagtcaagaataaagcatagcttggtttctaggttggatgatttttgaatagaggtgcagtttcactgagatggggaatatcattgaagaacaggtgtatgcgtgtgtgtgtgtgtgtgtgtgtataaggtaatgagtacattttagatttgtatctgaaatggggatgaaaatgtgtttctggagctcaggagagaatctaaggtgtaggaaatgggtaaggattcattctcttatactgatatactggtggctgagttcatgggtatagatagggtcacataggaagagataatcttaagaagggaaagtttctgaagaagaagctgcctgggttgaagaagaagccacaccaacatttaagagaaagaaaggaagttatgaagcagagtgagagggagtggcttcagaaaaggaagggagtaggagagagccattacatgagacaagtgcagaagagtttgacaatagcatatatggccaagaatattaaatgcttccagaatttaagacagctaaagactaatggtcctaccttgcatgtagcaa

SEQ ID NO: 121641 - DNA, 1034 bp, Homo sapiens
caagcctctctcatcatttaagttacataactagtagctaagtctgagactcgctccctagtccttcaacttgtcttcaccaccaacttttctttcccaagaggcataatggccttgaagaaacagctttatttaatcatacagactgcagttagaacctactacttattaatagctgtgttttcttaagaaacttattttcatgtataaatataaatctcaattccttatttgtaaactgaggatgattatagctaacatatagggttccatgagctaacatatacaaagtggcttgtgcattgacagatatttaataggaatgtaataaattgtttatattcttttttccatattctaaaattgaactgtatccaatattaaatccacctgccccctctgtcaatattctgtgcttcacagtgctaatgattttctattacatttttttcagatatacccccatgaaagaacctctgttaaattttcagtaaattaaaacttaaacgtctccagatgggtccatgaatgactaaaaaaaatcttctagtgaaaaataacaagatcgtcaacagaaaaagtgacaaacataaagtatatctagccattatagaaaatgtaaaaaaaattatttgtattcacattaggcctattttaacacacaacactgtgtaaatgtccagattgacttttgttagaccatattgtcagatttattttagtagaagatgaagcacacacttcataatggagtataaaatttaccaaagttgtagataatccattcaaatggaatgtgtctatatgtgttttggactacttaacactgcaaatgcaacttcaaataattaaattaaaaacataaaaattattcccaaaagtaatatcatgggctactttacattttattcaatttaatctagcaaaaaattttgaatgccagatactgcaaagaattctacaatcacaactaaggggatggtcactgaccttggaagagctgatagtctagtgagaaataaaacaaatatatg

SEQ ID NO: 121642 - DNA, 1049 bp, Homo sapiens
ccgcacccggccgtagattttcttcttaacttgccttgccattcacatgtatatacctaccacacatagattttcataattgtacccaaatgctatagtttattgtgtacttgctattatttgctataaaatatttctttataataaacctattgtgttttggggtggtctactattaaaagtatagtttttttgttttttgtttttttttttagacggagtctcgcttttgccaaccacgctggagtgcagtagcatgatctcggctcactgcaacctccgcctcccaggttcaagtgattctcctgcctcagcctcccgaatagctgggattacaggcacttgccaccacacctggctaatttttgtatttttagtagagacaggggtttcaccatgttggccaggctggtcttggactcctgacctcaggtgatctgcccaccttggcctcccaaagtattgggattacaggagtgagccaccatgcccagccaaaagtatagattatcaacaataaattttaatattgggagctattcaaagtgcattctgtgtactttttctgtctcatactttctacagtctcatcctttctatagtctcatcattaattttataaaaatatttatctttgaaatatttacttgtgtaataatgactttgttattttaacaaaagagtaagtattcatgtattttggcctgtggttttttttgtttgtttgtttgtttgtttgtttgttttactgaatagcttgtggcttgccatctttatttaaccatctggtgaaatgtttctcttccatactaaaatggctttattctttaccattttacttgttaaaacttttattttagtatcggggtacatgtgtaggtttgttatataggttgtgtgtcacggggatttggtgtacagattattggccacacaggtaataagcatagtaactgataggtagcttttccatcttcaccctcctgccaacctcagccctcaagtaggcctcagtggtttgctgccttctttatgttcatgtgtactca

SEQ ID NO: 121643 - DNA, 1021 bp, Homo sapiens
tcagaatactggctgactctttaggtatgtgggcttatatgaattttttagctctttaatccttagtttttccattagtagtacccaacttgctgaattgtgaggtttgaatgaattattaaagttaagcttttagaatgggacctactacccagaaaatatttaacaatattattgtaatgtatcactgtcaccatttattactacaatctctcttgaattactcatcacttttctgacatcatcatatgaaacaagttttttaattcatgccagcttctccctcttacttacggtttaggagttgcctctaatgcctaaggaaacgtgtagccctctggttgtactgcaaaagtggttgcattttgaaggcaggtgtatacaacttccagagtaagaatatgtgtattcaggtgtaggcgttgtcagtttccaataagataatttataatgcttaatttatattaggaagatctcacattgttctcttctgtaaattatgcatgtatttgtaaatctaaaaggaactttgatttttctctctgattaaggtgtataattataatcttaaataaaagtgaagttcaaagtagcttcatttaaaatattaatagacaaaacataagatcagttcttttagggattggtttgtcagccacatgttagatctgcttagaaatcttcagtgaaataggaaacattgtataaatgttacctaatgtaaatactgctaaatttaagatatactaaaatttgagtattttccctttagtctcaaataagcaaaaggaaatctgagttatatgaaaatgaaagcatgtattcagcttttataaaaccattataaataagttatttttcctaccaagttaaataggatatgtttacatgttttaaattttagttttattagttacagtatcatattgtgaatagtagcaaatatgtccttatatagttctgggttcttgctttataatgtacatagacaaatatctttttaaaaaaatttttgtgttcc

SEQ ID NO: 121644 - DNA, 1036 bp, Homo sapiens
gttcttgctgttttataattaccccaaatgttctctgttacttctcctaatgattcttctttttttttcttttttctttttttttttttttttgcatacagcagagaatgcctgtgggtttaaaaattttttaactaatcttgatgaatcaattataatttataaaagtggagcataacagttaagagctcatgctatggaattggacagagctgatttcagatactgttctgccacatgcaaagtgcataactggactagtcacttacctttctgaacctcagtttcctcatctctgaaggggatgatgaaggttcagccctctcatagggctcatgacaattaatgagataatgtcacatgcttaataccagcatcttgtatgctccataggtgttagctgtctgtttgtaataatatttttgtgtttggttacacaaacccactttcttcatttgttttctgctattaatgccttttgaagtattgtgttgtttgtgaacacatagtacaaattgacttttgtttttttaattatcaattttgtttctgtaactgcacagaaaagtgataaattgtgagcttatattttcttttaatacatagatatcgcctcccaacatacatgaattttaagacactaaaaaccccttaaagatcttttcttaatcagtgtttagtaaatgggcttacattctagcgtatagaccaattcaaactgttctacagtagagaggaatttgtatgttggccagtttttcatacagtgatttctaactctttccccttcagtatttccctaacatacactttctcatccagtatttcttttagaattctcacacttttgccctcataactcactttcatattcctagagctcttttcttcacactgattgtgctgctccttttcaatttttccaaccttatggaattattagtgagaaaaagcaaaattattattatttgagacggaatctcgctctgttgcccaggctggcgtgcagtggcgccatcttggctcactgcaagct

SEQ ID NO: 121645 - DNA, 1035 bp, Homo sapiens
tttcataaggtccttggtgtttcttaatgtcttcctttctcttttttccctccccttttcccctccccttttctcccctcccttctcccctcccctccctcccttccttccttcctttcattttttctctgtgaccatctgtatgttcttttctttttgtctgccttttagtattaaaatggtcacctgacgaccatctgagttgagctttgtcaagaaccaagggctgaagttctttttgttcagactatgtttctgttaccagtattgagggactaaggactttcaagcccttctcattctcccagcctgagagatattaagataagggaaaactagattttgcaggtaaactttgatttgttgaatgcctgctttgtgccagacattgcatgctacgatatattctattaaaaggattcaggaagggcatttactcttttagctactggagtttgattttctttattatcatgctgatcagtgtacactggcagtgtggctgattgagtggaaaagggagagctacactgtcttgtcactcacctagttgataacagattcaggacaaggactctcgtctcctttctaatacaatattagccctaaacccaaagaagttgagatgttttgtcattctttagtttttcccaaagggaacatttttcacaacataaaaagttagctgattggaattaacttatactttataagagatcagtgcatatctagaggcgacatagtagaattttcaaacaatcagaaatctcataaatcggaatctaagggaaaacaaatataccctcctgaacgttgtataattgggtatacagaaaactttctaattttattttgccttcatttttagactaacttgcaattaccccaagttgctaggtagcaaaattattatggtactagctcagaatttgctgtattttaatcagccttagtgactgaaaacacagagagaatgtcaatgagggagaaaggttttcctttactgcccctagataaagcagatgaaaatctgtt

SEQ ID NO: 121646 - DNA, 1076 bp, Homo sapiens
catatattcttaaaaagactgatatcctattcgtagtcttctcttatatatccttgaattatcttccatgatttttatattttatatacttataatagcgtattataacaacttaatgctacataatttacagtaatcgtttccaaattaaggaagccctatgtgtaaaatcacaaatttatgtaacataacacaggaacttttattcatataagaaaatcattattcactttactgttttcctttatttcagcatcatttattacaaaattaatactgttttcgaaaaaccaaaacaatatattataaagcacaacgtggagtcttctctcacctccttgtcattcccagcctcaaagggtaaccactgtttacagttcaagtgtgtcttcacagcagatgtttttctatgctcgtgcagacatatagatgtattcctggaaagagtgatgcttgcattcttgaggagttaggagcattgctatttgaaaaaataaaaatccagtttgatgatgttagtcattatgctgaaaggagtgattttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgtattaaaagtcctaaagttgttcgtggagatttccagttgctagggaataccaacacttatttggtgtttgatattgtaaatcatgatagttattggggccaaagggaggtctgtaaatgtccagtaggttctctttggagctaatttgtgctgtttgcattttctttctgccccaatacacttgtcactggaag

SEQ ID NO: 121647 - DNA, 1053 bp, Homo sapiens
cacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtctttgggttgtatgtgttctttttttttcctttagtaaaaagtttttgtttcagagtaatagcttgtgaattggttaattaaatctgaattaaagtacagtattcactatagaaatggtgacttctcaactttattgtatttggttcagttctttatgaccaggatggttatatgttgacagaacttctagaatgtttcccctcattcttccctcttgcctgaacaaggtgtcgtaatgaatgtactcacctccccagtgtgtggtgggtggtgaggcagaatttttcctactgcctctcttccgtgagatggacagcctaagcctgtccattacaaaactgccaagttttagctgtagctgtagtgtttgtcgtgatgttgcaaagcaatttttgcccatgttctttatattattacttggataaaaagaaaaaacaacagtagcaacaacag

SEQ ID NO: 121648 - DNA, 1037 bp, Homo sapiens
gattacaggtgtgagccactgcgcctggccaacacacgtgtttaaatagaagactgtatatttcttctgacatcttgctgggaaattttacctcagagtgaaaagaatgttgttcagttgtcagctctaaattaagttgtgttctcaggcaagttgacaaattgcctaatcttttcttatgcctgatttttaactgttaaaatggtgattggaggtggttagggatgacaagacattggggaggaggctcacatctattaaatgccaattatgtgccaagtgaacaatactttatttcctcaggcttcaagtacaaattactgaaactaaactaatggttacctgtcttgtgtgactgtttttgccaagtgtagattcttgtaactgtctttgaagtaggtgaaaaatcaaataaggtattgtctccaaagccctagaacatcagcctatgcctctatgacagacttttcacacatcattgtcattattcgttgacatcattgattcccagcccccaacaggaaggaatcctgacttattcatcaccgtgcacaagagtagctcaatgaataatggaatttgtggtactcctgttataagtataataatttagatggaagaaaataagtgataagtataaagtgatctccgaatgtaatctctttaatgtcagctatgactaaaactaagagccttatgttcacagattgctacttagtgatgccatttttttattagaagaaatcgactggtacatgtatatttcattgtgaggaccccaaatctacttgttggcttaagcaagttgaaatttatttaaggaatctaatttcagcaagaactctaggacttataagaattattggccaggtacagtggctcatgcctgtaatcccagcactttgggaggctgcggtgggcgactcacttggggtcaggagttcgagaccagcctggccaatatggtgaaacccgtctctactaaaaatacaaaaatttgccaggtgtggtggtacatgcctgtaatcccagctact

SEQ ID NO: 121649 - DNA, 1074 bp, Homo sapiens
atatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcaga

SEQ ID NO: 121650 - DNA, 1155 bp, Homo sapiens
gctttctccttgccacagagatagcaggatacctgatttaaaatgcaggatacctgatttaatttcactgtattgtatccatggaaagtgatagttcctcaaaaggaaattggaaggcaaatacatcctgcttagtttataattaaaagagtaaagagtcttctttcccttcctcctttcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttgg

SEQ ID NO: 121651 - DNA, 1033 bp, Homo sapiens
gtaatctctgcgaaagcttccaggttcgctcatcgtaggtcactggaaaaaattgtagcattgctaaagagtatttcagagaaaattttgcatgcaaaaatttaggaagatgagtgaaactcatcattctgtaatctctgtgaaagcttccaggttcgttcattgtaggtcactggaaagaattgtagcattgctaaaaagtatttcagagaaaattttgcatgcaaaaatttaggaagatgaatgaaactcattattattattctttcagtccctggctatcttcttcagtgactgctccatccatggtagccccagtcacttttgcatctattgtagaagaagaactacaacaagaagcagctcttattagaagtcgagaaaaaccgttggctctgattcaggtaaataacatacttagtagggtttaatttagagaagaactacatttcctacttaggttttaagaaaatcgtgtttgtttgttttggacaggtgcttgtatctatgaaattaaaatgtaaatgccaggtaaaattaaactgaggcatctagcagtgtatgtattagttgtagatattcagggcaattaatttatgactaataaattatgataaagcttatatttttgctttggtgatactttggattattttagtttttttaaaatgaccagtagagaatttggcagtattctctagtgctgcacttggcttctgtatcagtaagaattctaagattgtaagcaacagaagcccactctggctaacttaaggaaaagataatttatttgagggatattaagattccatagacttagctgaaagaccagacagccaggcttggaaacagaaaagacgcatagtagcactggaaagctcagaagcaagatttagaagacttgtacaacaacagaaagtatctcacagaataaagctattggaatgaatgaattttagcaaccattttcagtttctttttccttctgctcaagattcaaattgaagagcgcatgggtatctcatgattctac

SEQ ID NO: 121652 - DNA, 1047 bp, Homo sapiens
tttaatcagcctgatttttagcacctacagtaatcctgacatgctcaataaatgtgtataaatgaatcacgaagtcaatattttaggtcctgttaatttactctctgtttgactttgtgttgttaaacctgtctagtcctcagttttctcattgctgaaagagagcattggagcaatctagataatctctagggacctttctagctgtaaaattccataattaggtccatctgtattgtacctttttaagtttttctccttactggaatgcttcttactgctttcatcatatacctcttttttattatcttctcaagttcattccatccatgaggccctctcaaatgattaaatattgtgatttttatagttgttatagccagtgtgactcaatttgttatactgtcttaaattctgttctgttattttatatgtcattttgtatgttgtttcctcaactagcttgtgaattcttagaaggtaaagatcatattttatatttctgtcctatctgtaatcctttgctcataaagtatattagttccttacaaaattcggctgttaattatctgatttagagattattggtttatctggtgtgtgtatatatatatttattattagaaataggctatttcttgcagtatctttctctatgatattttatacagaaggttttataaatatagattattttgtttacttataattttaaaggtaagcttgactgcactcatttaatttgcctctggagtcaggagtttacaattcttcctctgtatctattaataagcagtttgactaatattactagaagctttaatctttaattttggcatttgttttgcagatgctctacccatggtaccccaggaccagaaggcaaccatatttcagatttaccacttctagacagtcccaagtaaggttaattgataagttatgggcctccaaagctaagttgctgcttagcattgaaaacattaaggctgagtgcagtggctcatgcctataatcccagcactctgggagactgaggcgggtgga

SEQ ID NO: 121653 - DNA, 1055 bp, Homo sapiens
aaaaaagcactcttagatgacaaattttgttttaaataagaaagcataagagcattatttccccaccctttatatattaagtgtgatgctgagatttgacttttccctctttgtattagcttgagaagtgtttttctaacaacatgggagattataaacaagtcaggcattctagtgggcttctagactgaaatgatcaatttaagttggccattttatggtcctagtgtgagatcaagacattttggtgtaattttgtcagctttctacctaaaaaatagaaatatattttgatgtatttactttttattatggttgccctttcaacatttagaaaataatcttaaatctcttttctagtgtactaattacttcaaattttttttttacttaaatctcttttctagtgtactaattacttcaaatttttttttctaggtataatgtatacaaagaaaaagtgatgcttgttttctttctttttttagaatctcaaaatgtagattttatttgtagtgttcttgtggtggctgatcaacttctcataacccggttgaaagagatttgtgaagtagcattaactgaaaaacgtgagtaattttgagtttgaatattaatatgttttcaggttcatcaaggattactgtactttattgactttatgattccacttatggtaaaatagaccatttttttggtaccacgaaaacctgccaaaatatgtaaattattacatgccatcatttgtaagtgaattcttattttagaaatatgtgaaaatatatatgacttagaattgaaatgtaatatttgtattgaaatgtcataaaaccttgaagaataaagatggtgtcagatttatttgctaatttcaagggtgagagtttaaaagtgaaatttttgtactcttgccctgatcttggctttaggtgtttttagctacccattttctactatttgcagtgattttaaaaatttaactttcccattatatatctgaacaaagcacatctctttttttcttgaactcttctttcttgctctcttcattatct

SEQ ID NO: 121654 - DNA, 1201 bp, Homo sapiens
attgcaccattgcactccagcctgggtggcagaacgagaccccgtttcaaagaaaaaaaaagttttgtttttagctattcatgcttcctctgtaagtgaaaaggttttggagaaggataaactgtggagttgtttcaactgtgcttggcccagattagctactacaaataagtgaattacagagacttaaatatgatatcacttagtattatattattaacagtttttctggaataaaaaaaaggaaaatcagaaaaatactttttgaatatttgtattcggctcccttttcaaatattgtctttactctaaggcccttatcttccctgtggtggaaaaagatgaagtattttattgtatgtattcctgcaagttatttattctctgccacctttaagagaaaactgaaagttaagccaaatcctataatctttttcactaaatatgtaaagaaattgctcttgcttcaattaaacattttcttgcagttcatttctgtgtgacgtgaccatgaaatcagtggatggaaaggaatttccttgtcataaatgtgttctttgtgctagacttggtaggtgcactttttaaagctgctgatttatttgctgtagtattgtttcactattcttattgcattgaacttttttttcttttagaatattttcatagtatgctgagtagctcatggattgaggtaagatttaagtaaaaagcgcctaggttggtaactatgtttctttatattttgtgcaaagtatgtagtaaagaaattcaaaatcagaactggatattttagctcagtttttcatttatattaaactttatgcttgaggctgctggaaaatagcaacacttagaatttaaaattattgccaagaagctacttaaataaaaatttccccgttattatttagaaatgtattaggaacaccactgtgtttcttgttttctgaatttttttgttcctttttcatgttatgttttaaaattaaatttaatattattttagccatgtgttttgtaaattttatgttttgcatttgatgtgatttcctgttcagagtgttttgtaccaataacccaaattagaatgtaatattttattgtttagaatgaattattttactttattttgtcttattttatttaggcttccagttgtgcagctctggaaatgccaatacattctgatatattaaaa

SEQ ID NO: 121655 - DNA, 1439 bp, Homo sapiens
ctttctccctacccatcctttttttggggaggtacatggatatgtctttcctccatttgcgggcagagctatctctgggacttcttggattacattaatggataggaaagctgttggtgggtttgaactctggtttgtgtatgtaacagggatctggagtggcaggcaatgtggtatgctggaaaggtctttcaagttagacatacatatctcttagctttactattcctggctgggacaattttcttttacctcagtttctcgaactcctgggctcaagcgatccttcttacttcagtttctcaatataagaaatgggaaagataatatttgcctcatattgttgatatggttttgtcatatgtaaattgcctaacaccatagtatcatattatgaatcagattatttgaaattctttctttttttaaggtatttatgttgcttgtggcagttaaaccttcgttgtagggtgggaagagaggaggggtgtgtatcgtgtttcctgtttaaaaataatgaaggggccgggcgcggtggctcacgcctgtaatcccagcactttgggaggctgaggtgggcagatctcctgaggtcaggagtttgagaccaagctggccaacatggcgaaaccctgtctctacaaaaaattacaaaaattagccgggaatggtggtgaatgcctgtagtcccagttactgggttggctgaggcaggagattcatgtgaacctgggaggtggaggttgcagtgaactaagatcatgccaccacactctagcctgggcaacagagcgaggcttcgtctcaaaaaaaaaaaaggaaaaactttgtgctatggctttgatttgtcttttgtcagtaatgtttaatctattttgaattctaactaaaatggaagaaaaagtatgatatttctttatctcagagtaggagtttgttgagatacttttctaggatacagtattatatttagatgtaagctaatttgttggattttttgttgtatgtttatttttgtaggggaatatcaattgttaatttttatctatccttgataggttagatggagtcagatttgaaaatgaaaaaattaatgttattgccaagaacactggtaataaactgaagctaagtcagaaaaaatggtaagtaaggaaaggaagattaacatttcatgtctggattttggcacttaagtgtggaaatagatctctgcttacccacatatgaagcaaaatgtataggtagataccctcttaccttttctagtattctgcatttctggaaatgttggggagctgttgaagtaaattgataaaatattaactgctgaagacatcaaaggagttttttctttccgatgactttctaatagagagtggaacttttaatttttattttttcttgcctgaattttgtgccttgttataattaggaaa

SEQ ID NO: 121656 - DNA, 1045 bp, Homo sapiens
aatattcttgtattttaggaaatgccaaatttaaaattttctaaatattgttaaaaaaattgcattttaaaggagaattggctaggtatgaaaaaggatttccttcatattttttgaagcataatttgtttttgtcttctttctagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggtatgatttctcttttatatctgttcctgtacctcattcagtcctcctttaaaaaatttcccacccttactgtgaaaccccatctctactaaaaatacaaaaaattagccgggtgtggtggcgggcgcctgtagtcccagctactcaggaggctgaggcaggagaatggcctgaacccgggaggcggagcttgcagtgagccgagattgcgccactgcattccagcctgggcgacagagcgagactgtgtctcaaagaaaaaaaaaaaaatcccaccctttttgccttgctttgct

SEQ ID NO: 121657 - DNA, 1573 bp, Homo sapiens
ataaaagagttgagtataaaaacttatatttgattttgggatgtgtatcacttacattgaaatggatatagcttatacttctggatatttacttcctgcaaaatagagtctcattaagaaaaccaagctctgaaagcatcagtcagtctcaatcagtatagtctttttgtgtgaataactttttagcgaccttgtcagataaccattttgtgttctagttttcttaacttgattatgagggaattggacttttaaaaatcagcagttccaatttttcaaatgaaattgtgcttggaataccggtatatgaaacagataaaacaattgctactgtggattgggaagcctgacaccccatctctcatcattctccatcccttagcaagtcccctggagctacttttcagggactctgaggtttgcagaaccatttacaaccattgaattctgtaatgacttttctaagattttgttttagttatataattgagttatgcatacatttacttttttcttgagagtaaagtttggattttcatagggggctcattcttcttgtaaagagatagtactacaagaagcctgacttgtaagttgtagctttaagattttgtttttctttagcattgtagcacatctgtttgccctaaacaggtaatactggaaattgctacttcttaagaggagtgcctttgaaataatttctaatgcttcaggcttgcttaatatacttttctgaaagatatttctttaaaatcatcttgatttttcttatagtagctatctttttctgtggaagaataaacattgaaacatactaatgagagcttttattttaacagcattgtctcttgatatcttgatttaaggttttggttgttcaaatgctacttgctttatatttcaatgtgatttggttttgttttaggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaaggtcagttcatatattgaacaatacgtaaaagtacctttcaattatcctttaatttgacaagtattaggttcaactgacaagtgttattaggttttacttttatgtatttatctttgtgattagttttttaatgcctgtttcctattagagtgtaaggttagtgatggcaagggccatgaatattcgtctatatccttagcctttggcatatttcctggcgcattgtagtcactcattaaatcacctgttgtatgaataactcagttattgtgtgccagaacaaaatcaagaatgtttataattactcagaaaattataaacgtattcttcaaaatcataaagccacagataaatgacttttgtaaaatttaatgatttacttgtatttcttttatttctttatagattattcaagtctgtaaacatttaatatatatttactatgtgccagatataggggaaagttt

SEQ ID NO: 121658 - DNA, 1060 bp, Homo sapiens
gcagtgaacaagacagaatcccttctttgtttaagtttttattctactagggggagatagaccaaaaccaaaaccaagcaattaaattaatgaacaatggccgggcatggtggctcacaactgtaattccagcactttgggaggccaaggcgggcagatcacctgaggtcaggagttcgaaaccagcctgggcaacatggcaaaacctcatctctactaaaaatacaaaaagtagctgggcgtggtggcacatgcctgtaatcccagctacgggggaggctgcggcaggagaatcgcttgaacccaggagatggaggttgcagtgagccgaggtcacgccattgcactccagcctgggtgacagagcaagactccgtctcaaaaaaaccaaaaaaaacaataacaacaaaaattaatgaacaaataggaacatgcttgataaatattgatgtattagagttatttttgcctgcaactggaaccaactatggtaacataaacaaaatatattgaagggatatcagatacctcgcagaataaacaggtcatcaacaattaactgtcaaattataaataagaaaaaattcctcaaactaaaatagagtaagtataaactaaataaactgatttgaaattttatgtctctccttctccagataatttttttttgtttttttgagacggagtttcactcttgttgcccaggctggagtgcagtggcgcgatctcggttcactgcaacctctgtgtcccgggttcaagtgattcttctgcctcagcctcccaggtagctgggattataggcatgcaccaccacacctgactaatttttgtatttttactacagatggggtttcagcatgttggccaggctgacgttgaactcctgacctcaggcgattcatccacccacctcccaaagtgctgggattatagtcatgagccactgcgcccggcagagtgtggctcctcaaatgcaagaagagttaaatgtttatgttcagatgcactcccacacagacacaaacccagagctagggacttgtagggacagtgtatt

SEQ ID NO: 121659 - DNA, 1002 bp, Homo sapiens
taagtttgttaatggtagagaagattcctcttatatctgaaaccttggggtatctgtttaattcccttattgtcattatagggaaagctaggttagtaagagttaaagcatctctcagctccattcttacccttttccatctgtaaaaccttggctttttttttttcagtttctgctggaaagttggatgactgccaaccctgctgagtttgagaaggtccctgggtttgggtttcctgccatcctaggggttgccatttaggtgttagcatttagggctacagtttgaaatagttatggtctggactgaattttggtcctttccttcctgtgagattttattgccccatcgaaatcctcagtcactctagccaccttggctaatagaagccaggaaattgtgccgttgtcaccttgcccttagcttgactgtcttattggcatcagagccctgctgatcagtgatagatacataacagtggatgtattccactgacggttttcccctaaatcctgtattaaccattcagcattctcatgttggtaggctgtctgcttttgttcagcatatttttttactttgaccttccaacacttctttaattggaaggggtgcagtgataggtgtcttcatgtcagttccgtctctgatgtcagctgtagcacttcaggtattatggattatcaggaagaaaccacacacattttaatgaatttaaatttgataaaacttcatagctataacatttgtaaattgcacagtaaattgtcagtttcttaatgccaaagatataaaaccttagcagaaacttgttgcctacaaaaagctggaatagagacagattatcttatgtagctcttttggggcttcttgattccatgacaggatgcatggctggtaaagactgtttatgcttgtggagtcctgctgtatctgttgttgctaaaccattgctcttttatactggtggtttacttactattctggaagaacttgcttta

SEQ ID NO: 121660 - DNA, 1292 bp, Homo sapiens
aaaaatacagcatagaaggaatgaaggactggaaagaaagagaaactccagagtacaaccaatgtgggttaactttaaacatgagagtggaaaaatggagtaaggatgactgataaaaatataggtaccataaatatgaaaggtcgatagatttaagaaaaaaaaggaattaacccgtttatgccagaggttgcaaatgttttttgtgaaaaatcagatcttggcgatgaccttgagcattaggatataaataactcccgtaagcttagtgttccagtaatggaacactaagcataaatgggttaagggcatctaaatatggaggtagttgtgttctaaagtactcaaggagagcgagagacagattttgaatttttattttctcttctctttctcttataggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaaggtaattgtcatttgtttattttaaacgtatttagtctggaatatgtttttcttaatcattttcatacatcctacatgctttttggaaaatatttgcattttttcttgcttgtttgctatctcttactactgtaactgatctttggaattaaaactccatatatccttttacttaacttttttgtgatgtaaaattttaaacatttatcatgc

SEQ ID NO: 121661 - DNA, 1049 bp, Homo sapiens
tggatttgaagccattcctgtgggcgctcatgttccttatccccttcctggagtcacaagtttgagtccaccctggggatactgactctggggaagcaggtcgtgaaatctgataagtggacattgattgctatgtaaaaaggaactgattctttttggagggtggagggttgagagagacagagaagacaggccctttgtttttgtaacaggcagagctgtctggctcaaagagttttagttcagctgcgaattaggtaacataggccgtccttgactcctgttttccaacgtagttcataaaacttgactgtgttagccagagattcatgtagcaccttttaacttatgcctcgaagtaggccatttgaaatttatcagaaatactgaaaggatatgacttttatgagtagtagtgtttcagtgcccataaagtggtgtaaattcacaggcttgccagccccctcttgatcatttctctttttgtattttgaattccttaacttttatttgttttagaaattgaggcaaggtagatgaggacaaaactggtttctaaaaataattacatttgcaaatatttgcagaagctttagtcaaaccagagtttacttcaagaaattttttaggccgggcgcggtggctcacgcctgtaatcccagctactggggaggctgagaattgcttgaacccgggaggtggaggttgcagtgagccgagatcgcgccgctgcactccatcctgggcgactgagtgtggcaccatctcaaaaaaaaaaaaaaaaaaaaagatgcctgtaatcccagcagtctgggaggccaaggtgggcggatcacttgaggtcaggagttcgaggccaacttggtgaaaccccgtctctaccaaaaatacaaaaaaatcagccaggcatggtgatgtgtgcctgtaatcccagctactcgggaggctgaggcagaatcgcttgagtctccagctgccctaccaaactgcttttgaattcaattattttgaattgaattccatggtacttttttctactacactatact

SEQ ID NO: 121662 - DNA, 1737 bp, Homo sapiens
acgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaaaaatatttctcaatgtcttaatgtaaattgaa

SEQ ID NO: 121663 - DNA, 1035 bp, Homo sapiens
gctgccaagcccagctaatttgtatttagtagagacagggtttcaccatgttgaccaggctggtcttgaacccctgagctcaggcaatccaccctcctcggcctcccaaaatgctaggattacaggcgtgagccactgtgccaggccacaaattttatttttattaactataatttgctaacaggctcaaaagctgaagttttttttccttggtgggattaatagtttttcaaacctatggtgatattctctcccaatgaaccccttagagcactggaacatctgtgagccagaagtcctcctacaccctcactgagaattattgaaggcatttccctccactccttaccacatttctgaaatcttacttttcttatccatactttctttgttgtacagtattggaccaggatggaaagttaaaaatccaaattaatttttgaaggatgaaagggaaagagtaatattctaaggatgtgtataatttcgttttctccaagtatgtgattttgtatttgtgcaatggcttgatgttattttttaaaaagtggctgacattctgggcagaaattgcttctgcctagaatcaggtgttaagaaatcaattttctacattatgctggctaaatacatgaacacatagtggcacacacacaaacacatattcttcatatgaggatttagagggtagctagtggaatcttttcatttgggggctgccatcaatctttggaaacctgttgtaattgcctgtatggtatgtgtttgaagtgtagtgtttctggcaaatgtaagtcaccaggaaggccaagtgcagcaccctgtacataataggattatgcagaggcatgctcactctgtctgtgactgctagagcagggaaagcaggcatccccagcttaactaataaccttcattcacctactcaaaatgctttgtggcaggcttcctgtttttcttcaaaccactgctttttagacttttactttcctgattctttctaggaattgagtgatacaaaagattctttttaat

SEQ ID NO: 121664 - DNA, 1072 bp, Homo sapiens
tccatttttctttgtgggcacctttttctttatgcagccagttttacaagaagcaggtgaaattcttcagctgatatatgagcaagttatgtccattaaaattaatgagagctgactatgtgcactgagggaagaatatacttcaaaaagttaatttacacaatgtttcttgttacgttttcattgtaggatttctttttcaattatgcttaatgaattgtattgaatgccctgtctctaaggttagtgacattaaatatgcttctagttctgtttcatgtcttaggctgtccaaagcaatcttttagaagtggaattaatcttatcacctatgatgtttagacaaatgtaatggttttcaatatagttcaataccaaagtctccacagaaagagaattcgattaagagactagtaaaggagacagaacagattgcttgtaaaacatgtgacttttggagataataagtgacactttatttattaaaagagcatttctggttagaaaaataaacaaaaccatcacataactgtggggatcttcaggggaggaaatgggccttttctcccagggatgctttcacgggttgtgcacagtttgtcaataaaccttggtttcattaaagagtgttcatcctcatactaatgaaccaaatttgccgagaaaccccagaacagcaaaatggcaaacctaacccacacatttatgttattgtctacttattggcttctggatacaaattgatcctctgttggcctgtctgtctcagaccttctaataggctcaggaactgcctggggctttcacttacaaggagccaatgaatctggtcatccttggtggttgttattcttaataatcttttcccccgttcttccaaagggacacctaataagtgccttaacgctctatcaacatcactgacattattattgcagaaactttttactgtttcctgcttctggtagctttaataggatcttggagagcacaaaggtaatatttctgcttgtcagaaggattccttggattgagcttctgtaatttgagcatttgcttttgaggcagcaga

SEQ ID NO: 121665 - DNA, 1080 bp, Homo sapiens
gcacaaagggaaagaaagcagatgtgaatgcttatgttaaaagtcagctaatttaaacctaaggaaaaaaattcttagctgtggagagggccagaatattgaaggagctctgcagcatctcctctggaggcatttctgaataatatctcttgaatggcttagctgtacagggctgcctccaggcttagcagagaatatattctgggtaccattgtaagtgttagggaaggcctgaaaatcactggcagaaaggctaatgttatacagttcagattcccccaaggaagaaaatgtttatgcaattcaactttggtaacctgagttgtaagctacttgttttctgcaaacatcagagttaatagtaccggtaccctaaactactagttcacagcatatttttggatccatttttctttccactgaagaacaacttttaacttgttatcaggaatgttctcttagattcagagagaaccacagaagtccgttgccagtttgttactgtgacctgtgggacaggggtaaccccttcagaagtcctcacccacctgcacacttgccacactccctgtgactacttcagactgcattaattgagcacagagccatggggccaggaaaagtgtggcactacagagaggggcaagtgaaatgctgaggcttcctgggaaacctggactgactcacctgcagcctgagccaggccctgctccagtcccacactgctttatgaccccaggactgtctctgtgccctggctgtataaatatctccctgaggccttcaggaagtttcgagtagcatagtacgtgagtaagttatgcagtggaggaagggaagaaaggaagagtgtatttgaaaggagagctgttgacaagaagtcctataccccatccatctttctcctaatatttttaataaacatgtattaagcacagtttgtatatgtaatgcatttattgaacagtggaactcataggattgaaatatgaaattttttcccccaatcttcaaccacattttggagttaggaaaggtgttgctgagtttctttttgttttatttcttattttcgtattt

SEQ ID NO: 121666 - DNA, 1044 bp, Homo sapiens
atgggaaaaggcatattctttattgattaggcaaatgctagctattttaatctgtatctcaaatagcgaatttggatttttgaagcttaggtttgtttcaggaattgtcccagagcactgcctgtctttccagttacagtgccgatcctaagtggaaaaaatggaagtatatgaacagactagatatttttaacttttcatttattgtagttaagggttatgggttacttttacataaattacactggactaggagtcaaaatagtgtgagttcaagttctgattcttctgtgttctatacacatgagttggggcaagtcatcaaccctgtctttgttgcccaccatctgcctgttttaagttataaggctatttggaagtgctttttagaaatataaggtactacttattcaaattatttggcaacttttggactatcaagaagtggctggttttggaaaagtgaatctgtgtgttactgtttcttaagacttgaaaaattttctctgtgcatgtgaattatgcatacaagctaaatgtattcccagtatttagtagagggcagaataaaatgtaaagttcaatgtatactctggggactatgttaaaattatatattccttttaagaaaagctgaatgacatttaaatgacatttttctgttctacaggaaccaaaggcaaataccaaagtaatttgtaagcgttgcaaggtaatgttgggagagaccgtgtcatcaggtaagaatttcataacaagaagccaaaatgattggcttcttgcttaaaagccagaatgatattttatagtaaatatataggaaagatagatgattaatatatgttgtggaattggtgcttttcaaaatagaccccaagtaacataccatccaatataccaagaagtttgtatattttgaccttcataaatacagagtattgaattttaagtattaagaagttgagtcattttcagagtttcatagcctctttgtagatataaagcaatagtataaagtttgttcttgggcctatttcaagaaaa

SEQ ID NO: 121667 - DNA, 1014 bp, Homo sapiens
atcctcagagtgactgtcttgagtaagaaatgaggtgactttaaatttgcagaggagggaacctcatctttgcttgaattacctaagggttgaagttattgcatgtactcggtgacaggcccactttatcctgaaaggttcaggggatctcagtttacattgtagttgaaccaagagtgttttccttctctcaatctattttaggcgttggttgaattctcagaagaagtttctgaaacatgcattcctagacaacaatagggattcctagaagttacagttggaacatgttaaatcagtgtaacagtatttccgggttctgcttacagtaaaggatatgctggttcattattggctgttatttgtgtttcattggaacaggatgataatatgaaaaatcttttatctgttgcccccattttttctgttcaggaactgtatcttctgtgtcagtcccttttacagtcatggaactgagaactaaaagggcagcactcactctccctaaccctgaccatcggcaggccctggaggcaggagcaggagaatggggacctgggtttgaaatccagcttcttgacttagtagctgggaagttgtgtttgtactacctcaggttcttctaatacagccttctaataaggcctattttccaaacttgtcaagagagttaaaggatgtaacatatgtaatagttaatgctcgacaaggtcttttaaattggttttatagactttctacccccttttccagattgctcttattagcaaactagcaaattatctagtttagtgtttcaaacctttttgtttcaagactgtgattcacatactctgcaggtgccgaggaaatgaattccctttctctttttctctctgagaaacagtggacttgacttagcctttgcctcatttaagcaaggcttacccaaaaaccttttcatgtcacacctgtgtgcctggcatatgcatgcctcttcagtaatgcagagaaatccttagtaaatgactcaag

SEQ ID NO: 121668 - DNA, 1055 bp, Homo sapiens
aggaagtgacttgaaagttttagccttcagtttgtgtttcagggttttttaaaaagatgacttttcaatgctaagaacacccttttaaggacaactatagtaaacatcatactggtatactgctattttgagtgtcaaactgtgaccctcggtgtggaactagctacagtaggatctattagagcacacgcattagattgatcccccgcagcaacgctctcccaggattcctctatatcagaaactgaattttaaacccgacccagtgcatcatgctgggtggccagcagagggtagtgtttcactgaaaatttgtttgtgggtctggaaaaaatattttggattcctaggtctccttttaatctgctcaaagttaaagaataatactgtttattgcaccttagtgctatagggatttctggccaccccttaaaaactgttaagatttttaattgccaaggcgtaaaccttctagcatcagttttttaaaatcttaaaatacatacagaaaaacacaaaccaaatccacattgcttgattctgatggatatgacctcatttctttaattagatttttatagacatattttagttcattcttttaaatgaaagtttccttatttcataaaagaaataatagaaactaagggaacatgcggccttatgctgctctttcccatagtgtgagaaatatacatttttccccacagctttcaacgttttaccatagctttcattagaaattgatttttgatctgggaaaactggactctttttggagccatttcattcccagggaggtgtccaataaacattagtttgagatctttgtttgttcatatggttatatgctagactggacataaaccttatttaaataaaattaaactcaaagttggctgggcacggtggctcacgcctgtaatcccagcactttgggaggccgaggcaaggggattacgaggtcaggaatgcaagaccagactggccaagatggtgaaaccccgtctctactaaaaatacaaaaattagccaggcatggtgatgggcgcctg

SEQ ID NO: 121669 - DNA, 1045 bp, Homo sapiens
aatctaaccagacttaatgtattttaggatcaaaacaaagtagaggagcatatatatatcagaaatgttacataaacaaatatgacagagaaataacatgattctaaattgaaataagtataagaaaattttctatgcttttacttactaaattttcacagtcatttttccaattcctaggaaggaacacacaagtagttatctttcaggctgtctttgaatacttccatgaccctgaacactagctgaggagagtttcaaccactgctaacagtaaggaacattttcaagttagtcattacctttgtagtaagatcatatgaacccgttttaatactttgtaaccttggttcctcctgcaaactcttttgtaggtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggtatgtctgtattatccatttcataaaaggagtaaaaattagaaatctgtgtttgtacttgttagatttctcgaaatcttgaagtaagaatgcaaaaacataaatgaaccttagattactcttggtagtgctatttttcttcatgagttgcatgcctgtgtagtcaagcatattaaggctttggaagttttaattcaaagaaataacaatgcttgaaaaatatagttatcgccatgattatcagctataaaaacagaagagaaggaagcaaatatgctaactatgagggctagtaaatttctgtaatggagcatcagatatggtgctggaattcctggcagcaaaatgaaaacctacaaatggaaagcagtaattcctgtgttctttccaaatgatatatagcaacaaggaaacattttctatcctggcaagctatagttataatttggtactttttacaaaggcgagtatatacaagca

SEQ ID NO: 121670 - DNA, 1059 bp, Homo sapiens
tcacccaggctggagtgcagtggcccaatcttggctcactgcaagctctgcctcccgggttcacgccattctcctgcctcagcctccccagcagctgggactacaggcgcccgccaccacgcccgactaatttttttgtatttttagtagagacggggtttcaccgtgttagccaggatggtctcgatctcctgacctcatgatccgcctgcctctgcctcccaaagtgctgggattacaggcataagccaccgcgcctggcctcagatatcaatcttaaatatttgagttaagtgattcagaaaaatgtagaacagtctttaatgtctttttgttttttattcttagatatcatttattaaaagttttcattcaaagttgttgagactatagtacattctacctttttaagcttgaaaactggcctgagaaaaaaataggataccttgatctctcagcaactttcaacatggttgactcttctccacttaaaacagtcttttcctttggctttcattgtaccacattttcctgttcagttactctttctcagtctcctttacaagtctttcctcctctacccaaactccacacagagtttcttagggctcatttagtgcagcaccttcttatattttcactttgtaatctctccttagacaaacttagccatacccatgatttattttttattttaaattttattgtgtacatttaagatacacaacatgatgtgagataccaacagataataaaacaattactgtagataaacaaattaacatagccatcatcttacatagttacctattttttgtgtatgtggcaggagcagttaaaatctatttagtaaaaatcccaaataaaatattattaattatagtcttcatgttgtacattagatctctagatttgttcatctgacatttcccattttctcctgcccttggtaacaactgttttatcttctatatgctgactcccagctggacatttccagtgctggcagcagctttaaactcctgcttgcttgacatcgccatatagatctttaaaggc

SEQ ID NO: 121671 - DNA, 1044 bp, Homo sapiens
tggtactcttgatatctaactattcaaacaaagttatttgatctgtttggaccctattattattttcggggagttaatatttgtaggcaatgcatgatggcattaagtatctctaatatctcattactaatattcttattaaaaaactaaaatgtatatggtattttattacttagcgtactttaacaacctagtgaggtagataggtcttgtggtggagtgttttgttgttgttgttctcttcattttacagatgaggagactgaacttaacaatgaagtgacttcctcaacatatacagctagtaaatggtggagccaggacttaaattcagtcctctgactctaaagtatattcttctttcagtctatcacacttgtttccagggtggaacatatgactgtagcatgggtgtttgcatacatttttggaaaagaatgatttattttttaaaatatgaaactaaatgtttcccttcttaaaccactttatttatacctcagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtaggtctaaaaatatggttgctcatttcacaaatatttctttagagtcaggcactattccagacatatattgaggattgtataatgaacaaagttcctattttcatcgagcttacatttatcaaggaaaattaaaggccaaaataataattattatttttaaaagcttaactcctggactcaagtgatcctctcaccttggcctcatagccttctttataagaagtgaattttagataaagtaatatagccagattccgtatggaatttatgtgagaagatgtactaaaacagatagtgaaagataataggaagaaaaatcacatttattgcttacttatacaatatttt

SEQ ID NO: 121672 - DNA, 1242 bp, Homo sapiens
tggttgtatataagttagtaggcaaagaaggatgagctaataatcaaaatactgtccaaaactttgaattcatcaaaggaatcaggactagtaccattgtcttacacatcatacagtgtcccactcaggcagtaatacatatgtacactttggtcgtccatgctttttgtgtgttttgtctgtcttcacaactctttactgcctagagtgaggggacataatataacttattgtggatgttctgagtattcagttatttcactgttagtaaaattggccaaaaaataaaaaggataattctggaagaatactatgatacttatgtattgaattggtttccctttattaaactatctaaaatgatctctcttgctgacattgaatgggctactaattggtaagtgtttagtgctgttctgagattttgctgttttggtatttagtgaacaacagttttgagaattccattttaagtaattttgtgatttgtttccatggaggttttgataacaacggtgctatcataggacccagaagcacaagacacagtaatcctgaagaacatgccacttactatttcactaccttttcaaaagaattattagtccaggtaatgaatacttttattattctttggttacttactgaccactagaggtagtgaaaaagtgtaagacgaggtcttgccttaattgaattcacagttgaaggggtggagacaagacttacaaacttcccaagaatttttataacaagaaaattcctgtaaaatgataatcatatgttagactaccatgtaagacaaaagactttttttctcttactttgttgttttcattactttattaaaacatagttgtagcttctcacctgtctgctcaatggaagttggagcttttccaaaaatgagtcaggacctgtgctatttcctgtgaagctctggagaagtttatttcatattatttttaattcaattatatttatttaagatatttgaaatagaagaaaatacatggtatctgaagcatttttaaatgagtgaggttataagaatatagttgttaagtcactaacgggaaaataattgcctaatagcagacactgccatgataatgtggcatagttctgagaagaatgatcttaaatagaaattcatctgtagggaaaacactcagctcatgaatatatttttctaaattttctttgatattccactatgtctaaagaaaatttagacacttt

SEQ ID NO: 121673 - DNA, 1038 bp, Homo sapiens
taattacaagtagcttttgttgaatacttattatattctagaaactatgctacccatcttacaaatattttttctaacccttaacagtcctgtaaattttggtattatcctcattctggatgaggaaactaaagctcaaagaagttaaataacttgtctaatgtaacagaactattaactggcaaaaccaatttctctgattctgtaatttctattgtgtcaacctgcactttaaatatttgttcagttatgtaatatcttatattaccttctcaaagaagtgtgaatttagcttagcttctgaagaaatactattttaaaaatacttgtttttaaaacattgtttcattgggccaattttcagataagcatgatttgctcatgctgattaattactgtctttaatttgaatattaattttaggacctgtaattctagaagatgtcctgattgaagtgtttagaacattatattctcaatgcaaagcagagttggatcttcaaactgaaccacccttcagcaaggatcatgctcagttaagcaggtggattatcaaaaaattaaatgtgacatgaagacataatatgtattcacttaatataaacttgaagtgtaataacttgggatcctactctatgaagtttgtgttctaataagtaaagctgatttaatactagtaaagctgatttaatactgacatactagttgtattgacagtgcctcactatataaagacaattgttttaattgttacaaaagacaggaggaggaaataggtaataggctaaagggttgccacttgaaataacaaagttctttttccctgatgcaatttcagtaatagtggctattaacagcactagttggttttgttgttgttgtttttcaaactaagaataataatttgattgaaactggtcaaggtaaacctttcttaagaaaatcctgaatagcacagggaagcagacaaaattcttcacaatcaaggctgtgaaaatcaaatcactactcagtttgtatgtgccaagggaaataaaa

SEQ ID NO: 121674 - DNA, 1050 bp, Homo sapiens
aattagtactatacacatttcaataaaaatttcacattcatgtggccctgaacagatgacctattagattttatttgtagttattaaaatgtcattttttaaccttacatatctcattcttggcattgtttagacattaggaaagtgatttcatgaagtagatgaaatagtcatttgaaaacaaggatatagatcctagagacttgtatatatgtatttttgtcctcaagaatctaaccttatgtatgctgtgtgtgtagtgcatagtaaatacttggtgaatgaataaatcagtgtggggctgctttaagagtcaacagaatgggcagattaagttgtgaatagtctaaaacatctcaaaagtggtcatttctaattcctaatatgtacactttgctactcagccttttgttttcttaaaaatctctaacaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattgga

SEQ ID NO: 121675 - DNA, 1937 bp, Homo sapiens
cctctgagatcagtgccagacctcatcaatggtatcatgattctttccctaaatttgctagcatttggtatgtactactttgtatgtcactaagccttccaccttttctaaaagaagaccgtcattattgtatgccccctaaaaaatacagaaatgaattatgtatttgtggtttgctgctaattttaaagtctttagagagcttagaaacagcataactaaagtgaggtattaaggaggaaaaaacaaaactttcacctgcaataaaataaaatgtaattttaggaaaatataagtagatgatgacactaatgattaaaaattttgatcagtctacatttctacatttcaattattttaatgcattttgtatttttcttcttttactgtttttctcatatatcagtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgc

SEQ ID NO: 121676 - DNA, 1052 bp, Homo sapiens
atgcaatgtctcaacaacaacaacaacaaggaaaattgccatgagttcactttttcttggctactggaagatgtaactccaccggaggaggaataaaccaagaatgaagaagacaggggatccaagaaatgggctgcaacacaaaagagaaagcaaggggaatctctgggataatggtaacaggagagatatcaagatgacactgtgtagcaaacctagagagtatcaacccagggtagaataaaaagacatctaacagaaatgtctcaaggaaaaaagagaagagagggaggaaaagatacaaattaattacctgaagtatttgaatatgtaattagagatttacagttgaagtatgtagggatgaatttttaataggtacagagaaaatgaagcaaacaaagcagtttattagctctaggaaaaacaaaaagttgtaccataaaacaaatgcaatgctagtacaatgcacattgcaaccaaaaataatcatgtgaacattggatatggatttaaataaaaatatgatataacaatgttgagaggataggtagaaaagtataagagagctacatctttgtcttccaaaataagtaatgaatagataatgtctaaaattgaaaataaaatcaggaaataggaaaaatagtagtatatgttatttagacgtaatggaaaagaacataaagagttgagcatggttgctttggggcatgggaagggatataggacaatactattttttcttataaagcttattgttctgttttattttttgaggtgatgtacctttattgatgaaaaataaataaattttgagcctgggcaacatagggagactctgtctccacaaaaaaattaaaaaattatctgggcatagtggcatgcctgtggtctcagctactcaggaggctgaagcaagaggatcgcttaaacctatgaggttgaggctgcagtaaactgtaattgagccactgcactccagccttggagacagagcaagaccccatctcaaaaaatatatacatatattgtatatatatatatatatg

SEQ ID NO: 121677 - DNA, 1042 bp, Homo sapiens
gcttttattagtggaattggttcgttcaatcagtgtcatgagagcagaaactgttatccagactgtaaaagaagttttaaagcagccaccagccatagccaaggacaaggtaagaaaaaactcttcttcacatgtgtttacaattctgtttcagaaattatgctggtaagatttttttttgtacaataatgtcctttcaatatagtacagattgcagagatgactgcatgtggccctcacactgcttcaatcaaaacaattatcaatatttgtagtgacttgctattctgattattcggtagccagtgaagagcagttaactgctcatatcttcatatgtacctcaaaggtagtcagggaccatgtgactaaattctcaggagagatttttctggtcatttaaagaacataagccagagctcaagatttgcttctctcagttgttgccatttttcatagcttctttattgctttcttttctgaatgaatctcttaattctgtgaactccccaaattttgctataaccttagttctagtcaatgtcatttcttgaccatgtataatactgtgctatgcaagtgctacactatgaatgacatagtctctgcacacacattgctgtgtttctaggcaaaaataaaagtctacaaattaggaatattacggacttttctactttttctgctctttgttcaagcaataccaagaggtcatattttcccagaaagtatttaccaactacaaacattagactttgagccaagccaaaatagacctaatcacatcctttaaagaattatgatatatatctgaaaatgttgaatgatgttttccttttatcttgtgtttccaaagggagtaagatgtgtgtgaatagtcagtgtccttattaagtttttaataaaaactggggcatttgtcataggatttttagtttgtattttgagtacctatttgtgccagacattgagcaacacatgagggatatgaaaacaaattagagccaatccactgtcctgccccaccaacctgtgtcccctt

SEQ ID NO: 121678 - DNA, 1021 bp, Homo sapiens
ctgggcaacatgatgaaaccctgtctctacaaaaaatacacacagacaaaaaaaaaaaacactagccaggcatggtggcacacacctgtggtctcagctgctcaggaggctgaggtgggggaatcacccgagcctgggaggtcgaggctgcaatgagccaggatcacaccactgcattccagcctgggtgaaaagatgagaccctgtctaaaaaaaagtagtacataacttatattatgttcaagaaatataaaaataaaaactgtaaaagcgagaaacttttttactcagtttctgcaaggatgagaaaattctctataataataaagttattagtacaggagatcctttttataaatctactactgaagaagaaaatatattcaagaaacttggtcttaaaggaacttttcaatttataaatttgtgtaagtaaaaaattgtatttagtcatacattaataaactgcctctattaaaaagaataaaagtatattaaattgggaccatctggaagatctgcatatacgaatagcctggttccaggttacctaccataacagggttggctatatgttgcaatgtttcagagaccagatgtgacttaccaaaaccagcctagctcatgtagctgaaacaatactgtactgctttaaattaaatttgtgtctaggggcccagggcaatgaatgctgatggcttaatccaatctaaagggcttaaggaataagtaaaactacattatatccaaacgtaatcaattagataataataaataagtattcagaaaaagactatattctcctagatgctgagtaatattctgaataatttcagggtattaaaaaatggacaacaatatatttaaattacatattaccgtgaaatatcttcatcagcagtgagttcctgctccatcagtaaaaatacttgtacctgaaaatggtgaaatgttaaatgtttatttaaactggatatttaatcctttcaagttatctttaagttgtattttcattaacgca

SEQ ID NO: 121679 - DNA, 1039 bp, Homo sapiens
aaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactca

SEQ ID NO: 121680 - DNA, 1037 bp, Homo sapiens
gttttaatgtaattttatatttagtctggcacttttcgtagaatgtatgtttaacaggttaagcttctgaaaggaagtgtaatagagtaacaaatatgaaatgcttgcacttaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagtaagctgggatagttctattgaaaaagagcctaatattaggtgatgggcaggcaaactattttaatggtttttagaatctcactatgatgattaaggctttattttgttgagccttttaggttcacattaagactacaaaattattttcaccagcagtaattatacaatttaacaaaattagacccacttagtttatttccccaaatatttttgacttattctagacttcctgaaagtgtcatatttttaaccatggcaggaataactaataaatacttagtttatgcactataaggtagatgatccttttctcttcttttaaaaatatactcttgtgacatgaaaacaaccagctttgtagttcatttctaagtcaactgatagcattctggactcttgatttgtttttcaaaatatttcctttaaatgacagccttactctgtgcctgtttccctgacaggggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataat

SEQ ID NO: 121681 - DNA, 1492 bp, Homo sapiens
tttcaggccataaggtctcttacagttgtttaactctgctgatctagcttaaatgaatctgtgtggttgtgttccagtaaaactttacaaaaacaggtgactagcctgtgccttattttatcaagaaaaatgtatttcatcaagtagttgagcatagtatgctaatcttgctcagtattaggcctctagaaggcagtaaaaaagatgagtatttccaaatgagataagactcttgaggagcatgatgaattatatattgtaatgactatccatgacattatttgccatattttgatgaatactatgaactcttaattttgcctagctcatccccttaagttttagaataaaactatactagctgcaatgaattatatccttcaaagtaaaaaggatacagacaggctctaagtaacctggttgcacagaaatgatttagctggttaaagggaaaacatgaacttactgtgtgtgcttgcctcttgtcaaggtggtgttttctttgtaatcagatgtttaaatttttataaccagttatataatccgcaaataaaatttttcccctagtactatcctctgggttttaatgtgatcttacattaatttcatacattttaaggctgccactatttttcccctcagtttctccagattgactaggagggaaaagtgggttagctagaataatagtacttatgactaggttttggatagtgttttgagactgattttatattcttttgctgcaggcactgtttagtacagctgttgaaatgaagataaaacaatcagcagaacaactggaagataagaaaagaaaagctgctaagatgcttgaaaacattattgacttgtttaaccaggtcagaactgatggggcagtggactcttggttacctttacattattcagaagatggacagaacagagtgtgggtgcatacaaaattaaagtggagacgtcctggcctggtggcttccttctaatagtggtatattcagttgagatttataatgaaatggaatgacagaacattttttaatatgcttcccttcccctacctcttatgatggaaattttcaagtatattgggtagcttctacctaggatcacagattcagctactcagtgtatacatatatattattaatttttttttaaccaaacctcgatgaaattaagtaaaaataactggttgtcaggccaggcacggtggctcatgcctgtaatcccagccctttgggaggccaaggagggcggatcacgaggtcaggagatcgagaccctcctggctaacagggtgaaacctcgtctctactaaaaatacaaaaaattagccgggcatggtggcgggcacctgtagtcccagctactcgggaggctgaggcaggagcatggtgtgaacccgggaggcagagcttgcagtgagccaagatcacgccactgcactccagcctgggtgacagagcgagactctgtctcaaaaacaaac

SEQ ID NO: 121682 - DNA, 2132 bp, Homo sapiens
cctaaggacaaggcctagtcaggcccacctaaacctaactaaagtttggtcaaggagagaatttttgtcattagccatcttttatcttagcaaattgtattggaatgtgtccgcttggctatattaaagggtgagcgtttatctttgctatctcttagcaaattagcctgtgattgaacatcagtttggcttaatacttattcagtaataaaactgtttcttacccttcttttttttttggagaggttttctggggtggtgggagattctgtttctaattatttccccggtgtccaccaggtgaccacccttggcaccacactacttgctcggagagttaccagggttcatggacaaaactggaagtctgtttgcctatactttctcattatcgagaagttttccaacttttttgtacctcattttgtacctcgttctggcatttatactagttttagttacctttccattctctagaaagcaggaattacaaagtcagattcctgcaggatttggacaggtaaagtgaatgagggcagcagggggctaaaaacaggtcagtatgtgccagctgatgtcaactgtagtcacactcttcaagagaagcaggaaatctgaattttcatgtgatgttcctatttgtttaaaaagaaacagtggctgggcaaaacgaaatatatcttgaggctgctagtttatgacctgattttaatatatggttataataagctcattcaagggattccatctggggcccatttgcctgcctttcacagggattgggttatttcacagtacttgggttattgttttaggattttcattttctgtcttaaaaatttattacagataaaataacctagtttaagaaactgttacttctcaactcactgtcttccagatgaaatatttttagcccttgccattcctgaggtctcctacatccaatctaatgctgatctttcttttgcagtttttctactatcaatctttccttaaccattcttaaagctctctcagatccatccatccatgactttccctattcactattgctgatccagccactatttcttactgggattagtcctagaagcctcctcattccatttcttaaccttctaattgaacttgctgctatttgcaaacaaagttttattggaatagagctatgttgatttgtttatgtatggtctgtggctgcttttgcactgtaatggcagagtaattgtgacagagaccatatggcctgcaaagcctaaaatatttactgtctggcctgttacagaaaaagcttgcaattctgctctaagctattctccacactgtagctaaacagctttctaaaacagttaggtcatgtcacgcccccacttgtaatctttcgtgtcttataaggagaccctcatctctctcaccgtgctttacccttggctgcgtgcttccagagtgtgttcatgcttccattgtatacgtaccattttgtattttaatgcttaatcgtcttcctcactggactcggccccagtattttgttcccctttgtatctctgggatactaggtatgcaagaaacatttgacatctgagtaattgctgtatttctttaaatgcatgtgttataggtacctgtctattgcactaagactggtgtaaaacatttgcaccacaaggctcaagagtttgacattggagtttattttgaagcaaatgggcatggcactgtaagttctcttaattatagttggccttagctggcacttttctttatgatgagacttctatatctgggaggtaataataggtaatattgtactttgttgaaataattggatgtgacaaaaagatcctttggttatcttatatattgatgtattatgaaactgtgattctcttttacatggtaatgattcttctttgaatgtgaagagatatactaaggtgttttgaatagttttttaaaatttacagttcttaatttttttataagtatgttgtctatgcattttccggctggccataggagaggaaaagaaaaattcagtcgctatggtgaattgcaaagtgttggaaagttgataattaataagaaatgaaaatgaatttaaggtaactagtgataggcataaaatg

SEQ ID NO: 121683 - DNA, 1033 bp, Homo sapiens
ttccttagttgctgatgtcatttttctctctcactatatgatttataattgcattttcattttatatcttcattgcttatatgtgcttttattataatacacttaatgtttttgcaaacataggatacagtgtttttgaaatggataaaaacttccactcacatgggctcatgattacctctatttattaaaataattaatattcttttcttatatctagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattacct

SEQ ID NO: 121684 - DNA, 1231 bp, Homo sapiens
ctgatttagatttgcccccatctagaaatttaatcaaagtcttagagctggagagaacatcagggttactgagtctccctctctgccttagggttcaatacaaaatttaacactgtttgatttggaactagggaatggtttggggacagtaaatgttgaggctaattaggtgatttagataatccagagtctgtgtaaaattaaaatcctatttgtagtgagactctgaactagctttctcagccttttgctctacctcctgcacaagaatatgactcagagctgggagtaatggcatgcttagccttggatagctgtcctcctctgctttcaggatccattttcattactctatcatcttcctctttctttcttttcttttcccttgttcccctaatgtatcaattggaaagtatctagcatttcatggtacaatagaaaaggaagtggactaaaaggaaacctagattctattcccatctttttcaccaattatgtgatctcaaccaccaccacaccactctgggcttatttctttgttgatagaagtggggatgaaattaggtaatcatattaatgtcactggtttttgtatagaccattatatgtaaccgttcacttagttattggcgtacccaccacattgtatcgtgtgaagtataaacactttttttctttctttttttcataaggttatagctcagcaagtgtcagataaacacttggaagagggtcggctttatcctcctttgaataccattagagatgtttctctgaaaattgcagaaaaggtaaaaccactcttgttcaagcttcattatttttccttccttttcttgctaaatatgcatttttaaatattaaaaatctgcttccttgaaatgtatatctgtatcaacttactatgtcagaagtcagagaaatgaggcacactgacactgtagagcttaggagctacatttgcttctcagagaagaatggaagtattgggccgaataattaatttccctctctatcgttctttttttctcctaaaatttaaataattcattagggcttcctgtcagccagatttctcccatttcacctttttaaagttgttcttttctatatcacattagtgataattaaccaaaatattacagatatgttagagtaacatttagaccttgaaccaccttccatatccatgtcactatgatgtgtggcatcataaatgacagatcacaac

SEQ ID NO: 121685 - DNA, 1669 bp, Homo sapiens
tatttaagctggtttatctgatactggcttttagtatactccagtgttacaaaaacaagtttttaaaatttgactcacaattcagtgtgtatgtatgtaactacatatgtgtttttaagaaaaaacattttgaattagggatttgtagtatattattactgttcacatgcaaaaatcccaaaatattttaaattgttggaaagagactgcagcaaaaccaaattatgctttgttattacttgcttaatttaataatctgaaagaagaaaactagactcctgtaataataattcatccccaaactagaaattaaaatgttagttgagtttgagtttcttatgggaaaactgccaaaatctctttagaattatagaatgtaagtaatagagaaatattttgtggctatatatatatatatatatatttttcaagaaactttaaattttcaaattgaatatgattatgaacacaacaatatgttacactggtagatcattgtttatgtcatattggttttcattttgcttgtttttagataaaacaaaatatgtgaagttagaattcaaatgccacgatacaaatatgtgaaagtattcagaatgtaaatcacaaattcactttcacattgaaataaaaatcaaggctaaatgacagctcattaacatttgagttctctattttgcggattattacatgctgtatttaactttagtaaacctctttgaattttcaaagggtttgatgaatggcacaggccagttcttgatactcaactaggcagaagaattcatggttggatgattcaaaactagcacttgtttgtccctggaaagatattggaaatttcacagataattataaaatttaccaaataccaaggaagttgattcctttaatcttgcaataaatttcacagcacttttggtatccaaattagaagagtaagtagatgcttggaaacacagatcttttatttttcatcagtttcattctgttgcctaattggtcaagttcccatccaaatgaccaagcttctttcttcaaattcaattagagtagcttgaacctaacaataaacaatacagttcaatgagcaaggttgaccagttcattattttgaattcagtattttttcttggagcaaatcttggttgtattaacaggattaaatacactgacaatcaaggatatcaccagtttatctgtggccaaatagcaagccacataatagtggctctgttgtagtaaaaagggtaaataattgttatttggcttaacctaaatgtgacaaaaatattttgttcccactaacaaagacaaaatggggtgaaatgtaacccttaataagatatcatgtagaacaactttaaaattttttcttttcatcactgaggctgccctagggattgcacacctgattgtgatggccttggaaaaagaaggtttaccaaaagagaaagccatcaaaaagatatggctggttgattcaaaaggattaatagttaaggtaagaatttgtcatttttaaccagaataaagataactatgccattctggatggccatctcaaagacaactctgtttctaccacctccctttacactatattaaaagagtagccattaaatacaaatgatcatgtcatacagaatactgatactcttctgaa

SEQ ID NO: 121686 - DNA, 1440 bp, Homo sapiens
tagttttttaatcctctccagatccatgcagagcccaccccccaatacacatgtcttactatgagaatcttacaggttctgtttcattattggaaggtagggggaagcacaggtagatgagctgaggagaaataccgtaaagaggttttgcaacttgaaatgagattgcaaatggcttccatttcactaattccaatgaatgtttttcagtgtttatcttatttgaattttcagcagcattccacattgttgactcaccttgtttcttgaaatactcttttctgttggcttccatgtcagggcattctgctggtttcttcttacctctttggctgtttgccttttctttttcttctgcaggttcatcctttcctgtctagctattaaatgacaaaacacttcatttttaaatgacctgctcagtgccagctccttttctttttgttctgctgtatgttcttaggtatatactcaggtccacacattcaattagcaaatttatattgccagcccagacttctttgtattccaggtctatacacccatgtctttatttaaaatctccacttaggcgcctataatcccagcactttgggaggccaaggcaggcagatcgcttgagcgtaggagtttgagaccatcctgggcaacatggcaaaactctgtctctacaagaaaatacaaaaattagcctggcatgatggtgtgtgcctgtagtcccagatactcgggaggctgaggtgggaaggattgaatcccttgagcccaggaggtcgaagttgcagtaagccatgatcatgccactgcactccagcctgtgtgacagagccaggccctgtctcaaacaacaacaacaacagcaacaacaacaacagcaacaacaacaacaacaacaacagaactcctgctggatatctcaaagttatctcctacttaacctactcccaaatcaaactcttatttccccaccaaacctgaccttcttccagtgttctccttttcagtgaattgctgatagctccctcttcagctttcccaccaaatacagtctatcactaaaccttttgcatttcctatcatcaaaatctgtgtttttcatagatttctcctcatcaccccagtgcaaattgctatcatctaagtaatctatccacatttactcttgcttccccttcttatatgttttctgcataatatctctacaatttgtcagatgtagatctaagtgctcaggcttttgtggtgaacagagatagttttctttttgctatagaaatctgatcttattagttcttcctcaaaataatttgatggattttcattgtacttaggataaagatgaaaatcctgaatgtggcccaaaatgcatggtctgatgcatgtttctctcgtcactcattctagccacacttcctttctcaggtcctgaaatgagccagg

SEQ ID NO: 121687 - DNA, 1142 bp, Homo sapiens
attttgtgcatgaaaacttgaaatgcaaaattgtgcagttttaaataactaagagagtataattggattgtttgtaacacgaaggataaatgcttgaggggatggatatctcatcttccatgatgtgattattatgcattgcatgcctgtgtcaaaatatctcatgtaccccataaatatatacacctactatgtacccacaattttttaaaaaaagtaataaaaaataatatgttgcccttagtgtcttacatttttattatgaaattgaatatttttacttgaagttataacttgctatgtctttacattccttggtatgtggagaatttggaatgtcccatacttaatattttgatttgccaccaagattgctctgaatctgtattcgcctttattgccaagtttcttcttaactgggagtttgaaaatataaactttaaccattttttctggataccacagaacccacaacgtattactgttatcagtttacagaaaaacacaatgactaatacgtgactaatgactgatgtagttgatatgagaaagactaatcatatcaatgactaatataggttcatatgagaaagaggaatgggaacctctttattccacatatgcttattattcaacattgccaaatttcaaaaaaccaattgcagcctccatgtgactcagttgtagccacattctccccttttccattaaactgccacacagctcttttcacttatgacctgatagagccaccccaggaaaagagaaaatggttttcagacaatttgtgtctgtaaattgtcatttaacttactttgtttttaaatttttatccctttcgaattttctggagctttgtgaagttagttactacttaataatcctatctttgaaaagagttagtgctgtatcagcaagtaatctgaggtgggaatagtcccaaattatgggcccattcgtcttgagaccttttcattttatattaccggaaagtaaaagcccctttcctgacattgtagtgtcagttttctagttagattttttttttttttttactccttcacctagccacaactttacttcatttgaaattaactaaatttgtttggctttgattataaatttatcttgtttgtttaaat

SEQ ID NO: 121688 - DNA, 1045 bp, Homo sapiens
ttttgcataacaaaacaactttaataaacttcagtaagctttagctttcccttgctacccaaagtttatttcataaagagctcaagagacaattggcaagttaaataattcaagagaaaaaatgttcacaagaagtttttatttgctttgcattctattccctatgctacatattaattgtacagttagcttcaaagtaagtttgtagtaaaaattactttcacaataaaaaaggtacatagatacaagcaactagcaaattaacttcgcaaagaataagatgtgggtttacataagccatttatgccagttaactagaccagttctcaactctctctttttttgaaacatctgtatcagtatcatctgattgtatcctaaagcagatatggaaataatttattattcttgggtctcttctgtgaccccattattgtcctgtgcatttatctcaagatcagattcattattaaatctatccagacaattcctctatcatgtccttgatccatttctataaccataacccagtttctataatcataacccaacttcaccattttatatctttacaccatctcggtaacttctgattttctttaggatcatattaataagtattcaggaacttacctttaccctgctattgactgttttcacctacatataaatccctttgtgatctggcccatgcacttcaccttcctgtctgccatcctccacccctccgtgtatcctttacaccattgtataaataaatagttttagttggctgcacatgtcattgttctgtcacacttcttctctgtataaactgctccttcttcccccagtgcttttgcttatttaattcatgcttatctttcataactcaggttaaatatctagactggattagagaagttttctgtatagtatcctagcatggatacaccaaaatagcatgtatcacactgtattgtaattatatgtatttatttgacttagcattaagtcatcaagatattagaggtcagggcctcattcttttctctcttcctttata

SEQ ID NO: 121689 - DNA, 1921 bp, Homo sapiens
gggattacccctgcctgctgtttagatacttacatggacactaatttctgcccatcaacctccctctctttctccttcaatgcccatcaacctccccctctttctccatcaatgctatgttggttttttttatttgccatcttggcaggtttagggtagagcagcttcaaattcttcctctcggtcttctccacaatgagagctcttcactcacaggctgaggatttgatatgggtcttgtggcacttaccaagtctgtcttttctgattacacatctagggtctgaggaatcaccaccaggtgggtctgtggtgacagtggacctattatgagccagaacttggctggggctccatttattactggctcctgtatgcctctactctaacagggagaggggaacagtgttttgatgcttcaagtctccaggtatcagtgtcaactgtgtgctcattagttctcagacatttgaatagtccttctccagtgcatagttacttgggtaaagggctgtagttccctgtggataaagattagggggattattaccctgtattcttgtcatggtgttataaggttctttcttctgggaactaggcctcttcttcagtttatgggttctgggtctaaaaattaactcaggttcggaagctgagcaagagattgtgacttcattggggcagctacactcaactttgtggtcattcatctttggtttcttttgatagtaaatattgagtagtagctttgttagctctccgttttgcctctagggatgcaagattccgttaattatctcaaaaacattttgtgggttagccacacacaccccacttttgccactcttatgataattgtgtccatctggcttctgattgttaagcattctcacctggtcttagcatccttattgctatcagtcaggctggttatatatcatccttttcttctgtcactcctgaccttcaggggagaaccaccactgaaatttttagtaatgttgatgtcttctcattggcatattccttatggctttgggaaatggtgtgttttctgggccttcctgtggaatatgttcatcttatggattttctggcttttacatgtgtctatataccagactgcccagttctctgagcctcgcaatcccctcttctgtcatttgccacagcattcctggcatttcagtcatattagtatcagccattaatttgtccatgtttctaggaaccatcctagcaatgagtttgcaccatcttctgggattcttgccacatgttaaatcctgtatctcaggagagtgcctgcaaatcagtaagctctcccttttcctaggttccagcccttttaatcaaacaccctcagaatttaattctacatgtattctcctggctaatacaaatactggtcttgtggctcctttggggtaaagtctctttcttcctttatcaactctagtatgtcccagataggttatattgtgataaaaccttagttattggcccagggatctggaggggaggcagaggtagatggtagttaaggggcacatgttaacttatgggggtgaaatctctacccttatcatcccaagaaagaaggggaaggccactttgtgagatgcgaaagctctgggggaatctggggattcaggatttcgacagacatcaaaccagacatcccattccatgtggcaaattcccattcttttgtaactaggattctgacttagcagatctgctttccttgagtttgggagcttgaatattctgatgattgagccctgtttctggacataagctttctctacccagcagctacagaagctgagaacatctttgtatctacaaaggagggcctctggctttcttgttggcaattactttctctgagctttttgtgttttttttcccattgtcc

SEQ ID NO: 121690 - DNA, 1085 bp, Homo sapiens
tttatggtaactttttttaataggagttacttaaagatccactctacattggactacggcagagaagagtaagaggttctgaatatgatgattttttggacgaattcatggaggcagtttcttccaagtatgtatctttatttaacctatattttagtcagtaacaataacataacagactattaaaaaatccaagatttatgcaatatggtttaataattagaagtaatttgaatgaaaaatgcatatatcctatctatttcctcataactgttaatggacaaatgataatatcatgtgtctatccagaatagattatttctgttgctgtccctgaatatacttttttttttacaagaacctttagaacctgtggctgttgaaatgcatgattatggtaaaggaggcagtgaccagtgactaaattacctgcaaacctttttacatttatcgacaatctgtactttctggttgatgataaaatctgatcttcagtcatctttgtagctggtatttgactctcttatggtcaaccaccagccacaaaggaaaagcagaaaaagaggtggggattgagcatgagttggtacagtccacaggggtccagaatggagcaaggacagggcattccatcatgatccatgcatctctgattaaatctataatatttgattaaaatgcagtgctatgtaggttgagagtctcttatccaaatcacctgagaccattagtgtttatgcagattttgaaatatttgcatatatatataatgagatggtacccatatctacacaagaaatttatttatgtttcatataaatcatatacacatagcctaaaggtaattttatgcaaaagtttaaataattttgtgtgtaaaacaaagtttatgtacatcgaaccatcagaggcaaagatgtcactgtctcagctacccatgtggacaatgtatggttgtttggcatcaccattatccctgattctgaattttatatgctagcaataagcaatcattttttgcacttatcatgcataaatccttaacagtataaaacataatataccattaatgcaatgaaaaaaat

SEQ ID NO: 121691 - DNA, 1026 bp, Homo sapiens
agggatattatctgagataacatgaagaagtaagaatattatctcatctcccaaatctgttttgaaggaagaggttatgagaaaagtttgaactatatatatgaaaaagcatccatattttaaaattgtctcaattctaacatgaaacaagaacaaaaataggagtattcttagttggcatgtctaaaattaaacattttaaattgatcaagaataacagggatggtgaaaaggtattcattataattccattcattaaaaaatattgataaatacctttcttatttaaacttttttattttataactgtatatatgtatatgttgaaaattaatgtttttatatccaactgtgtaccagaaagtatgagtcatttctgtgccaaaacacttttggatatctcattcggtttctaattatgaaacatttcaggaagtattgcaaataactcaaatagccctcccgaaatgcttggttttggtgggacgttaccggtcctttatttgttgaactctcttcaaaagtaataattctttctatgaatgaatctctactcagtgcaagagattacaggtggccaaatgactcttattctgaagctgaactcagatataataaacattggcatttaattggtgttaattttggtgtaattcattgtctctcttatttaaaaaaatggtgtttcctgaaaccagtgttatttggaaaaccttggctaactaacaagttcctgagaaatattactggataccccaaagccttgacttgaccactgtgcaagctatgcatgtaacaaaattgcactggtaccccctaaatttatacaaataaaaaatagtatattgccaagaatgtcttagtaattcaacaaaagtgccttctttaaaaagttcaaaaatattttaattttataattatttattgagatcctgctgattttataggctcacattggactatgacagggatccaaaagaaatatataccttataaagaacttataatcaattttgagaaacaaaa

SEQ ID NO: 121692 - DNA, 1045 bp, Homo sapiens
caaaggaagtaccctgagaactctattctgaaccaagtcttattgatatgataatagtacagctataatttttgaaaacatatttctcactcgtgctagacttgaaggaaactagtgacagattttcagtagtagcataaatttgaatttgtgcagaggtgatctagatctgagggaaaatgggcattatttggtttatagagtagaattgaagggatcgttttcttagtacccagcagtagcaacctcccctggaaaattctttggaaaactgcctcatatcagaagaatttgcttgaactgtatttggcagtataccaagtctgtctgtatggcttatatttttctgttgatacattttcttttctctgaaaaggaaaaacccggcaacaaggcctgtgaacaaacagcagtttttctgtttaggtttatataggcctattcctacagttttcagcatatgcatgtgagtctctgtcagttttccaaaacattagaataggaaatgagactgattgattgaatagtttgatcagttagttttgggtttagatacactaatctgcaagaatgtagacttccaatgtaaagatcagcaaagggaaagacttctggataaaggctaagtcaaggctgtaggatttactttagtagcagtttgaaaggaacttgaaaataaaacttcaactaagaagctattgctcttcaagaatgctgttttatcagagaaacaataataaaattcttagaataaattataaatgaaattattagaaagtttatagcaacaacaatatgattaatgaaagttgtattaatgatagagattacctaaagatttgggacatgagatcttgagccagcacaggtaaatttcatgtgaacattggggcaaatcttaatggtctaagtaaagtgttatatgtttagaggtaattgaattctaccgtatcctctttttcttcattaatgttttttgtgctttatgcctttgacttcttgcataaaagcatggagtcattctggtgcacttccatcatagaat

SEQ ID NO: 121693 - DNA, 1021 bp, Homo sapiens
gaatgggagtttctgggaaggggtgagaggcagtcctaaacctttaggtagtcctggatactagagctgcccaggtgaaccagaactatttttaattggatttgccttttttaaattaaactactttagaatccttaggaatatctaggaaacttttgaaaaccagggaatatttttggcttatagttctggtttagcatgtgacttttattttttattttgttataattgtctgtatttctagaaattctcttaaacatcaaatagttgatgtttaagagggcaactagcttttaatgcttccagaaaagtgatcattttaatgttaaatattaaaaacattttcactatttatctatggtaataagcctttgattttgatttatacttattctgtaatattatttggtccatttatttcatttcccttgaaactggcttacccctactttaaggtatgagaaaaagaaatacatggtgtaatttttttcaaagatatgaaacaagtcagatggaatgtctggactaattcaagtcttaactgttacctcagttgattttgtagttaaagataattatttattaaaagtggatttttatttattatagagatatagatgatgatttcttaaattatgaatttaaactaattattttttccaagcagaataaaagttatttttatgaaaatgtatatatgacttgtgctaaataggagtgaggtagagtattctatatcttaagtactggaaattcagtgagtgcccagaagtagtttaaaataccaaactgtcttctttcctaagcattgccttaatgaggaaaaatttggagaatggaaaaaatgtagacatgtttctaacatcagttctttacatcaagatctaagggttgtctaaatttgtgcgtagacgtataaatcttcaaggcagtgaaacttatcttttactgtaaaatgccattaaaaatataaagtaacagttcatcggctctccatattcatctagagattttaaatgtg

SEQ ID NO: 121694 - DNA, 1064 bp, Homo sapiens
atttttacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaaggtatgtcaacttttattttatatgcaacttgtgtctttatttatttttgtaagttttttaacgaatttaaaatttattattattattttaaatttgacaataaaattgcatatatttatgatgtacagaggatgttctgaaacatgtatacattgtgaaatggtagaatcaagctaattagcatatgcattatttcacattcatatcatttatttgtggtgagtatgctaaaatctacttttagcagttttcacgtatataataaattatccttagcaatagtcactatgtggtacaatagatgtcttgaactcattcctcctgtttaactgaaattttgtatccttttaaccagcatttccctaatcccgcaacccgctccccctacctttctcctatcctctggtaactaccgttcttctctttgctactatgagtttgactatttttaggttccacatgtaagatcatgtggtatttgtctttctgtgtctggcttatttcacttaacgtaatatcctaaaggttcatctgtattgttgcaaatgacagaatttctttcttctttaaggctgagtggtatcctagtgtgtatgtgtaccacattttctttatccattcatctgttaatggactcttaccttgatcccatatcttggccattgtgaataatgctgtagtgaacatgggagtgagtgcagatatctcctagacatactgatttcatttcctttggatatgtacccagtagtgttattactagatcatttggtagttctattcttaattttttgagaagcttccatactgttttccataatagatttactagtttacattcccactgaacagtgaataagagtttcctttcctcaggttcctcgccaatacttattgttcatct

SEQ ID NO: 121695 - DNA, 1086 bp, Homo sapiens
ggctgccataacggaataccatgtactggctggcttataagcaaaataaatttatttcttacagctctggaggctgggaagtccaacatcaaggtactgcaaatttggtgtttggtgaggggtctgcttccttatttgtagacagtggtcttcttgctgtgtcctcacatggcagaaggggtgaaaagctctctgaggtaccttttataagggtaataatcctatacatgaggggtctgctctcatgacctaatcacctcccaaaggcccttcttcctatgccatcgccttgggggtgaggatttcaatgtgaattttgggggactcaaatgttcagaccataacaccaactatcatatcatattggtgtacttatcctggacccagaggaacagcagtcatagtctagataaagaagtctcttgggcttcagtgtctccaatcagatgcctctccagagggactccttatcccaatctaccacatcattttcttaatgactacgggagctgctctgatattactttgtcttgtattaatgccagcaaatatcttaggtccattatggtttatgcatcaatgcataatttctatttagttttcatgtttttgagcttcatagcttgttattatcatttgttttatacaatcaatgttcatgtaaacaggtaacataggtataataatagggttgtaatggatatactgaggctttagacaggaggaagcatttgaggtaagacataaagggcagagaaacagggaagaatatcttgaccatgtgccatggaagaataaaagggtgtggtatgtatggacaatggtgagaagttttgtatgcctaggagtacataagaatcaaaggctacaacttgggagaggaatgttgaaacaggtaactcagaatcatataaggcatttcctgacctattttaaaggtggaatcacagcaggtcacaggtgacttactcacattcataattttaaaatctcttctaataatgactttttatttttatatgtactgacattgataataatgattatatcttctttcatttttgtgtctttaagtagtttccttcc

SEQ ID NO: 121696 - DNA, 1047 bp, Homo sapiens
tagaggaaaaggtgatacttttcggcagctcttctccaaaaacaagagcccagacaatgaaagtagtatcagacaaagtgtgtgaatggagtgccaggtcagactccatgtgccactcacttactggttgcacacacagtgtggcaattattggaagttgataaggcgagaagtggctcaactggtcctgcccagacagaaacgtgtactgagtgccttcagatcacgttagcaatctggaaatccaagtcctctcggtttctggagtgacacggttaagagtctgggaatgcgtggtgggtggcctctgtcttggacactttgcatggcttggtagaagaactctgtcccagacatgggactgtgggtaaagccatttcttttctttctttcttttgttttgttttgttttgttttgtttttaatttggctttctggaagttaaaaaaaaattttgtttagagctgctctctttttattaaaggggaattcagtgtacaccctgttcagagactccttttcggatcctggtaacatttcattttccttcactggtgatgcaatataagcactcgggatgtctctcaaataaaaaatacctccgaatttatcattttgcttccacacttattttacagccaggtttgtctcgggattgttccttttgtgtgtgtgtgtgcgtgcgctttggacatttcctatttattcaggagtctgaaaatgccatcagtcagcacagaggtttgtttagttattttggttgtctctttggtggactgcatttcacattaagaacagaagctcagctttttccttgtcgtgttcctgatgatttgttgatcatattaatgacttaaagacatgatttatttaacaagttatagtcagtgtgagtgattttttttgtgtgtgtggtgacaggcaccttttacaaatctatgactgtgtgctatctgccgtcatgtagcattattaaattgtaaataattccaacttatttctttctttaaaataaatttaattgctagtttgattgttttttctttt

SEQ ID NO: 121697 - DNA, 1034 bp, Homo sapiens
gattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgt

SEQ ID NO: 121698 - DNA, 1096 bp, Homo sapiens
tatgcccatctttttttaaaggaagttgtggggaaatgtaccatgatgtttgaaaatagatttcgtaatatatgaatcactccaagagaaactgttacagactcctaccattgggtcaaaactgctattacatagaccactgtttttgttttttgtttttttttttaacaagctgatcatttttctatgtgaaaactcatggggtgatctcagctcaacagggtcatagtgtgaaatagattggtacagtttgccttggattactgcttgtggcccaagtagtatatatagaataaaaggaaacagttcaaggactcaaaaatagtaaaagccaagtattggtcttccttgggagcaagacaaagtgtgtgcttagtgatagccttgacctagaaattattattttcataagcaaagcattatgaaagaccagttgcaagaccacagtagtaagtttaagttcagattattagtcaaactcacaagacattgttggcttaccttactctgattttacttagacaggtacataacaggaagcacaacagtagtttcacagaggactcagtcactcagatgcagcttctgaggcccctccacagtcaccacaagggttgaattttggtcctaaggttgacaaggggctgacgagagcatgggtcacatcaccactgggaagctgccatgcatgtctgaagtcttgcatcttaaataccgtgctagtgctagccatgtagaccttgataaagcatatgaatagttcccttttttagtgtggatatagcccataaaattacaagttatacaataaacaatcctggcaccaggtacagcaagctgaggaacatttattcttggattagtggtgagtaatggcagatgctaaaagaccctcatcagccttcagagttgtagggagtttgagttgaggtcaaatctttcctcaggaagctaaagcaggtagtcgtagcccagctgttaacctttccttccatcagtaattcagactggctatttaacagtctttcccaggggcaatagttctctagtgtctttcccatcctttcctgactactatgatcaaacataacagtct

SEQ ID NO: 121699 - DNA, 1050 bp, Homo sapiens
ttctcataggcttgtgttaacagaaaaaaagtaaggaaaatatggacaggatgcataataattttgtgctgaaacatttctacgccttagctgtttagattttttgtttccagtccacttataaggagttgattacctcaaagaaatcaatcaactctatcttacttcctgcatagccctctagaataataaagactaagatatttctttgaaatattcttcatgccattatgctgtttttgtttgtcatttatttctgttttgactatattcatcaagtggaaaaatctgtatgtttagaaaattttcatgatggcattctttgtagctttaaatataagcttaaaggatgagtactgcagagaatcatgcaacttaatgtcaaagaatgagactgttcttgtgattttatcaatatcctttccagtcatctggctgagaaatgagtgtacaatgacaattacatctgaaaatcacatcataattattttattgatctgtttagttctataaattgtctcctggcttctgatagctatacaatttccatcctttatgttcaggagtctatatatgtcattatctgttttgtgattttcagtgattttctgtaatttctttcatgccttcattggtttttaagaaattattcagagatttaatttttaataaaaacctaagctaaaatctctttggccattttgtgtggccattttttaaatattttgtctctctacaatgggtaagtggtagaactctagaataatcagaaaaccagttatgttttgtttaacacagcataactttacaactttaaaacatgcctttttgaggtcctatgcaatatgtacagcaactaagtagatttctttagaaataaagcttaatggattttaatttcagaaggatggctatttaatttcatccctatcaaatattaaaactgttaatgtattttagtactatatttaaattacacattttaaaaatagtaaatttttgtgatttttaacagaaatattcttattgatacacaagtaatgttttagt

SEQ ID NO: 121700 - DNA, 1145 bp, Homo sapiens
ggataataagctcatttgctgctttgcaaggtggtccattcctccattccacctaatagctatctttaattgttagaaaatcctttattttcattgaaccttaggtttgcctttagaaaagcctgtttattattcttagcatgtaaatgataaatcataaattcttacctttcttactttggcaatgatttatacacaatgaaaaataagacagaaagcataatttgttttataaagtttataaattctttcttcagaatgtgtctttatacttgattagaatacctgtgtaactatgcagttggtgttcctgaaattatttgtgaattggtattttctcttataaaatccaattaatgattcatgctgatattggaaattataacattgttattatagtcctttggaagaatgacaagtgtatttttatcttacatgtcaattaactgattactaggaactgattggaatgttgtatgaaagaggttctaaggctcagcagcaaaccatacaatgctgtggatgtgggacattcatgccatgtttttgctgtttttgtcattttgagaatatactgcataaacaagcattttatacacacgatttaagaagtactctagtccatgcattgtgtttaaaatcttttattcatagaagtaataattgtcacatgaaaattctgggaccaaaataatatcacaaaatgctgattcttgaactttcacccatacaacatgtagttagaataaaaatcttttttaaatataagggaaacaaaagataaagattagcttatgtaaattgtatatacattaaagcacattcacgtttctttcctcatgggtttatcagtgttggtagtctttaagaaatgatagaattgcttaaaattttttcttttgctgctatacaggtgttttttgtatttggtatgattttgccatggtttaaccgtaattatcagcctaatctagtaaaatttgcctaatttctttctgtgaaaagataaattatgcctgagtacggagaacagattattttgtttcattaaatcttggtgtacattcatcccagtttctcatttgttattgtatgtaagtaaggagctggcatgtggcagtctggggtatacacttctctaatca

SEQ ID NO: 121701 - DNA, 1100 bp, Homo sapiens
tctctaaaccaaatttgaatgttttcttcctcagtcagctggtgatagggaactcccccagagtccatgggtataatttgagggagaaatgggaaagaaaaagagtagatgcactgggaatatgaaccatctgttcatacaatctacctgcttattcacaacctgcttgaggcttatctcttatagactgcttcttttgataatggagtatgattgcacttgttcaactttattatttggtacattagataacacccactttaggtctgatgatcacttgatgttctttggtcaaaatttaagtctctaaaagtaaaaggtaggtaaaaataaaccaaggtaaactgaggtaaaagtaaaccaagagcattttttccaaaggagattagctaatgtgtgaagaagacatagccctactccaaagcactggaggcctgtattggagtgtaccagaggtactctacagcatttgaatctgctgtacacactttaagtacctttagatctgctgaaacagagccccacgtggcatcagtttggagaagttgcagagtcttcccttaatctgagcctgactcatatgtgacactataccagatgctttgcttagagcagcacatacacatgtcctctatgttgccaccaaagcagcttagcagacttctgcctctttttagttacaaagagtgcaaggtacaaaatttctcttttacacggcaaggatttctctgaaatgcacagtctttggggcccttagaaacttcattgaggtgactggtctctgaattttcatggattctcccatactttgacatgcatgtgacttatcaaggcagctaagataccgtcagttcttgcccactaaatacattcagccttatgtcatcaaaatgatatcctatgggagtatgacagccaaagaggttgatatccctgaaataagacagtgaggctttaatggcatctctgctagatgacagaaaactacttctgatggtttctgtttattgaggtagagataaatcattacctagttctgtagctgcctatgaggtaccaggagctacattgattttcttctggtaaatgaggatatatct

SEQ ID NO: 121702 - DNA, 1105 bp, Homo sapiens
tcctctctctctctctctctctgtgtgcgtgtgtgtactttcaaaaattatatacacagtatttcatttctttgtgttgggagacaattttcttttgcatttttgcatgtcttgagagtagaggcactgtctttttgtacagtcttttaaaggatatttgcattgtgaacaaccttgaatgttagtgtctccctctagaagaaaggacagctttgcttactcttctgtataataaatatctccctcaggagcaagggcaggcatgcttataaaagattccagtttcctgagctcagagttcctcttctgtaatgcagcgcattaagtgtacaggtgttacctggccctcttcacatagcactctagtgaattagagttcagtgaactgacacaaatgtttatattctgactactgctattgatgtgagtgctaaactcttctttgtctctgacctaggagtctcttgttatctgccaggacccatgaaagtggcaggttaagttgtttgcttgcaagtgtgatgaaatctcagatcctttacagttagttcttgatactttgaaataacagtgattaattaaatggaatgtatttggaaagatttattgaaacttatatttataagttttacaatttttgagaagttcatttaggatattatttctgtttgctttggtacaggtttcgtttataatgtcagcccttatatggagtatcatcctggtggagaagatgaactaatgagagcagcaggatcagatggtactgaactttttgatcaggtaagatgtgctgaaagtaaccaaagtattccggtggaagagtactcagatttatcagtgtgacatttgtagaaagaaaggaaatagttgcataaattccagatgcattggcttgaattttgaagtgtgggaagatgctcacaagtagcagctgttcatttaatttgccctttgagttattaaaattttagagatgtttcaaatctgcgactaggggtcttcttttaagtgttcgctgcctcctttgttggtaagtgtttattcagtcttgattagttttgataatgatcggcttatgggaggtagtgacaattggaagaag

SEQ ID NO: 121703 - DNA, 1042 bp, Homo sapiens
atagaatttgttttatatagttgacctttgaacaatacagggattaggggtgccaacaccctcactctcccatgcagtagaaaattcatgtataacttttaacttcccaaaaacttaactactaacagcctactgttgaccagaagccttacttataacataaacagtcaattaacatatatatgtatgttatatgcattatatactatattcttacaataaagtaagctaaagaaaagaaaatgctattaagaaaatcataaggaagagaaaatatatttatattccttaagtggaagtggatcatcatgaaggtcttcatcctcatcttcatcttgagtaggctgaggaggaggaggagaaatagggagggttggtctttctgtcttgaagtgtcaaaggtagaagtaaacccatatgtaaatggactcggttgcagttcaaacctgtgttgttcaagggcccattgtgtttgagagcacttaggtgcatttgcttaaatggcaggatctcatttgctgttaatgttcttcctgggttggagaagagtcatgtttactcttggtcataacagcattctccttggaaggtttttattgctgttttaaggcaagttcccattgttatttggtatttgctttctctctgtctgcctgcctgctgtctgtctgtgtatctatgagacagagtctcgctctgtcccccaggctggagtgcagtggtgtgatcttggatcactgcaacctgcgcctcccaggttcaagcagttcttgtgccttagcctcccgagtagctgagattacaggagtgtgccatctcgcctggctaatttttgtatttttagtagagatggggtttcgccacgttgaccaggctggtcttgaactcttggccttaagtactctgcctgcctcagccgccctaaatgctgggattataggtgtgagccattgcgcctggcctggtatttgttatctagcaatgcaagctaaatagaaaggtttaggaacatttgcctaaaaacttacctgctatacttttc

SEQ ID NO: 121704 - DNA, 1040 bp, Homo sapiens
gaagtgtaattaattatggaatttctggtgaaatattggaacacaaaaaatttgaaagctttgattttaaatacgttagtttctttttgtataaaacaaggtgatgtcagcttaagaaatgatgtctttccatttgactacttgaatattttttgttagcttatcccatttttttttaaattttgacaacttgctgaggtgtttagtttgactataatggtataacacttgtggatattagaatataatatagctttgtgagttggccgccatcctgaaagaaaatacctgttaatttttttcctgggtttgtaacactaataattgcattgggtatacatgcaaaaatctgaacatattttaaacttgtaataacgatcattttatgcattgaactcagtaaaagggaaagataaggcatctttctttgagttgttaatgtgtgtgtttcatttatgaagtataatctaataaattctggttaacttggactaatttaaaatatgataacacggatgaaacttgacgtttacatatgctcatatagaaattaaccaagatattagaaaaaagtgaccaaagaattagaaaaaatccaaatgaaatgagagacaaacatctggagaaatatggtctggcagtcttcagagatgaaacttacttgtttaaaacaaaggccgtttctatattggcctgtttctctcctcaggccttagaagaaagcccttcaaaaaagaagggatgttatcttgaaatcagtaatgtggactgacattctcattgacattaaagtattcttatttgacttttttttctaaatcactatacagactatcgtgaggaggaaaagaaagtcttaaatggtaagtctataaatttataataaatgaatcatattcacatgcttatgaatagtattgatacacagaattgtctggggcatttaaatttttttcttttttttctttttgagatggagtattgctttgtcacccaggctggagtgcagtggcaccatctcagctcactgtaacctccac

SEQ ID NO: 121705 - DNA, 1199 bp, Homo sapiens
atattttacagctatgattggttccaaacagactctttagtcaccattgccatatatactaaacagaaggtaaatatgtctttaaaatcagaaaagaagaaaataataaatgttaatttatgtaccaggtctttttctaaacacttttttatattatttacttctcactataattctttgaggtagatagtattgttatcccttttgtacagaagaggaaacaaagaaaagattaagtaattcacccaaagttacacactgagtggcagatctggcatttggaactcaggcagtctggttccagaacatctgctcttaacagccattcctatagcctcttaaaaatcagagtaggaagtattttatgtgtttttctgtgtgtgtgtgtgtgtgtgtgtgtgtgtgtgtgtgtgtgtaaagcatggataacaaaaaatgaatctcagttaacatcaccataagaacaaatttcctagacataaactaggattggagaaggtatttcgctgtggctgtggcttagtatgtttaaaccactaatggtgttcagatgcccatttgaaactgaagttagggaggtaattcagtaaccatcaaaactaaagttagggaggtagttcattcactaagtatttataacctgcttcatgtagaacacagccttagagatcagggatctaataggtcagatacgtagagacctgactttcaaaaggcttacagtccagctggaaaatcagataaatatgcagacaatttaaaatatctccaagcacatcctccagcaactgttgaggttcccacactttgagggatatgtagatttaaagacaagctctggcagctaggaatttttgagaatttatgctacttctatagtagcagaaccatgtctgaaccagtgggttcctctcattcttgcagcatgatttggtcattctgcaggagtgaccagcctctgcttggaaagagccaagatggccagaggcactacttatcctgttttccactccctcttgatattgtctcttcatcacacagttcaaaacccagagcacaggctctagggaggtccacttgcactggtaatatcaatggaacacagaggatggatggctaagggaaaaggaaaggtttccatgtggaataatgtattcattgaataatataaataatatatatcttacaccaaggctatg

SEQ ID NO: 121706 - DNA, 1046 bp, Homo sapiens
attatgtaaactgaaatccaaactaaattccacttatccttctcccaaatatgtgatcagtgtatgaggctcagttcattcagtacacattggcccacctgctcccatcagcagaatgccctagctctgtgatgtctctgcttttgtagaatgagttttgtggggtgggacaggtggtacagtttgacaatgaggttgacttctagaaaacattttgtggtatataaatataacaggtattttccttttgtttcaaatgagtcgttcttggagaccattaatcttattttagtaaaggtagtggtacatttttttataaacagcatttgttgattttcccttctttttataaaattaatacatgtttatatagaaaaggtataagaaaaaaatcacccataatcctaccacccaaagaacaattattaacattatggtctgtatctttctattcatatgcatacctacctttttgttttgtatatttaaaataatgtagtcatactaactataatttttataactacatttctactcattgtattgtgtgttttttacataaagaatattttcaacaggtggttttcaaccttaagcaactctgccaccccagaaacatttattatcacaactaggggaagacgtgttacacctagtcagtagaggccaggattgctacaaaatatcttacaattcacaggagagcccccctacaacaaagaattatccagcccaaaatgccagttgtgccagttagtaaatcctgcagtataccatgatttttaataactgcattgtgttcagtcatgtgagcataccataatttagttaaccaattctctgttatttgacatagtgactagaaattgttcaatacctctctaactattcaggataaagaagaattattaggtcaaactgttttaaggctcttgatacctatactttaagttctgggatacatgtgcagaacatacaggtttgttacataggtatacgtgtaccatggtggtttgcagcacccatcaacccattatctacattag

SEQ ID NO: 121707 - DNA, 1069 bp, Homo sapiens
gattgaataaatttgggaaacagtatatgccttcctgaagatttactctgaacttagcatatataaggctttctgaaattctacggaaatatatttaactttttttaacccagtatgtcacagacttatttgatagttagcctgctttcatggaataactactaacatctggaggcatactagtgtttcattagattcattttaagaaatgtttccatataattatggaaacatatataattatatatattttatctaattttgattcctagttttgtgagatttttttcctttgagcacatagcaatttttactacagttgcaggcattttctttagctagaaaaaaaacaaaaaacaaaaaaaacaaaagcaggaaaagctggggccccaagtactctgaaataccaatctgtgggcagtgaggaatcactgaagcttttaagcaaaaaagttgtaaagttgtatcagagtttttaggggaactaatatggcaatggtatatcaaatagattaagggctaaggctgttaatgtaatattttagatgagatataagaacctgatctggagttgtgacagtaaaaatgggaaggtaagggactttgtgtgagaaaatgaaggaggcaagttgctgaagctgattggctagaggaggagggaataagtcgttggatgactgctaatgatttagactaaatgaatacatttgtatttcaagacttgtcatctcagatcactatcagcctactttaaaataaaatttttgacaagcttacttagattgacgtttgagatcacataggcactcatcagaagcaggtctgttctcttcctctttcatattactttgtattttatgggttatctgaatttattttcaggtaaccttttcaagggtcccaaccccttctggcacttttgaaattataaaagaatttcaggatgtttactgtgtgccccccacatgtctccagcatctcaaagctgtaattttttagacagtaagttaaccttcattcagaaaacccaggagagagtattccacaggaattgtctatattttgatat

SEQ ID NO: 121708 - DNA, 1038 bp, Homo sapiens
aaactcttttaattactgttgcctgctggtgctgactaatgaggtattcaatattctctattttcccttttattaaaaatttggtataaaatatataaatcctttaatatatttctgaattttttacaagccattactgaacaaatactttttgatgtttctcaatgttctttaagcactcatgtaatactttcctccatcaatccaaagtccagcatcatcacaagtcctaccatgttatgagaattatgtaaaccacagtgtttgcctttgtatcctagttttaagaaaactctgttaaatttattaatcattgtcaatagttaaattgagttgagtatccaggaacaactattactctgcttcttgaaataatttttaaaactggttttcatcctattttgccattgtcttttccactgtttttaatatggtgaatcatctaaatccttttgggaatatgaataaaatacattgtaattaataaacatttcaatgtaaaaatcaggcccacatcatcattaagactgtaggaaaggaccaagaaacccaatttcataaaagtccacttgaaaataagcccaagacgcaagaaacaaaaagccaggagaatagctggatcccatccacgggcatctgggtccagacagcaaatctataaccacccccttctcttcatccacgggaagcacctccggccctgggtagtagtttctatttcctcagtctcctgtgaggcttaagagacatttaggaacagcccaaacttactcttggtgtggggctcctgtcttggtcagcaaggtcagcacaaaaaacataaaaatcacgaagactgcaagaccaacccaaaatccaatcacaatggaatctgaaagacagttaattctgggattagtatttcacagtagtttaaaacttgaacattcaagaatcagagctttttggagaggctttggtacatgaaacatgaaaggaagtcaacagtctgatccgcagttggctggagactgataagatgtaaaggatgaggaggag

SEQ ID NO: 121709 - DNA, 1046 bp, Homo sapiens
ggtgcatttatacattgtttataatatttagaaatcttatctggaacaaaactcatcaagcctgcagctttggataaaccagctcacaaaactgaaagttgcctgtctactcgtaagaagtctgaaaatcccacagaaactgattcctgtattcagtttcagactgtaggtattcaaaattaataatcataatgttttatgttctaaaattatattaaaactaaattatatataacaaaatataataaggactgaaatgtcttttcctttgagtgatactgtaatcactcttactaaacagttaattttcttatataatagaacattattaaccatgtcctttttattctttttttaattaaccacctgtgttcaaatcttatacataagtctactgtaatgaagtaatgctttgtcttgaaaggattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaaggtactagatacattgttctggtatttttttatatttattaaaaaaaaaaaaagctgaattccctgctaaatacattgtcatccttggttcctagagatgtttgacttgatgtatttgctgtataaaatatagaatggttccaagagtgattccgtacatgagagcctaaattttgaacccttgggggagaaaattaaatttaaattggctcatttttatggttttcttctgttagcagtcctttttaaagaaaatcagttcattctgaccttcaaagaaatgaaagtttgagcaagaactgctatagaaggtatagacccagaggatgacattgtgtagcatttgtgagttcctttactcacccagcaccatcagcacaaaacagcactttgct

SEQ ID NO: 121710 - DNA, 1046 bp, Homo sapiens
aggtacgatccattgactgtgagtcctagtgaggtcaaaggattattggaatctgggtaccagagggtgtgaggtggcaaaacaaagatgatagtcatagtaggtgattagatgagggaatgagactggggagtgattgcattacttataatagtctaggaaagacctaaactatgccaatgggaatgagtatctgagatggaaaggagttcaaggaaccaaaagccagggagttgaaaggatcacctgtgagtatgctgaaatgaccaagaatgaagacagaggtaatgtcacagtgagtgaaaaagaaatgagaggaatgatgaggaggttgctagatgaagactaatatttttatgagtaaagtgaaataatattcttaaactcatttttcatattttaaaattgtatagcatttgtgacatccaaaataaaaaaaaacacattattaaaatttatagtaaagtataatgatggaccataaatgtttttaaactgaactactttttctcattagactgaatattaagtatgatatttttaatctctgttttttattgaagaattgcccagagaagttttagttttattcagaggaactataattcctttgggatagtggttacttgtcaaaggttgagttctccaagaagcagagtttgagatgagattagtgttcagaaaatatacagaatgcagttaaaattaaaatcaacattggttaggatgaagaaaaagcccaactaccggaacttaaccaaattaaaggcatcttttcttttatgtaacaaagagtccagagataggcagttcatggctggaaagctgtgcaaggaaccagatccctttgtctttcctgatgcaaaatccctagtatgtgacttttgtcttaactgtcacaatggctactctgcctccggaccctgtccatgaggtagggtgaaaggtaaaaggtagatgccagccaaaccatcaacccaggaaagtttttgcatccatcttaatgacctttgatcttgtggccgtaagttgaatggagttcaggg

SEQ ID NO: 121711 - DNA, 1101 bp, Homo sapiens
atcttacagactgagtctacagagagagaacccatttccagagtttctagattccttctattctctttaaattctgcttacaaaccagctcattctgtgttgagctcatcagttttttggtaatatcttgttaaaagaagctaatagtagccagcacttaactccttgttctttccagtcatttctcttagttctccatggtcggctggcatgtggtctgccttataaacttttgtagatgacagtttagcaatgttttgccactgtaaaacataggctgccgtctctccagactctagttatcagtttcctgccatcctaaacttgacaactaagccagtaacaaataagttgggttcttagcatcatagcactcacattctaaagggaaaaactagtaaatggtcccatctagatggaagttggcaaggaaatatagtttagttggtacccagcaagaatgagaaacaattttgattagcatctagccaggttctgctgctatgaagaaggaaagaactattatatttctgatgattccacctactagcagttaccaagaagccaatctacattatatgaaaatggtagcctcttaaacattctttaatcttattttataaattataaaattaaatggcctaattgacacacgattaaatattttaagactaacagttcccatatttttggagaccctgtagtttgccaatatttaaccgcatttaaaacatttccttacgttgtatcttctaggtatttaatatctaattgaattgttacatttaagtgttttaaaccacagaaatgattttcttttcaaagcctagtgatttttctgttttacattaaaatttttcctatactgtgattaaatatatgcttttttagtatttatactctatgcctccttaatacaaatttatgattatttctttagtttcttctagaaatgtttaaaatgtttttcttatttcaaatgcatgtcgactttataagaaattgtagataaaagatatattacaaaaagttcacttagaaatttgtattttacttttcttctacaaaagcagtctcagtcttgtttggtttggtctttct

SEQ ID NO: 121712 - DNA, 1044 bp, Homo sapiens
tgagtttgtagccacaagagaaatggtcctcattaaaatgcttcaggtccaatacagtttagtggaagtatgtgtgacccactgtcattcttcaacacggagtaacatgtcacagtaaccttgtaatagacagcgttgcttttatgtagcactgaaatgtcatgtccagtctcccacgtgatcctcataacaagtagagaatgcatctttatgcccataattcaagaaatgcacctgagattaactcaatttactggtagatgataacagctaacatttttcacatttactttgggcacatactatacgtatattatttaatttaaccttacagcatctccatgggttatactccattattatccctatttcatagacaagaagattgaagcctaagagattaaaataaataaagccattgcccaaggtcatatagttgtagaccaggaacacaggccatccatgtgcttaaccacttacattgtcaggtctttgatctccataaaatacttctgtgaaatagtctgtcatccattcatgttgtcatttgttcatttgtgtcttcaacagacatgttttcagcctccttcctatactgtatcctcatgatgtaaatccacatgtggtgatctcctggccttgtttctacatttgtgtgagttgagaaaaaaatgatgcagtgaaccttccactaaaattcattcacttcaatgctaagtgtagtagtcttccattgatctgtagtgctaattagtatttttaaaggagagatggtaccactcatcattgctgtttgggagtatgttagcggtaactacagagattttcttacacatcttatatctttgttgttataggtaaaaccatttcagtaataggaattctaaaacagatttttacatttgtgtttaaaagcttaaaacagatattttgaaggtataacagtaatcatacgtaatagaaatgtcagtaatatgatctttagtacacatacctaaaaattttttggtaaactatggagtaaatgaccctagctgctataac

SEQ ID NO: 121713 - DNA, 1193 bp, Homo sapiens
aggcgtgagccaccgcgcccggcctgcattgcatatgtttaaaataattgtattagatcaacagaaccactgagtttatctacattccttatatttttcttttatattcttccagttgtgctgcttgattcattagactctgttgcagaggtcaatcttgatgaacaagataaaataacacctaagccaaggtgcctaccagaaatgactgagaatgaaatgacaggaacaggtaaaaatgtttagaaacctgactgttctctaaatatggaatgctttatgactaatatgactacatttctaaggaaatatatatataataactatattgataatgaaaactttaaatctgacatttttctaccataataataatttaaataattggaacttgctgatggtgacacaatgctagtaggccaagtaaagtgaggttttaaataaatatttgttaataaatgaataaatgctgttgataatagtgtagcactgtaggtgaacgttaactaattttctatgcctctccagagtattcagttaaatctgccatgtgtaggagaaatgggactttggtcttattgtgcttttccatagttctttctctaggaaaaagctacaccccatccccaaattctgaaatacctgagaccaactagactttcctaaagcttataaaggtctttgagataatgccttttcaaaattttttaaagcagtggaatgcacatcttcagttgaaatctatttttttgttttgttttgttttgttttgagatggagtcttgctctgtcaccctggctggagtgcagtggcgctaccttggctcactgccagctccatctcccaggttcatgcaattctgtctcagcctcccaagtagctgggactacaggcgcttgccaccacaccaggctaatttttttgtatttttttagtagagacaaggtttcaccgtgttagccaggatgatctcaatctcctgatcttgtgatccgcccgcctcagcctcccaaagtgctgggattgcaggcgtgagccaccacacccggcccagttgaaatcttatgtagaactctctcataggtaaaaatgatactttatcaggataaatatttaaacttatgtttgttacatttgttcataaaatagatgaggacagtaatggtcttttggaatttttgaaattagaaac

SEQ ID NO: 121714 - DNA, 1044 bp, Homo sapiens
taattgcagaactcttgtgtgaaatagctctgttatcttgacattcaaaaaaaccagagaattcttgagcaaggtagatgagcaaatggaacttaaatactttaagcaagaatttttaaggtctaaattaattttggtaattgccaagttttagaagagaattttagacattctgtcagagctagtcttgaagaattattgataaatgagagtcagtggtgaaagaagcctagaaaacacagttcctgatcgtttcaatgtggaataaaaagccctggatttcagattttgctattatttgcattgtggtaattttacataattttggtttcaaaacatatcatcattttccttttttaatttaggaagaagaaaaaactggcatgcttgctaatggtaaatattatttatattcatgttttagttggcaaaaaattagtctgttcagaatttcatctcagtaattctgaatgagtcactatctgtgtttgtttttaaatatttctaaggcattgaagttcctagcttttctcaataatgtgtttctatcttgaatccattctgttatatttaagattttttttgttatttttcttatgccctttgccttccatgtgtacatgtatactaggctgttcataagcatagatatgtatgttgatgttagcctactgtcttctacatcggaagaagatcatatttgttatatacatacacacacacacacatagataaaacatgcttgtaacatatatacatatataagtttatagattctttgtatataagcatttatctttgttttaatatgcattgcattttgtttgtttgtttgtttgtttgtttgttgtttgtgagacagactctcgctctgttgcccaggctggagtgcaatggtgtaatcttggctcactgcaagctccacctcccaggttctcactattctcctgcctcagcttcctgagtagctggaactacaggcgcctgccaccacgcctggctaattttttgtatttttaatagagacggggtttcaccgtgtta

SEQ ID NO: 121715 - DNA, 1006 bp, Homo sapiens
cattttcttaactcaagatattaaattaatgtaaatcttaatgaaaaaaattacgacaattaatgattttatgagagatttttggccaggcacagtggttcatgcctgtaatttcagcactttgggaggctgaggcaggaggactgttcgagcccacgagctcaaggacaacctggacaacatagtgggatctcatctctccaaaaattaaatttttaaaaaattagcaaagtatggtggcacatgcctgtagtcccagctacttaggagactgaggtgggaggatcacttgagccagggaggtcaaggctgcggtgagctgtgatcatgtcactgcactccagcctggttgatgagtgagaccctgtctcaaacaaacaaaaaaagatttattttggcaaataagttaagcttaagttaagctttagaaattgaaagcttaattaaaatttcaaaactaatttttaaacaagtatgttaacttatactttttctttggtatgacttgcctttatgaagtatagtaaatgtccttccctaataattatgctagtcacaacattaacgtctgaaacttacttggctaagataaggaactacatgattccattcacattcagtggtgcttcatactctaattctcacatttcccagttcttaccaagaattgttcagggctactacttcatattgcctaccttatagaacttatctttgaagctatctaatagtagctagtagaacaattaatattgttgttttgttatgtgttattactatttattattttggtctctatctgggcacagtctctttggtactgtgtgttaggactagatgtttttaacatgaatgaaaacgtggactcaaaagaaacacttttcaggtgtctataaatcttcttattttcaagtttacttagtatttggtcctggggtgtctacatgtcactcagttttgaggaaaaaatgagatgaccttagaaataacatagaaattaatgtga

SEQ ID NO: 121716 - DNA, 1627 bp, Homo sapiens
aacagttcctatcactgttcttttgcttcaagttactggtttttttcctttctttaatctgctattaatctcttttttttttttttttttttttttgagatagaatcttgctctgtcagccaggctggagtgcagtgataccatctcggctaactgcaagctccgcctcccgggctcatgccattctgctgcctcagcctcctgagtagctgggatacaggcacccaccaccacacctggctaatcttttgtatttttagtagagacggggtttcactgtgttaaccaggatggtcttgatctcctgacctcatgatctgcctgccttgacctcccaaagtgctgggattacaggcatgagccaccatgcctggcccaatcccatcctttttttttttctttcactctaacagttcattttggatctttgttttaaaattctttagcatttttcttcattatgttcatttttttcaagtccttaatattaaacatattttacagatctcagtatttgttcatttctgtgtgtcttttctgttggctatttagtttcgtgacactttttcctgcctcttagaagtctagtaattttttattggatattgggtattgtgaattttatgttattcagtgtctggattttattttcttcttttaaagagtattattgagccttgtctggtaagtagttgatcctaccacttgatttttttcaaggcttttcttatgctttgttagcagaagtctagagtagctctagtaacctctaaccctactgctaaggcacatcccaatgcccctagtgatcaatgaggtctctccacttaagcagattagagttcaaaagtctccctgtcttgtatgaactgtgagaattgtctaacttacagcatcccacttgttcttggctcattttatgcattaacagcttagtattcagcaaagactcaagggcaccctatgcagatttctggggctttgttttcacttaggcacctcctctcttgattactgtcttatattttataaattgcctcagcctttctgaacttatctcgctctcctctactcagtgatactgtcccaatctccccgcccctgctcactacttcagaacatatgtgccttcaggtaattgtaggctagctcacttgttttcttaggaatcacatttttttgctgccagttgtctaatatctgaaaatagttgttttatatattgtgttgtttacaaagaaagtacaatccctttaactccaacatggcagaggagaaagtcctctagattggcaaaaaattaaaaatttgcagctaagtttgccaacaaaagatgaaaaatgtcttccaaaaggttcttttacaattcatatggtttatctgagctttaagaacatttttatttctcaaaataacatttttgaagttacaaggatagagaatcatagaaacccagtaacttgaatatgtaacatctacctgcgaaaaaggtcagagtggtacaagtaaatattctgattgttttccgaacaatgtggaagagtctagatattatctctgatgtttctcatataagaatcaccctctcaaatttgttttactctttcatttttatataaacttaatt

SEQ ID NO: 121717 - DNA, 1034 bp, Homo sapiens
aagagttgcatgagaatatgtttttaacatgtaatgctaaattaaataaatattttttccagtaatcaagccaacgcagaactaactgatgacgaacatgagaatgaatcgaaacatgaagaactggcaggtaatttcattggttcttaaatttataatatttgaaaagataatatagcttttaataaagacattaataagaaaaataattaaaaggaaaatcatattgtctcagagctttgaatagagtgggtttgcctgtgttataaactgagctgctaagaaattgttgaaagtgaactgccttaaaaaggtttttttcatagactgcatatagctggttttagcatttttgttcaatctgacagtctctgccttttaattgatgtgtttttaccctttacagcagtgtatttattgatatagttgtttacggttttgccatttgttttcttttcatcttcttgtttttgttgcttttgtccttccttctattgtattacttatagtattccattttattcttattttggctttttagctattcttctttgttgtatttttttcttagttgccctatgagtcacaatatatgtctaccttatcacaatctactttcaaataatgttatatcactgtatttatatgaactctaacaacaataaactctcctcaaccattttgctatttttgtcaacgtttttcttctacatgtcttaaaaacaccacagtgcattattattattgttgttaaagcaatcaattatcatttaaaagtacttttaaggaatataatagatatttatgtaaaaatgtgtatttatccatatatttaccattcccagtgctttgtattccattgtgtagatttgaatttatctcaaattatttttcttcaccacgaagagcctcctttcacatttcttgtagtgcaggttactgctaggaacaagttctctcagcttttgtttgtctgaaaatatactctgcctttgtttttgaggaatacttttacttgatacagaattttatgt

SEQ ID NO: 121718 - DNA, 1009 bp, Homo sapiens
catctattttttgaaatgatatttacactaacgaaggcttctgtctaacctagtaggtttttaattgtacctactttgccaccttgtattttgttatagtaattcatgccacccacagtctatttccaatagtgttaagagttcagcaccaaaaactctctgagaaatgtaaagaacagagggaataaggcagaagatactctttgaagtgtcatggtatactgtattaagtacttgtaattacttcaaagtaattttaaaaaattttgtctcatggtgcaactctttgaagtattctatttaatatgatacagtgccaccaaatagaattataatctttcttttgtgagtgttaggtctgatggatttttatttaatagagcagatttattttatagctactgtgcacaaaattagcataacattattattgtgttgtcatagtggccaaaacaattctttgaacataaatcttcatctgtattaaattgtgtacctaggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatggtaagaaatgcaagggatatgagttggtaaattattaattgttatgcttatattcagaattacaaaaattatcttgaagcctcctttactgaagcatgtagacagatttaatatcttcctagaggtttagaattattctagagaagctttaaaccttacgtattattaatatgaattcatatttggtgagtgagagtaaatatttgtaaaatttttaaaatttactacataatgtcaataaatgcatcattcaaatcaatgttttcaaaattctgtatattactaaaatatatttgtgctttccatttagaactagtagtttctgagctcaaccatagtagtctcggagtgggattggacac

SEQ ID NO: 121719 - DNA, 1026 bp, Homo sapiens
accctgaaactcagttcttccttatattgaaattctgtttctagagtggtgctatgcaattttgttcagccattatttattcttaaaccctagagaatgtctagaagacaggactgtatcctcccgttttttctttgctgaaaaaaattcttgatcaagttttacgtctttgttgttattctcctggtttacttaattatgaaattgatgctcagagatgtgtgtctgatttttaagttattttggccaaatatgtttgtagctgtgaaattatacgttattgatgagaatgttatttatctatgtgatagctgaactgtgagcgaactaatagaaacatgcttaatgatgaatctgagattcttgaatttacactgtattttcaaattgaatgtcttatatctaattcagctttcagatgattcttttgaaaattcagacaaaacagctagacaatctaaaaaagagatgaagaagaaagatacagtgccttggtggataactgaagatgattttaaagatgatggtaaatgttgctgatttttagtttcaaattatttgaccacaaggggtcagtcaagacttctggattttgttacttcactataaatatatacagaaaataatactaatagtgtggatttttgaagtttgaattgattttcatataaccagtactttattatgtatttattatgtaattgagaatctgcgttataacattatcagcttattttacatggagataatttatatttactcaaattaaggtgacaattcaggtatatttattatcatgtttaatgataaattgatttaaggtgatttaataagatattctggcagtatattaatgtcattgcattgggaagagtttaacaaacctatagaccttggtatcacagtttgttaatgacagtagtaaaaaaaaatttactgccatatgtatatatgtctctcatatatatgtatatgatatgcccaggctgaagggcagtaacacaatcatagctcattgtaacttca

SEQ ID NO: 121720 - DNA, 1035 bp, Homo sapiens
caatctcttcaaaattgccccttggaaaaacagagcgctcgaatgacaagtgtggggaaggcgggaggcgacgatgcggagtgcggaaacacaaggaccaggggagctaaactacatttcccagaaagccacgggctggcctacaaccaccgcgccctccaagcctgctggaagcctccgtctcgcttctccagtaaccggtttgccgctgtccccttttctaaggaacgtagagaaagccagggaaggaaaggcattttactgcagcagcgaaggtttagccactagagtgtctttctcagccgtggttattccgaccttcgcttgtaaaggcattgggaaacccacggcccacgtgaccagcccgggtcatgtgactccagaacccggcagctgaagtctgttaccctgacaactggtggacccgcacagaccttccgggaaagcgcggaattcagaggcagaggtaggtggtaaggtgtgaacgctggtttcccacccaaatcgccctggtcgaggccgtgcttcatactcgagcgaagggctttaattttccaggtcattccccttctccgcccggagcccacggcaaatgcgtctttgtcttccctccaattcccgaacccgcgcttctggggacggggtcgcagccaggcttgagaagcttttagtggagctcacccctgaccaagctattcaggccaagaccttaaccgcacttaccctgaactgatcgaaagtgcaaatgaggggaagaggtgttactctgcacgatggggagggtattgtccgggtctgcaagccctcttcccctcccccatctctacagaagaaagctgggatttgagctgctctagggagttcaggagctgggggtcgacccaaggttgggttcattaggtgtctaggggaacgctttccgttgcaaatcactggattctgcttgtgttcagcacataatttttgtcggtcttccctcgcttcaaaagaaacatagtactgatttgtgtactccattaactttaagtattcttt

SEQ ID NO: 121721 - DNA, 1047 bp, Homo sapiens
cccagcaccttgggaggccaaggcggggggatcacgaggtcaggggatcaagactatcctagctaacacggtgaaaccctgtctctactaaaaatagaaaaagttatctcggtttggtggcaagtgcctgtaatcccacctactcgggaggctgacacaggagaatcgcttaaacctgggaggaggaggttgcagtgagccgagatcatgccattagactccagcctgggtgacagagtgagactccatctaaaaaaaaaaaaaaattttcaagttattgtgatattaagtgcatattaaaacagagtggcagttacagactttgtatctttaattttcatgggaatcaacaacaggaaacctttagctctgtttgagacttcataacagagctgtcattaaacgttgccttttttctcatatctagaacatagatatttctcactccatatgccagccaatttattttggtttacaatatatatgtcttaggttagaattttaatacactagagctgttaggcaatttacaaatgaacctgtgtcttgtcttctattaaatggatttatttttactttaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactg

SEQ ID NO: 121722 - DNA, 1100 bp, Homo sapiens
tttagtagagatggggtttcaccatgttggacaagccgatttcaaacttgcgagctcaggtgatctgcctgcctccgtcttccaaagtgctgagattacaggcgtgagccactgcgcctggcctaaatcatgttagttttaaagttagctatcaataatatatttgtacatctttttatgttactttgcttttgtggtatgtaaaaacaaaggggtctttaatggataatgaattatctactgtaactaaaatgaatattttagtttttatgtaatatttttggggaacatgtattttttattgcaattcggggcataaatggggaattttagaagcatatattaacctatctaatattctgttttgattggaaaaagtttaaatgcctttgctgtgtgacacttaatccttattgattatcgtcagcagatgtaataaactatatatctctttattattccaacttttattttagcttttcaatgatctgtttaaaaataatgcaaaccgtgctgaaaatacagagagaaagcaaaatcagaattattttatggaggtgatgactgtagaaggagtctatgattacctgatgtatgtaggtaagatctaagtggtttaagacttgtttttcattcatcttacttcttctgtgatgcaaataatgatcttgagtattgccccatcataactgtctttttaattgaagataccttttataataattcaatacgattggccttgatcatattaaagttgctagtgtttacaaataaaatattgaccatggtcatttgtgttttctacattggcaaatttcaaaaataccaattcatctggaacaatgaggtatcccatttgatcctttctcaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagaggtttgtattttctaatgtgtttgtttcatattttgtgtactctatgattttaattgaatctaaa

SEQ ID NO: 121723 - DNA, 1025 bp, Homo sapiens
gtcacttctaggtaactaaaatatgggataaaatgtgttaataatgttatgccaaaaataacaaattacaactgtggaataatgtccagctttgtattcttttttctttttctttctttttttttttttttgagacagagtctcgctctgttgcccaggctggagtgcaatggcgcaatctcggctcgctgcaacctctgcctcttgggttcaagcgattctcctgccttagcctcctgagtagctgggactacaggtgcctgccaccacacctggctaatttttgtatttttagtagaagcgggatttcaccatgttggcaagactggcctcgaactcctgacctcaaatgatccacccaccttggcctcccaaagtgctgggattataggcgtgagccaccgtgtctagccagctttgtattcttaatgttttaaatatggcattcttttaggttttgaaattatttgttactcagtgtgtgtgtactcaatttacagttggacacgagcctgaacattggtctgtctatagaagatatcttgaattctatgtacttgaatcaaaactaacagaatttcatggtatgttattctttttggataaaacattacatttcagcattagcattctttaaaactatgacaccagattaatttttttattttaagtaattgaaatacaagaaatacaacattgatgcttgtgtatactttcattgataacggaaatgtactgtttatcttatttttatttatctgtatatttaaagttcttgcaatgtacatttatgctttttttaaataaaatcaaaatttaaaaatagctattttaaaactatattttagaaagggttctctatttactctttttcgttcttcctgtctcatcaatgtatttattttggttaatatcaaggatatagttataaagaatttccagctatttttttttgtatttagcttggtgaattttatttgtgtgttctaaatctttttattttagaaaagctctgtagagtgtcc

SEQ ID NO: 121724 - DNA, 1055 bp, Homo sapiens
ttggcagcagtgcctacttgctctgtgtttcccaggctagtctcaaactcctgggcccaagcaatcctcccacctcagcttctgaaagtgttgggattataggcgctgtccccggcctattatattttcatatacagatgatgtaagaaaacttggagttgatgctagtaacttgttagtttttaactttttacctttactttttcagtagaaaatttaatatcacctagctttcagggtcttaaaaattatcaattgatatgggcatattactttatacttgtatctcatatgctgtagttctaaaggtattgggaatattaaattcatcctggtaatttttttccagattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcaggtaggaagctttctgagcacctttcttaaaagatgcccatgaatgagtctgttgttatcaggtatgataaacattttgccacttctaactaacaaatatggctgcatatccaaaagagaagtgtccagaacagaaaattgaaagaaagcttaggatgtcctaggttatcttcatagcagtaactaattaactaattcaatcaacacttattgagtgatgcctgctagacacctgacagtccatcaggcattcaatgcaatgttcttttaatggttttgttgccatcattagccattgcacttacttaattatcattaatccatatagcactgtatcaggtattattctagtttaattaagacagcgttttctctcacccattttgtgggctaattagaattgatgaaaatatggccaggcatggtggctcacgcctgtaatctcagtactttgggaggccaaggcaggtggattacctgaggtcaggagtttgagacccgcctg

SEQ ID NO: 121725 - DNA, 1062 bp, Homo sapiens
ggcactattctttttcttaaagttccatctgaaaatgaagtactgagaaagtaatagtttaatgttttttttttctgtcgcataattttagtccagttactctaaagggatgtttttggttttgaacagatcttaagcattttttaatctattttgaaatattgcaataagaactatattccactagggggctctcatcttttaaaaattctaatcctgttaatattttgaagttaatactaggtaaattttgagtgtttataaataaatattgtcccatttattcatccaccaaatttaaactttaaatactgtgtcatttttgacttctgagatgttgatacttaatccgtgtatgaaaactccaaaagttatgttagctatacctttagtttatcattttcaaaactgtttttcttttttttaataatggttttcaataaactagactgttgtgataatttgctatgtacttgatacatttttgtttaatattcaggaacacacagaaaaggggagaatcatttggaatcagcagaataggtagcaaaattaaaggagtattcaaaagtaccacaatggagggagctatgttgcctaattatggtgtagctgaaggtgaagatgattttgtaagtaaaatgtatcaatttgatttatttataacttcagacttactatgacataaaaattagatatactcattattttcctttttttggagaatctgtgtattctgtttaatactttacctttatcttcttacttcagacttcctttgtatttctcattctttcattagttgtgatagtttcatgacgtgaatctaatttttaaaattcctgagaactgtgttattgcttattaaggcagaatagttcctgttaagctgagatacttctaatagtcaagcagtttaccgtcttttggttaagcttcaaattctgatgttacctttttcccaccatgtactccaggtatacagagttgctaatagatgctctaactccttgcttacttaaactacagtctgttgacaagcagcattggcattacctggaa

SEQ ID NO: 121726 - DNA, 1010 bp, Homo sapiens
tgttttgcttatctgttcatccattgatggacactttggatgcttctacctttgatccagtgagattttgaagaaacaagaatgatttagaaatattttaaatgccaaaatcagaatagcttttatttgcccattttcacaaaggttaagaacctgttttgtagatgtaaaaaaactcctgctgtaatacatatgtgcagattttttgctactgctccatttattttttcatttttctagaaacttacataatatgatacaagttatgagaattctggggagaatacagtagtggaattattttgacttatgtttattattttccactaggatactgtgaatcatttgcttatcatcttcatagatgacagtccagtgagtattgaatatattagaaaacacttcagattgcattgaattttgattttgtatgtcaaatcaagtgggaattttactgagttaataattctctttctttcaaagcctgaaaaagcaactgaaccggcttctcctttggttccattcttgcagaaatttgcagaacctagaaataaaaagccatctgtaagaattttcagcaataacacctttttgatataaacaattttagaactcatttatatagcttaaacttaatctttctcttatatcaaggtgctgaagttagaattgaagcaaatcagagagcaacaagatcttttatttcgttttatgaactttctgaaacaagaaggcgcagtgcacgtgttgcagttttgtttgactgtgggtgaggcttacctgtgtattttacgaaagtaatttttaaaccttttaatgtatttgaatattttaaatcagatctgatgttgtggtacccatctatcattgtactaaatttcatatactcgatttcctttttttttttttttttttgtttgaggcggaatttcactctcgttgcccaggctggagtgcaatggtgtgatcttggctcactgcaacctccgcctcctgggttcaagcgattc

SEQ ID NO: 121727 - DNA, 1040 bp, Homo sapiens
tatgtcgttttgttccctccctactgcatttgtaagttactgcccaatgttgcaactccttgtaaaaattatgacatactgcgacacccaaatccaagaaatggaagatttaacacccagggtttgttttattttgttttgttactttttcacttatataacttatgtactgatttgagtgtacaggtaaaattttcgcaaagcgaacatatgtgtgtaaccagcattcagatcaggaaacaaaacgttaccggcatcccagaactcccctttatgttcctctctagccactatactcccttcagaggtaaccactaacacctaattttgaccccttacataaatcttagctgcttgtttcttcactgtattctgaaaatactgacttataaagttaggaatggaaaggactaacttgctctgtttcttctttccatagcacgtttttggttcagttaagcttcagagtcaggaacaatttatttaactttttgtttgattatgggaatatttagaaatatgtgcatgtcattctaataataagtttttctatttgtggaatttttatgattttccaagtgttttctcatatgttttctttgatcctcattcacataaggatgaaatatacattttgtcatgtgaaagtattatattactgtcgttatttgttttttgtttttttgagacagagtctcactctgtcgcccaggctggtgtacagtggcaacatcttggctcactgtaacctctgcctctcaggctcaagcgatactcctgcctcagccccccaaatagctgggaatacaggtacacgtcactacacccagcttattgttctgttttttgtagatacagggtttcatcatgttacccaggctggtctcaaactcgtgagctaaagccatccacctgccttgacctcccaaagtgctgggattacaggtgtgagccactgctcaccgcctactgtcactatttgtgataataaaattgtttcttggtaatgttacatattcccaaatggtaccatttatttt

SEQ ID NO: 121728 - DNA, 1046 bp, Homo sapiens
tagactgtgttttccatgcaggtagagactatgcagtgcagttcctcactgtattcccagggcctacctctgtctataacaaaataggtacttagtaaaatttttttgatgtagtgaaaaataatcagaattttgttgggatatgaatactacaatatcatcagaaggtattctggaagaatgtagtatagactagttaaacataggtaccaattatgaaatattgatcatttatgcttccttatcctttaaatgaaatatgtatttgatagcatacatcttatgattcttgtatttaatacattacaaaaaattaatcataatttgaaaaattgcttcaatctgatattgtaggtgcttaatgaatgcttgttaagtcagtgaagcggtaacttagaattaggcattttctttggttgtaataattattttcatttatttttaaggtatattcatattttaatgatcttctggtcatttgttgctggagttgtcacattctactgctcactaggacctgattctctcttaccaaatatattcttcacaataaaatacaaacccaaggtaaaattatgtgttcttattgttaagaatcaatgtatatgagcctaagctgtttattatttgaaagcctgctaaagcagtatatttttttaatttacaaaatttgttttctttcaatttcttctcttttttttttttgttttttttaggtactctgctaaaagcagtgattttattataaaatgattttattattataaaaaaatccatccaattttatttaataatggaagtctattagaaaattttcaaaataagatttgtatatgtgtatgcttttaaggtatacaattctcttagaggagctataaaaagaaaatatggtacaaaagtttcagaaagttggaatccacaattttagggtgtcctctattaaccgtgaggacaataaattaaatcacaggttctcaaagctggttgtacagtaaatctcctggggaattaaaaaatacagattcctggggtgtactaccagattt

SEQ ID NO: 121729 - DNA, 1910 bp, Homo sapiens
agaaatgtgcataggtttatcatcaaggatggtaatatcaatggactttagtggttagcaataatggaacaggatggtacattctgataaaggataataatgcatcattaaagatccatgtttttgtaatacgggaaaatattcatgaaactacatacatcattaaaaaacatttgtttccccactttgaaggataagatcctaggaaagagagatgacaggcacaggctctgtctttagaacgtgttcaaattccggctttgttagttttatgatcctaagttcctttctgtctcagtaatttgcctgtataatgattgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtaacgccgcagcgcggagcctgggcggcggcttttctccgaaggtgcagacgcccggcccgtgctgcttaaccgtgcggaggccgcgtagctgcgggactggggaccagtggggagagcgagctccgcagaggagcggcctcggggagcacggcggagcgtcgaggccggaagcacaggccggtggggtggggttgattgcctcctttcccgaggcttcgtctcctgagctacctttttctcatccatttctcaaaacgagttcttcatcttcgttgcttttcaaaagtgaaatccgtgtgtcggctcaaattgagactgtacacaggcagtcaagtcagctgacggaggagtgttcaaggtccagttcgtagccgcaatt

SEQ ID NO: 121730 - DNA, 10303 bp, Homo sapiens
cttggatagcattattgtagaaacaggaaaactttaaggtctttatgctaatttactgtagtaaactttgaacttcacacattttggttgtgtgcttgtcctacttgccattttgcttttgtaataaatgttcttcaagtatattggaatagaatcttagcagaaatgcaattcaaagtgacaaatttttttttgagtcagagtctcgctctgtcacccaggctggagtgcagtgatgtgaccttggcttactgcagcctccgccacctgggttcaagcgattcacctgcttcactcagcctcccgcatagctgggattacaggcatgaccgctcccagccctaaagtggcaaatttgacagctaaatcaattgtaaaaattctgtaacaggtttattgggagattttgaagatcatgaagaaataaataaggttcataactagagatttgtggtattttgggatgcctatattgtcatcctgatcctctgatcattactactactaaaacttaatctagtacaaataattctgtattaaagttatgtgaattatgcgaagtaaactctggatttaaactgttacaaatggctaaatgcctacttgttaactaagtaatttgatttaaactctaatctctgtctcttttttaataggtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaattcttgtgtggaatatgtctgcacattacacaacactgatttattgcagttttctgcttctggtttaaagtgctattttacaacagacttcatgttcccatcaaaaataaaaagataatacatgtagtaagtttaagttggtaagtattttagagttcttaattgtgatgaatgaactgtataaaaggacaaattcaggtagtctcaaagggtttgcaggtcacactgacaagtccactttcagttgcctaaagtttatcctaactaacctaaaactcagattgagtatattgccctcttgactgttttgcacaccatgggactagaaagcagcaaagaaactctagtgtgaaaacaatgggaataggtttgggtaatttgtgagttgcactctaaataatcactgtacttacctaattaaaaataaaacagctttacagttagttttgggtaagcaaatatatatctgaaggataaaatttacctcacagactggtttgtattaaagatctaatagtttggatttttgtttcacattttagtcttgttttggccatatggtctatacttctaacagtaatgatgggaaaatgttagagttttgggggacagactctaggtcaacagtgaaaaggtttaacagccactccccacttctgaacctccatcacccttgaatttaaaggtattatacctgacaataaagttacatgtgaaaaatacatgacttgaaagacaaactttcttaaaaatgtcactaaatttcaaatctcaaggtcaaacaagtctgagatgtttgctttcagcatattttatgattacttcatgtctcaaaaatgggaattacttgcaagttaatgggtaactttaaggtgtgacttcatttaggtttcctgttagtctttttttttttttaaataaaatcagtttgtgaacaaaatggggttttcaaacctcagtccagcctcctcactcaaaggggcaaaaaagcaaccaaaaacctcaaagcaagtaaaaaacaagcaaaaagaagttcatagttattaaaggcaacttttttggctagacagtatatttagaattaccatgttaaggcttgtctttttaatgttatcattatgtatgtacacattattaatttaagatgatttatctaactgattccttttgttacctggctagcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaattgtcatttcttgccttcttttaggctttcagctgtattctgaaaaggagattgttgtgacaaactcaacttgttttggagagaattttaggaaacctaagggatttggcgttttatatcatttttgatgtgcagtttttgagttttcagggcagaagggcaaagtatttggtgtggacaagttgttaccacagattaaagaataagaccagggcttgctgacaataagaaatttgttaaagagttttgtaggttccatatggtaaaattaggtcttgtaattatagaaacaccatgatatacaagaagagttccagcatacctgttatggctcgttaatagtgttaactttaagttgaaatgtgaataacatggcatttgtgttacatgagtactgcatcatttaaacacaaatttgctaaagctaggtgcatctgtatactaaaacccttatgacatcatttttaagagaatatctttaatatgtcagtatttatgttaattggttgctttaattggaagactcaggaattaggcctccagttgcttttagtttaacacgtcatgaaaaattagaaaagcatatgtacaaattgtatttctcagttttatttaatatttggaatatacttagaggaaaaccagaaataaacaatgttaaaggtcatctataaaaatggcagaatacacttttcatttccactctagagccacatgtatacagtgtagttttggcaaatttcattcatacctctacctcctttgctgttttccttgaaatagtaaaaattcacatgaatttgcagaaattaagttcttaggagttcttcaacagtattaaagacaggttctgttcccttttggtttcctgcctaactacaggtacagttaaacatggaattaaaagacagcctttattgtaaaattgtcatgtaacagatcctagttgatctctggtttcctggagatttatttagcatttgggagaggatcaacaaaggggcacagcaagcagatactgtagttagtattatttttcccttttttgcttactgtctatcgattagtctttaaattactagtacattttatgataaatttctttgatttattttacctccttttagaatggaagctcctcgaagggcagggaaatctgagtaggcaggcatttaaaaatatttaaaatgttcagttgggtggaagtttagttttatttgccaaattaggcttgtgacatgagaatttgacaaaggggatcaaatatttcgaaccatttaatttatggcatggaaagcttttaaaaatgatcacaaagtgctaatgatttaagtaaattaagatgaagatccacatttaaattatcaacgtgacactttaaaaaattataaaattgtcttaagttgagggaacagttggcctagtgacttacagatttttttatatgttaaaataaccctatgtgtaagtgactgttttccttatttgaaattaagaggaaaagggtgctcataagtcatctttagcagtgaacttaacagaatccagtggatcagttttcctttatgctgatgtgtagtttaatttgtgctgctgaacaagacagtatcaatttataagccccctatctataagttctttatgaggtgaggagggggtacttcaagatggaactgttttgctaatgagggtctggttggttttgagtctaaagtttttataaggttcttttgcatagcaatttgaaggtgagggaataatgatacttgagaaaaagcatgaagcctagataactaaaaatgaggtgttgaaagcacctgtttccgagggtagtgtatattgcttactctatcttaaagtaacttagagaaatggttacatacatatgaatagcctta

SEQ ID NO: 121731 - DNA, 1029 bp, Homo sapiens
tcctaaaaagttagttactgatttcctagaagaggggtaattgttcttgaatgtgagagcaataatcactgtcaatactattcaaggttaattttctgttgattgccctgtttggaatttaaaggaagaggatgcttctacatatttctgttacttcataatcagggaattgatcaagttctagtttctgcagttaattgtccagttggacaagttggcaagctctgaacctcaatttcttcagttctaaaatgggatcagacaaaattatgtaatagctctggattatgtgattatccaagtgacccatgcttgttctgggaccaaagaaaatatactttgtaggtttgatgatagtgtaaatgaaggaagactacaaaaagagttagttttaatgctctatatttcaaacacctggatatactaaacagtgtaaaataacttctttttatttctttcagaagacgatatatggttaatttattaaagtagaatgtaagtataggagattatattagataatgtgattagagcagttacatttggtacttgatagagggagatactaaatagaaggtggaggatgtcagtatatctgttaatatttgaaaaggagtacaaactaaaagggatgattgcatgttactttcgtactttaacttgctacagtctttttttttttttttttaagttttaactaagcacgtattcctacataattctcactgtattcctgtgagttaggtactctatcccttagtttgaaatgaggaaactgaggctcagaagtcaacttccttggggtcattcacatagtaagtagtggagttggatttgaactaaggtagtctagtctcccataattttccctcttaaccactataccaggatttctcatctctgtcctcctgacattttgggctggataattcttggtcttgggggctgccctgtgcgttgtaggacttttagcagcatccttggcctcttcctgctagatgccagtagcaccccctttctcagttatga

SEQ ID NO: 121732 - DNA, 1885 bp, Homo sapiens
gccactgcgtctggcaaatttttggcagttacaaataaagctgctattaacatctctctctaagtttttgtgtgcatgtaagttttcaactctgggtaaataaggagcaggattgctgggtcatatggaagtgtgtgtttagttttgtaagaaatcgccaaactgtctttcaaaggggctatacccttttgcattcccaccagcaatgaatgagagtttctattgctctgcattcttacctgcatttatagtgtgttggattttggccattctaatagttttgacttgcggtttccgaatgacagattatattgagcatcttcatgagattctttgccatctgtatatcttttttggcaaagcatctatttcaggtctttcaacatgatccagcagttctgctgcttgatatttacccaaggagttgaaaactttttttttttttatattctgacattcttctaatggattgtgatttgagttaactttgtagggtggggtggtggtatcttagaaatggaactctttggaaataatacaggggggtattttcttccccctaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggtaaatatggtggaattacaggcatctaaatcagactaacaaatttagtcattttagaatctcaaaatagttttacaaattggaggagactttggaagtccatggaatccattcaaactaaaaccttttggttttagtgatgttggcagttttctaagtaaaaatgaaaaataattgaatatctgcatctttaaataaaattatttgactgcctgcatggggctttctcttgtccttcccacattaatgataaatgatattccaactttaaatgaatcataattgtatgaaagtcctatttttatattgacttatctaattttttaaggctatggaagaaatgaatggcaaagacttggagggagaaaatattgaaattgtttttgccaagccaccagatcagaaaaggaaagaaagaaaagctcagaggcaagcagcaaaaaatcaaatgtgagtgaaatttgtatacttaaaaattgtataaattttaatatttatacactaattggaaaataacaggtgttgatcagacttgttaaatgcataacatctctttaaagaagacttgaacgtttgagagtcatagggaaacaccagtgatctaagtgtttattgaactcttactatgaaccatatttgtgaaaataatcagaattgtaaataactggaattttggtaaattggcaagatgaaaaatctgtctagctttttttttgttttgtattgggtgacagagtctcactttgtcactcaggctggagtgcagtggcactctttcggctcactggaacctccacctcccgggttcaagagattctcctgcctcagtcttctgagtagctgggttacaggcgccaccatgcctggtaatttttgtgtttttttttttagtaggggtggggtttcgtcatgttggccaggttggtctcaaactcctgacctcaggtgatccgcccacctctgcctcccaaagtgctgggattacagctgtgagccaccatgcctggcctatctcacatattttctttgtattttacagaatgttcttctgaaaatgtcttaaatattagctgtccaaatatcttaatacattttgttaaagggtggagagttttttctctgagagataggaaatactaaatctctattcatgatagactgtttcttcacca

SEQ ID NO: 121733 - DNA, 1570 bp, Homo sapiens
attggaaatttttatgcagtacttataacttctattttatttgaaataaagccattgatatctaaggccagaaaagtgccattaaaaataattttagtgtttgcataataagaaaaatagccatatttgatctatactgccattttcttagaacaattatatgaaaatttttatctgcctctctgatctaattagtgaaaacaaaagtagtccttacctctaaaaagagcacatgttcttttctggagatttctgtgttgaaaaacttggaaacagattaggaaaataatccggacctagtttttgatagtcttttataaagatgtctagtgaaggaaagagatgatttttcattttgatatttaagtagtatcttagataaatcctttgatccacttgtatttgctagttatttcatctaattttcctggaatggttgcttacttgcagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaatgatagtcaagttaaaaatattttttgagggattaatgggagaagggccggggttggggtggggggaacataaaatgaacagtatacatttttttattttttgagacaagagtctcttgtttcccatgtttcccaggctggagtgccatggtgccatcttggttcactgcaacctccgcctcccgggttcaagtgattctcctgcctcccaagtagctggaattacaggctcccaccaccacacctggctaatttttgtgttttttttagtagagctggggtttcaccatgttggtcagactggtctcgaactcctgacctcgggatccacctacctcggccttccaaagtgctgggatttagaggcgtgaggctattgcacctggccctggacacatttttttttaaaccatatttttagagttgggagaaatgttctttactacgggactaggcagtgcgcactggaaataccatgtgcctgcaaagtgaaaatagaaattgatgcgtggatacttagccataattgtatagccatcacaatcttgtaatgaagtcgcctacatgctgtagacagttgacttccattttgtgtgttttttaagagcaatttgagtttttgagaatggcaccattagtttacatggttttggggttaaaagtcttactactaaaaacagtaaattatactggccgcagcagaggtgcttgcagttacatttagccattattaggtatcctgacttcagcagtcagtggagacattgtataagaataaacatcccttgagtcaacactttattacacactggtgcagtaatttgcagttatttgttctatcctttgttctctttttttttttttttttttaagtgacagggtctagatctgtggcccagggctagagttc

SEQ ID NO: 121734 - DNA, 1009 bp, Homo sapiens
cagctaattttttttgtatttttttagtagagacagggtttcaccgtgttagccaggatggtctcgatctcttgaccttgtgattcacccgccttggcttcccaaagtgctgggattacaggtgtgagccaccgcgcccggccttaagtaaacggttttaattattattactgttttcggagacaggttgtcactctgttgcccttgctggagtgcagtgtcatgatcaatgctcactaaccttgaactcccgggcttacgtgatcctcctgcctcagcttcctcagcagctaggactatgagggcaccaccttgctaggctaatttttaaacttgtagaggtggtgtctcactatgttgtccaggctagtcttgaactcttggcctcaagcagtcttactgccttggcttcccaaattgctgggattacaggcatgagccactgcgcctggccattgtttactttttttttaaaaggatgctttactgtgggtaggatctggtagatttgctttagcacaacaaagaactagattttagagaaagtgaagtaattgaaacattctagagaaaatacaaatctcaagtttttttggatgttttttgccactttgtattcatttgcggacatgaatacccctttcctaagtatgttcctcaagggcgcatactttggaagctatctctactgtgttacattttgagattctacttgttacagttctatccaaagtgagtttttaattgaagtgtcattctagttatatataactaaatgttgggaaagtgcctcatgcctcctttgcattatttatagatcagacaagattgaagcacctctgtttctcttttgagtgtctggaggaataccttaggttgaaatagttttaggtatttggcattgtcttttaatactgatacagcaatgaatagtttctctaggttaaatagtactgtagactttatatttgtatgtggacttataaaaatgggttaattgatgttaaca

SEQ ID NO: 121735 - DNA, 2307 bp, Homo sapiens
gagatagaatctcactctgtcacctagacagcaggagtgccatggtgcgatcttggctcactgcaacctccgcctcccaggttcaagcgattctcctgcctcagcctctccggtagctgggattacaggcatttatcaccacacctggctaaattttgtatttttagtagagacagggtttcaccatgttggccaggctggtcatgaactcttgacctcagaagatatgcctgcctcagccccgcaaagtgctgggattgcagacgtgtgccactgcacccggccaagtcttccttttctatgttgtgtgaatattccccactggtttgcataattgagtatgatggaagttaaacagtacaaaattatgttacttgaaagaatataagcctttacaaagagaatttgagaatttagatattttcaaatcatgtctgatttttctcttcataaaagagtgctttgtgttttagagggaattcagatttactggtaacctttgagttgtcaaaattttagtttcagcagttcaatttgaggggaggggcattttagagctctagaaagaggtaccttagaaatcctttagtttgtttttatgatttgttttttgagacaaagtctctgtcacccacgctggagtgtgtgggcatgatcttggctcactgtaatctctgcctcctgggctcaggcaattctcctgcctcagccacccgagtagctgggataataggcgcgtaccaccacacctgactaatttttgtatatttggtagagatggggttatgttggccaggccggtcttgaactccagacctcaagtaatctgcccgccttggcctcccaaagtgctgggatgacaggcatgagccactgtgcctggcaggttggtcttgaactcatggtctcaagcagtcctcctacctcggcttcccaaagtgcaaggattactggcatgagccaccttgcctgtcccaaaatcctttaatctcctataaaagagtagaatatttttgccaagtagcaataaagtagcagtaagtgaaaatgcagaatgatccagtaagcaatgaggtatcataactacagaaagctaatacagtgggctctctctactgtgggtcctgcattcacagtttcagctagctgaggattgaagatactcccaaaaaacccaataaaaaaaaaaaacaacacaccagtgtatgagagaatgttcgtaggttatgtgcaaacactatgctatttaagagagttgagcattcatggattttggtatgggttcctggaatcagtcccccgtatgtgctgagggaccactgcagaatttagctagtggtgtcatccattttttaacattatgaaaaagaatcattaaactgacatcgtaggttacctaattcttgccgtcaaaatgtaccaattatggtaggtgaccactataacttatttatagatgttttccagaaactttacagtaaagatacatcattagaggaagatggtttataatccattagtaacagtgatttcgagtgccagtagacactaggaaatgtttccatttgtacaattgccttgtttaataaatacgttaaattataaaattgcattgctgtaggttgcttagaatatagtcttattaatatagtttttaaatataatggagaaacttctatagataagcattctttttgattggcgtaggaattaacccttgtcctaaaactttctacatttctttctgggtttctctgttgtgatttgaatccttttctgggggcataattattttgtactatctaattaataggagactttgcattttgttgtcttttaaaagatacttttggcagggtgtggttgctcacacctgtagtcccagcactttggtaggctgaggtgcaaggattgattgaaaccagcctgggaaacatagaccccatctgtaccaaaaagtaacagattagccaggcagcgtgcacctgtggtcccaggaggtcaaggctgcaatgacctgtgatcatgccactgcactccagcctgggcaacagagaccctgtctcaaaaaaccaaaaagggggaaaaaaaaaatttccaatggtaggtattggtatacagccagtaggatatattggtcataccatcatttgctttttttgactttttagtaagtttttttgaaacggagtctccctctgttgcccaggctggggtgcagtggtgtgatctcaactcactgcaacctctgccttctgggttcaagtgattcttctgtttcagccccctgagtagctgggattacag

SEQ ID NO: 121736 - DNA, 1927 bp, Homo sapiens
aggttatgtaacgttgcagtttcataaagtttttaaaagtcgttttggctgttacttttttctgaaggacccatgctatcccatgaaatatggcacgtaaatgtcaaataataataggagattttttttccctgtagctcccaagtttctagacttggtatgggaagtgtaatttcttctgaggttggcacaatgcccagaatggcagtatgtacctaggagtggggtttatagggaatttattgggtgagagatccagatttgaaagatgctcaaccaaattaggtacaatcattttttaagatggtattaacatagtaatacatcctgtcttgaaagttgctgatggattggtcttaactttttgttgtccattaagcacactattcagtaattaagtggagactagaaagtaatttgaacaggaccctggacttctgataataatttaggagtataacaagtacacatttaaggggaaattttaaaacagacatcacaaacctgtttttataagggaacatgccaagataattggaaagatttgagcaagatggatgttaactgctaaatatatgggtgtggtctagtgaattaaatgtattaatgacgtttgaacttttcaaggcactcttggaaagaacaggctacacacttgatgtgaccactggacagaggaagtatggaggaccacctccagattccgtttattcaggtcagcagccttctgttggcactgaggtaaagcaactaaaaacttgtaccttttgtagtaaaagcacaggtatctggtttcctaaagcaattctccatggtttttacttaatatttaatttacagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactggtaagttgtccttttttccccttcagttttcacgttcactgtctttaatatcaagtttttttcttagtgtgcctaagagtttaccaaacattttttgaagtactgatttaggcaggttttttttttcccacatcactgtgcaagcattgtagtgttattctttgcatgtatagttgataggattcagcatctaaaaggcggcatggtagaattcctagcaattggttcttataaacatctggcttagtgacgtttttgtgtgtttgtttaaatttataggaatgtgaaaagattaagaaaagtaactgtggtaagagctctcatacttcctggccatacctgagccatctctttttcttaaataattcacaaaagacattgtgatacatttctagttgatgaaacaaaagattttatggtgagtggcaatgtttgatttaaaaataccagatgttaggtaaggacctggtaatctttccaacttttttaaaaaggaaatttttcttttttcttttcttttttttttgagaccaagtttctctctcttgcccaggctgaagtggcatgatttcggctcactgcaacctccacccctcaggttcaagtgattctcctgcctcagcctcccgagtagctaggattataggcgcctgccaccacgctcaggctaatttttatatttttagtagagatggggtttcgccatgttggccaggctggtctcgaactcctgacctccggtgatccactcgcttcggcctcccaaagtcctgggattttagacgtgagccaccacgcctggctagaaagaaattttaatattttaaattatagtttatgtaagtcctttaaactagttttattaagttctgtgacagaagtggtttctgcattttatagttgaagagtt

SEQ ID NO: 121737 - DNA, 1059 bp, Homo sapiens
ttaaatctgttctattggtagtcctagtataaagaaacacacccatgatacctctagaatattttttgaaaagctgcaaagccagcttattgacagttgaaatactgatggagaatgtacatttggcaactggcttttttttttaggagtctcaaaccccaatgaatttagaatgttaaccctgctgccctccacttccatcagtatggattattagactatttctcaaagcagctttgacaataagattgtttagtgtgggtatgtagatgagaaactgaggctaggaggaggaggctttttttttggtttaaaatcatggtgaatggcttcaaattcagcttggttttgatatttatattggtgagttttctaatttatagacaatgtggtgattgtattactttttaacctggtgtgctttgtagtgtgccagtgctcttgagccaagcgtatggtttaagaaaatcagttaagggtataggccttgagcattgttgtagtggtgtggaaacagggaaagcctagaatatggaaaaggttggtatatggagttagctgtttaagacaaccatgaattggaggctttcacagatctagctgtgagtgaattgagtttgatctgtaaatctagtttttccataaaagtggagtatagttgtctccattgtaattcagttgtaatcaagtttgcattggtgagctagaactaaagtttttaaacttttagtttgtgacttttagctttcagttttttttgcaagggggtggcttaattttttgtttgtttgtttgtttgtttttgggagacagagtcttactctgtcacccaggctggagtgcagtggcgtgatcttggctcactgcaacctccacctcgcgggttcgagcaattctcctgcctcagcctcccgagtagctgggactaccggtgggtgccaccaggcccagctgatttttgtatttttagcagaggtgaggtttcaccatgttgaccgggatggtctcaatctcttgacctcgtgacccacccaccttggcctcccaaagtcctgagat

SEQ ID NO: 121738 - DNA, 2208 bp, Homo sapiens
cgctgctgggttgccgggcaggcgtcgcagtcactgcacggaagggtaaggggtggggacctgcacagcgcgccacgggtcacgtctcggccgggcgggcggccgggggtcgtcggcgcccggggagcgccaggggcggagagccatgtgtcacggcggagacggcggcgctggggggcggggagagcctgtggcctggcgccgccggtgcctcggtgttcaggggagagattgtgctgctgcagctttctgggggctccgaccgcggcttcgggttgatgttgggaaccagtgatggtcgtcttggtttgggattcgttgggttgccgttgaaggaagttgtaggacattggaaggcgcagagcacgtgtttctaatgggctcctggcggccgcagtggtgagactgccgctctgggtgcggagtcaggggcgggctttggggtgcggggttaaagggtggagaaattgggtggtgggaaggtggcttgtatgagcgctttgttcttcgctggctgttgttaccgatctataagcggcaggcgggaaaagcgcgcactttgggggtttatctttgagagagaggagcccagttttgctttctccacacacacctcattttccgaacgggcacagctgcatgtggcacgctggctcgtacccgtgctgattgggctctatttgtaatatggtttttcctagggagtgttagcaggtgagtcaggggtggtgctgaggaagaatatggtgaatcggtccttctgtgccctgtgctccaaatctggcttgtcaggcgatagtgactgtaaggcttttttaaagggaggtataggctagctggtgtagtaaatggtagagaaagtaaagatggggctctcatattgtcttgtattctttttgaagatcctagtttaattttgcttattgcgtttgaacagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcaggtaagaactaacacttgcaaaattacattatgaaatttttctattggatttctggctttgagctaaaatagcaactttttgtggtttccaataagtgtgggtactggagttttgcttgttgtgatagttggttaatttaagtttgaagtagaggttaagatgtatagagggagggaagaagagaaggttaggagctaaaggctggcttgcatgctggcctgatggataagtatatgatagtagcaacagctgctaaatgttgggaacaggccatgtgacttttttgagtatttttatagtaggattcttcttaaataacttggtaactgtagacttgttttcttgtctttctggtgcggctgttaactttttctggtggtatttgaaattgagtagaggttcagttgtcatgcttggtactttgttggttgattctaggattcgtaagtctgtatactgtaaaaataccgtagtgttcagagttatcagactttggagataaaagatgtaaaagaagttagctgattattgtaagtgtggttggtagggcatatttagttcaggattcagttcagagtggctgaagtgtgtgttttttttttttcaggtatagatgaggggagtagaagaattgtaaaggcacacatgtacctgtattgccaacatagtcttctctaaaaaatcttttctaaaaatattaaaagctgataacttttatttttttcagggctagttgcacatagtgatttagatgaaagagctattgaagctttaaaagaattcaatgaagacggtgcattggcagttcttcaacagtttaaagacagtgatctctctcatgttcaggtaatgttaatgtcaatgtgaaaattaaaaaatttgagtagttttgatactatctgctgaattttattagactcagatatggttattgttaaatattaatggaacatttttttgcagaacaaaagtgcctttttatgtggagtcatgaagacttacaggcagagagaaaaacaagggaccaaagtagcagattctagtaaaggaccagatgaggcaaaaattaaggtatgtctttctatactccctttagttttaaagtcatttt

SEQ ID NO: 121739 - DNA, 1073 bp, Homo sapiens
ttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaattactgtgagtgaatgtttcgggtttgtgcagggtacaatgtaagggtttttggatcagtgtaagagtggagagacaggaattagaagtaattgttactaagcaaatcatggaatatttagttttgatgtaactataattttgaaagcctggatgcttaagttgagaaatgggggaatgagatacagaaaataaggagcacaatagaataataatagcagtttattaagtatggtcatgagggaaggttactgataaaacaatctggtaaagacattcaggcttgctaaaatctaggaagaggtcatttggcaggatgggttacataatgct

SEQ ID NO: 121740 - DNA, 1432 bp, Homo sapiens
gggggcccactacagcccagcgccagccagccagccagcccagcttctcgaatcggtcctaagctgaggccgccctgcgctgcaaaacttgtgtccactctcggacccaatctgtcctggacggacttggctcgtggcaggcgaaagcgtcgtttccaactgcagctgtttgaattctggcgccacacccgcgccacgtagggccaagtcggccgccagactcgtaagagacgcttcgcagtgcgcctgcgggcgcgcgccgggaaatggccgggcgcgcggccggcctgcggcgcgctccacaacgcggaacgggcctcagaagagccaccgcgcgcgctcccgctaattcgcgaccacacccctgtctacttccatgtccaataggtgcgagagggcgggacggcctcgttctgactccgggaggctatataaggagctactggctgcgcacttcggtcttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatt

SEQ ID NO: 121741 - DNA, 1082 bp, Homo sapiens
agcagaggaagagagagaaggtaaaacccgcccatggaccgcaagcgtgagagccaaggcaggactatgaactgtcaaaattgtctctgacttctcaccaggccggagaggagggatctagtgcgtgaggtaccagatctcgtctcacttgactctcctcctcttcagcaccaagaacgcctgtcccctggaaacacattctctagggggtggaggcaacaaaggaaaagaacaattgggtcagagcagaatgaggttcaatcctcagtctggagaacggagcaaattcatgaaaagcatagtttaaaagaagtcagaatatgaacagaccagatgacttttaaaccacgaaaacatttctagaataagtgataactaactactctgtttcaccgtgatttagactctactacactctacagaaatcaccaacaatgacaacaggctatatatgaaagctattgaaaagaaagtaggtcaaggaaaaaaaaaacaccaataaggactccattaaaaatcataacggaggagaggaaattgatgctaaaataaaacaatattgtcgagaattattataaatatctacagcatttttttttcctaatgctacaaatagaggtagcattctgaaccacattttacttacaagctgaaaagaattaatacttggcacttgaacaaaagagtagaagaggtgctacaaaaatccaagagcttaaccctaaagttcttaataaaactaatattttttttaccgttagagcattagacaaaagacctatctctcttgcaactgaatagtctacagaaatttagaaacaatgatattgatgaggcacccagtcttttcatttactctgagtgaagtatatttttttagtacaaggatctaaaataaaaatacttcccattgtgggcagcgtcctcttcaaaagatttctagtaattaatggaaagtgttctacatactatgttgtccagaataaatgttttataacgcatcagtgatggtgatgtttttaaagcggcattatataaggtgaccaggcacagttaaaccccttatgaaaaacagtatcagt

SEQ ID NO: 121742 - DNA, 1629 bp, Homo sapiens
gtgtccttttggggcggtttttccagagtccgtttctcatttgctttcgcccttcgaggagtatgatttccactatcctttctgtcccgatcaccccctcacccctgtttcttggagtccttcctatttggcttcctgatgaagtgggagaagactgaggttcatgtggatctgtgctttgggtagtttcaaatcttttctttgcttgcccaagggcactgctcaccagtgactgcattctaaccagaatttggaatgttaataacactgtttgctagtgatgaaaatcatttcatccatggtgaaaatcggagagtttgggactacatttgcacttcattacgagccttacacttaggtttaaaatttcaaggtagtgttgctggctctggtgaagactttgatttgattgtcttgaggaggaaaaagaagacacaatttacacaggtcatatttagagttaacttgtgagtgtatcattacagagaattcgttttggaaaaatactgatcttaacgtagaacaatggttgaccattttagctgagtagattacattttcacttattttttagcttccaaatattgaaatattttctttattatgtcggggatacgtgatcacatacaaaagaatctccgttgctgtatgcactttattgtcacaaattatttgatggctgttcataatcttaaaaacaaaaactgtgagatcaagtggtgacgtctaggaggatgtgcaatgtgaaagctccctacttaggtaaataggtctggtgagtacctgtggcaaaattaaagtctcattcctttgaattttaatatttaaaaattgttgaaatttctcagtttctctactttgcagtacccactcattcttaattggtctttaaagatttattttagagataaaaaaatttctctaagatacccataataggaagtatttcatttgtaagtcgaatcagtttttatataataatcagtgaaaactattaaagtctagctttgctgaaagacattttcccctaatagtgtccactgatagttttaaggctaattactgtaaattctttttttgtcagcagtatttgtaagcaggattaataattctgggaaaatagaatctcatgcaagctggactcccccccgcttttttgtgagtgtgtgacgttgtaaagttatcacttaaagatttttatttatttatttatttttgagatatggagtcttgctctgtcacccgggctggagtgcagtggtgcgatctcagctcactgcagcctccatctcctgggttcaagcgattttcctgcctcagcttcccaagtaactgggactacaggcgtgcgccaccaagcccagctaatttttgtgtttttagtagagatgaggtttggggtttcactgtatgtcggccaggctggtctcgaactgctggtctcgaactgctgacctcaagtgatccacccacctctgtttcccaaagtgctgggattacaggtgtgagcaccgcgtcccgccagacttgagttttttaatgagtgaaacagcattttaaaaatcagaatgaaagtaatttcctatatcagtttcattaagtgattagtcttgccacataaattgttat

SEQ ID NO: 121743 - DNA, 2184 bp, Homo sapiens
ttacaggggtggaggtggctcacacctgtaatcccagcagtttgggaggccgagttgggcggatcgcttgagcctgagcagcatggcgtggccccttctctacaaaaaatacaaaaaacaaaacaaatcaaaaaaattagccaggcgctgtggcgagtgcctgtagtcccagctacttacgaggctgaggtgggaggatcatttgaacccgggaggcagaggttgcagtgagcagagatggtgcactgtgcacactccagcccgggtgacagagaaagatcctgtctcaaaaaaataaaaaataaaaataaaattgtatcttagcaattatcacctagcattttgatacgaagttgagtgaagcaatggttaacaattaaagaatttattggcgcaatctaaatatagtaccagggatactaggagctagaaattatgtcttagtttctaaccttgagattattatttaactttttctgtttaagcttttcctgtaaaactgggatagtcacacgcttcaagaaggcaaagatgaataaacgtttgtcaaagttaatgggcttcagaattaatattctgtcagtgttgatgctcagtgcttgtgtaacccttagttttgcatttactttaaaaaatgaattagtttacattctatgtaatttttatgagcaaaagttcagtttctggagaatgtggtgaaacccacagaaacaggagttgcttatgatccgtagtttatagatttttatttttgagtgaggtagaagattaatagattttttgaattctgagtagcagaatagaaacgaaaggcattaaatgtttttcttattaacagtgttgttttgctcattctggaaataagccacctgccccccctttgcttatttaaatgagaatttgcttaaagcttaagtgggaggagggaagagtaagtagaggatgggcatagtagagcgcccgtcataaattttaaatttttttatatattttattttatttttgagagatggggtcttgctacattgcccaggtatgatcatagcacactacaacctcaaactcttaggctcaagtgatcctcctgtctcagctttcttttctttctttttttttttttttttttttaaaaaagatgtagtttaactctgtcacccaggctggtgtgcaatggcgcaatctgggctcaccacaacctccgcctcttgggttcaagcaattctcctgcctcagcctcctgagtagctgggattacaggcatgtgccaccatgcccggctaattttgtatttttactagagacagggtttctccttgttggtcaggctggttccgcccctcttggcctcccaaagtgctgggattacaggcgtgagccaccacgcccggccctgtctcagccttctaagtagctgagacctcaggcatacaccaccatgcccagctcttaaatttccttgtatcttttcaaagttagctttaatatgggcaatataaccaactcattttcttaaaattgacttagaataagtatatagaataaccagaagtaatttcttgcatttacttgttttaggattattactgtatttattatacaaaaattggttataattggaaccttttagactagttaattgtattagactgggccagtagtcactcattcaacatttctattgaacatctactgtatacaggctaggcaaggatgatcatggtccctggcttcaaagagtttatagtctctggaggaaggtagacagataatcgtagtaaactatgatttatatattttatcactgaggtgagtacagtaaagagggaggttatttgggagttttaaaagaaacattccaacagaggagttgttctaaagagattttaaaataatagttcgttggaaaaattggccattgtaatagttgatttgttggagtatgatatttgctgacagcactatatactggactggccgactggttgattgtaactgttattgaccattgatcagtagtgatctggtggctgacagttgttttgaagggttgaattacagtcgtgtgtgtatgtgtatacatacgtacatgtgtttgtatatatatgtgtgtgtgtgtgtgtgtgtgtatatatatgcaaggacctaggtttagatgttacagaggatataagatacaggagactc

SEQ ID NO: 121744 - DNA, 1013 bp, Homo sapiens
tagaaatatgtgggatcaggtttttggatgttgctatgactagggatgtggtactggcatttagtgcccatgagcttcaatgctaagttttctgaagtgatcaggaccgtcccaacaaatgaaagcgtaattcctctaagtacccttttcagaaacattgaacagaaagaaaaatagtatatctagaagatttttttttttagtccttctactcttttcatattgagatagttaagctccagaaatatactttatttggaacaggtccaggtaaatgatattcaacaatatttaagtataatttatactgaccatgagaggtcaagaaactttctactttcttagcagaaattacaagcaattgcataaacagttagtaaaacaacttttgctaggttaaagagggtagcaaattcagcataattatcctgattaaagaaaagatttgacattttgatataataaattctgtacttttaagaaagcatttatatgcaaggacctaggtttagatgttataggagataaaagatacgggcaactagtgggatataaattagtaagataatatttaaatatcacttcaaaatgacagctgaaaagatgtcaaaaggcagtgtattaactaacaaattgttttgctttatttttatttttttgagacagggtctccactctgtcacccaggtgggagtgcagtgacacagtcacggctcactgcatccttgaccaactgggcttaagcgatcctcttgcctcagcctgagtagctgggaccacaggtgcacatcaacatgcctaactttaaaattttttgtggagacaagatctccctacattgcccaggttggtctcaaactcctgtgctcaagcagtcctcccaccttggtctcccaaagtgctgggactataggcgtgagccactgcacccagcctggttttgcttttttgttgtttgttttgttttgttttaaattgaaaatgtactaattgaaatggttttttaaaattca

SEQ ID NO: 121745 - DNA, 1645 bp, Homo sapiens
gatttcccagaaaaagactcagctagggacctggaagttcaggcagtgagttggaaaaaaggggcttgctgtctatagggagtatgtaaagttgacttattgccctgaaaagtaagatacttttccttgactgtgtccaaacacctctttttaaacttctttactgaggaagagtggcagtacctcgcttgggttttctaggtgtggagagtgaggaggaaatcagggaggcttaactcctaaaatagacttttcaaccagttatctcatttttagccccactttcacccccccctccccattttcagaggcatctagtgctcccagttcctgagccctttggtgattatgcagagttagtgggttttgtttgtttgtttgttcttgttgttgtttttacctaaagcctatttaggagtcacttttcttggagtgtcagtcttacatatgctttccagcttttaagattttatttctttttgttccattcccatgttcctattcttatggatttatgccactttaaaaaaaattactgtagtttcagtgaggtttggggagaggagagtaaggtgcaaagtgaatgtgtccagtctaccatttctacacaaaaccttaaaatacattttaataacttagaagttttaaagagtatttcacattcatcaaaggctcctcagcgggtttagaaggtcaaaactgtaagacattatttgccacctttcagtcgtgtacagtggagttttccaaagtttacatgatgtgtggtattgcagcaaattaagtgcataaactgataggagaaacctgctcttttctcttgtcaggcattgaagagatttgaaaaatgtaaaacaatgcctctcttttcacttttttcagaaaatgcatttttattaaaaatatcttatttatggtaatgtgatgggtttattgttattttaaacttgtttataagtaagtaaaagtctcagtttttgttttgaatatggtgaatgtcagtagttgtaactcacataaacaactctttgggatcctcagtaatttttaagagagtaaagagtcatgagatcaaaatgtttgagaacttctgttctagagaaccctagatgtaaattggaagtggaacatgaatgtaataatataaccataaccaacactccactagtcttatctttacataggacaataatgtaatttaatccccatgtttattaaatgtaacacccccgcggttttatttctcttttattttccctcgtggtaatccttagggcaactaaaggaagctatcagaagttaatctatactctttctccctaaagcatgtatgttctagactctgcttatttaaataatgagaaataaacttaagagccaaattgttaaagtgtgcatttttgttctcaaggggttaaaaattggctcttaaagaaaaaaatttttttttaaattgtttgttacatgtaaacagatacatagtttaatttgtggtatcaaaatatcattgaggatgatgaacaattaggaaaaaaagtcaaaagtctccttaagaggggacaataatgaaaaacaccgcaagaaacagtgtgttagagatcctttaacctcttacctatttcttctatcctaggcttgccccaga

SEQ ID NO: 121746 - DNA, 1032 bp, Homo sapiens
tgttaggggttctcacaaccccctcctcagggtcagtaatttgctagaataactcacagaactcaggaaaatgctatacttactattacaaggtattataaaggatacaaatgaacagccagatgaagaagtacctagggtgagatctgaaagggttccaagcaccagagcctgtctctgtggagttgggatgtgccaccttcccagcacatggatgtgttttccaactcagaagctcttagactactgttgtttaggaggtcttgtggagtacatagccatgattgatcagatcattggccattggtgattgggttcaatctctgcccctttacctcctgcaagactggggggtggggctacaagttccatctctctaatcatggcatggtctttgtagtgaccagtccctgtcttaaagctatctagaagctcctcagcctaatgttatctcattaacatgaaaaagacacttacgtagatttcaagggttttaggagctttgtgctaagaacctaggacaaagaccagttattttttattataccatacttgtatgcctgccagtggcacaaactgaattcaaagactggtcatgaatcttaacatcccttttgattgaatggttgcatcattgaattccaaattttcttgtataatctttcctagttcatgttggttcaaccaggaactaatcccaggttttaattgctctaatcaaaatcaccatgcaagagaatgttttcatttctagcagtccatagttctctgtcattgtcctctgaatcatctagctggtcaaaagattggagagtataaccatttcagatccataagaaatataagttcttctttatttgagggctgtttagaagaaagttaagaattcttctgtgtaggggtcaaaagaaaacttcccttcatcctctgaaggttcactgaaaatcacctgacaaacagcagattaataggagaaatggcatacagatttattaatgaaagggaggtggggaaatgtgggtgattttagag

SEQ ID NO: 121747 - DNA, 1116 bp, Homo sapiens
tgaaaaaggacacgtctttgctgaccatacatgatttattttgttgttcaatattgaattttctgctgcttctacgagaaatagaaaacagatattatttcaaattcttcactgcatgcctggtcaactgttacttgctcagatgtctttttaaaataacttttaaaacttactagggaatagaggagataactcttgccctatttaaaactagccttgatgaaattatgctgttgctggatgaattaatactaatcttttctcctacagagagctgccaaaaatatgactatgactttatttcatttaatattttaatcaatataaactactttttgtttttataaataaaaatctgtatttttcaaaatttttcaggaaaaaacagctgatgagtcaatgtatattttgatttacattttgaatactttttattattccttccaaaacagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattgtgagtagacctttgagtaaataaactagatttagctttaaaaatacatagacacacacacacacacacacacacacacacacacacacacacacacacaacattaaatctcaagtcttatagtttaattttaaatagattagttatggggagtctgcttatgatactagaattactggttttataatttcctttgaattttaataattattcctctccttaccaactttttgttttttagaagctgtgttgaacttttactgtgtctgcctgttgagttatcagataaacagtgggaacaatttcagacactggtgcaggtgagaatctttatctttagatttaatacaggtatatcttatgtcagttttccttactcttaaaaaaattattcagttaaactttaagacatctcaataatgacagacattaattactgatcttattgacactagtatcttacatagagtagatctcaacaaatgtttgctaaatgtatatatacattt

SEQ ID NO: 121748 - DNA, 2898 bp, Homo sapiens
acaatgaataaatgaaaaaatcatgcatttagttattttctttttgtaattcccttttattggaatatgcataagttgtcacttagttcgttatgcaaatctttttattaatggtagatttgggggaaaacttttttaaacacagaggatataaaatgtgtaaggtcttttatgcgtatggatattctgattgcttccttgaggaataactttactcctggcttagattttggggaagaaaaaatacagacttacttctgtaaatacattatatttatttaagatttgtaaatgatgtatttcttatccttgaaattcatctttaaatattagaaggaattgagtactttgtaatgtgatgtgaaatttttaagatgaaagtcttttcagaagtttagtgttatatttaaagcctgataagcttgcttttaaaaatctgttgtaattctttggatgtttatttaatatttataggtagctcatgaaaagctgatggagaatggcagctgtgaattgcattttttagctactctagctcaagagactggggtgtggaaaaacccggtactgtgcactattctttcccaggaaccattggataaggataaaggtaaattttcgagagacagagaaaaaaaagaataattagactagaaaaaataagtgttaaagttgttttgatataatttatctcaagatattccaaagaaggaccatttaattaaatatcttctgaggtgtgcttgaggccctgcgcctttattttattttggggaagatgaatttatacgattatagaatcatagattaacagataaactagaattttttcccaacatctttttaacagaggaattccttctgtaacttctgacaggtggcaatccagtttatatttgataatttatttgatagttgggagaaacagaaatagggtgctgaaatgcttttcctcaaaataaaataagaagtcagtactagaactctttaagtcttttgtctctaagattaaaatgctttctcagtttattgctcagtcttattgtatcccctgcgtttttcttttatgagctcagcctggtatcctattgaaagtagatggctaaattacttatatgtataacacttaatgttttttagagtttaaaatttatatagaccctgaagaaaagtacagttgtattctagatacttttcttgagattatttaggaaaatgtgcccaaatatcaccctaacctttcccaaggtatttaactaaagaagtaaatttttttaaaaaattgtaatatatctaatggaaaagcatgtatttaccactgtaagcttcttccgtcatttattgctgcttttcttgttgatcagtggcaaattctaggaagttttgctatgtgatagcaagttatgaaggccatgagaagggagtgttaagtctattgcttgtgagctcttctggtactttgatgtttacccaaagccttcccagccaatcttcaaacttctctttagattggttattcctactggatttctgtcttcaccattttctccatgctttcttgatcgttctagcagtgtacttgtttcttagttttcacaagaggtttatttttagtatcccctaccttcatggatatccaaaaattagctacagtgttctcgagaccttggaaggagatcctttcattacttaataatagtaatttatttatttacttatttattgagacagagtcttgccctgtggcccaggctagagtgcggtggtgcgatcatggctcaccgcagcctcacttccagactcaagtgatcctttcagcctcctgagtagctgggactgcagacacatgccaccacactcagctagtttttgtatttttattttttgtagagacagggtctccctgtgttacccaggctggtctcgaactcctgggctcaagccatcctcccacctcagcctttcatagtgttaggattacaggcatgactgaccacacccagcctaacaataaatttaaaagttgagaatcttagatttttttttttgccttgccatattaactttattcccaatagattaataccagtatgctttagttctagcaccaaattatactttctgatcttctcagcttttagaaatattagatgtgatatattagtaataatatcaaattacaagttcctcacagtttggaaagtgcttttatatgcatggttttatttaaccatcatagtgaatgctttgaaaaagataggatccttattgtccctgtttttcagatgagaaaatagaggttcagaaagatgagtatttttttcataccacattaccagtgatgagaggcagagccaggaattaaaatcagacctcagcctctccctattaatgccctgttgcatctagcctaataaaatagagttgcacctactctaaataaaggagtaactccttttcccattgtcagtttctgaacagcattttgccaaattcacatattatgctaaagcaggaaaaaggaacctttatcctagcagagatttcaactttatttgaaaagataatgtgcttgatttctttacttgtttgaatgtgcctaacattgtatctgttaaccaatgtctctgcccatctctgtgctgctttatttcttgaccttcatcttgtcatagccactggaataattaggactatgcagccaggggagttttctgcaaagtagatggattgtaggtagccaaactaatacaatacagctcatgaaacaaccagagagatgttacatgatggagagatttgcacccataatctagcctgcagcaagtttgaagagaataataagagcccagaaaatgagtatacctctataggttatactcattcgtttgtttatag

SEQ ID NO: 121749 - DNA, 1051 bp, Homo sapiens
gaaccactagaaggttttaaacagggaagacaatcaagtgtgtgctttaaagtaataccagaagcaccctggattctagtgaagtgatggaggtggtaagagtagatggagacgactagtagattgctacgaagtagtctgattagtgatttgggctgggttgggttgggttgggggagcaatatggaagtggagatgaagaagagttaatggaattgagtatttaggcattggaagtgacacaactaggtgatagattgatgtctgggtgaaaaggaggtaggagagagcatttttaaggcagactcctaggtttctgccttgagcacaactgaatagatggaaatgtggagatgacacgtaatgtggtgtagagatattgtatgctgagtttgagatgcttttgaaacagctagtcaaagatgctgcaaaggaaatcatgcaaatctgggcatgagaataggaacccagtaaatgagttgaccccactttagggggaatctaggacctagtgtaacctgtggtacatagtacacaattaattcttgtgtaattatttatcacagaaaatcaactcatattttgtatttaattatctttaatgtaggaattagtggtttccttttaatattatgaaagtgacatggcccggcgtgggggctcacacctgtaatcccagcactttgggaggctgaggtgggcggatcacgaggtcaggatatcaagaccatcctggcgaacacggtgaaaccccatctctactaaaagtacaaaaaaattagccgggcgtggtggcgggcgcctgtagtcccagctacttgggaggctgaggcaggagaatggcatgaacccgggaggcagagcttgcagtgagccgagattgcgccactgcactccaacctgggtgacagagagagactccgtcttaaaaaaaaaaaaaaagaaagtgacataggaagaaggctcttttacatttttaatcaaattggctaaatatcatttatttatattgccatgtgaagtagtgttatctatgtcacatagctttctt

SEQ ID NO: 121750 - DNA, 1711 bp, Homo sapiens
gaaatttgatacgtctaagctactcaaagataagtctgagaagcatgaaaacagtctttgttgcaatattgtaacattataaggaaaaacatcttggattgcagagaaatagaaagatgcagagaagtgggaaaaaaaagtagtgaagaagtagagggagagaagtgagctttcaataggactgaattgagtgtaaaccacttttgatccatttgaatcatgaacttcagaatatataattatcttcctttaaaggctgatgctacttcacaggtttttactgctgtaaggtgccattccaatgagaagtagacccagtagtcaaatagaaaaaaaaaaattctttttcttacctcacactgtataaagctagaagtcagaagactcattctactcctcgctatgtcattaactggctttatgtccctaggaagtcacttgccttctctgagcctcagtttactcatctgccaaatgatggaacagacaaaatgatctataaatttccttctactcaaatattctgtgtatttttgaaatccattttgccctaagtgtggcagtggtttcccatcattaagagacaaacaaaagcctatggctttgaaatttgcaatattaatattcttctacattgatttaatgcagaaattacacaatttgtcgttctaacttaaatgctgctatttgagaatgcagggcctatttgagattgggaccatcagttttgtgaaatacttcccacctttaagttatttcttcaccatgatcttttagagtgtgttgattgtgacttttttgtgagaatatttgcaataattcccagactttgtatctctagagtttcctttggagaaaattgttgaattaggaaactaaagctcttgatagccagaataactttattataactttgttttttagtcttatatttaaaatcttttgctttggcagtgaactaaactgtaactgcattgtaattgtcctaataggataatgcaatattaaaaaagaaaagtaatgccctttatctcataaagacatgtagtcagaggcaccagaaacatatgctttatttatctgtgcttaccctttatgccttttagtgtaatgtaaagaatagagggtagcaggtgaaaaggtctagacttcaagaaaaggattagatttgagatcttgtgttctatagcttatatgtttatggttttaataccaacgagccatgatcatagcattttatagaagaatcttttctatagtggagtacagttagatctaaaaatgaaagtactagagggaaacaaaggatattacaagaagtaaagaacatctctcattttctgtattctaacctgcaaattacttaccagatgtatctttcagtctgttaacaagcagagaagatactgtgttttattcatggagcattttaaatgttattactaaaagccttcccaaggtttcaggctagccattgtcaaataaatttttaaacatgatttctattctggtaaagaacacttaggaaaaacttaaacttgttaaaacttaaattctccttcataaatacaaaaaataaaaatattaattcttatttgtagatgaccaaacaagcactaggggatagtcagaggtttgaacaaagtagaaatgttttatgcataagtgactgttttgagtttattcattgatgttttaaaaataacgacat

SEQ ID NO: 121751 - DNA, 1027 bp, Homo sapiens
ttactcatcgtggaaggttgtaatgccctagcattacagattttagggatgctaactgctggtgttgaagaataactgctgtaggaaaaaaaattagtgtaattttaataacattgactattagcatttaacacagaactattttcatcatcaacaagtttattcagctcattctaaatggtcccttatataagggccaaaagtacttaacttttaaaagttagcaatataatctcttcttgcttataaggtcaagtcttttgtgatagccttactagcaataatagaaaattgaaaaaaagcattttagttcccgtgtttaaaaatatttcttataagtgttggtattgcaaatgaattattaccaaatgttaataatctattatgtcttgttttttaaagtgaatgaatttttagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagaggtgagtatgttttctttcattagtaattattttttaagttgagaaattaatttttaattagaatgtctttgatttccttttctcttagatagcgaagagatcattgtcaatcttacatttttggtatgttcttgagtggtggcaacttgattctaagtagcttttagaattatatgtaaactgattgcacctagtttctgttttaaataatatacatcttttaaatgctttggctaaattgtgggaaagatagtggtggcttaacagtttagtaaaatatctatatttgtcagcttttggccttaacttcaatcttgtctgacttcaagatacttgcacatcttttaaactggctaatttaagtaactttatagaatttttgtgacttatctctggaaatactttgtcatataaattctata

SEQ ID NO: 121752 - DNA, 2746 bp, Homo sapiens
ccctgcccttaaggttcatctgacctcccttccccttccacagatttgtattaagtgaatgattttttctgtataagcattgggggggattgggggaggtgggatttaaaggtgaataaggggtaggcccttcactaaagaagcgtatctcctgttaggaaactgactatctaagcatagagttgttgggttagctttgaagttgaagactgtgaatctgtgtctcaagtaaaaatctagtaaaaaaaaaaaaatctgtatttctagctctctgaataatccagtcttgcaatactgagcctaagttccttcttggtttaattatccagagttgagtaacaacagtccagcctactctgggagatgatcaggaaaattctgtgaagaccctgggtacttccagtgtcatatggaactatttccctcccccccacttctcatgttaagcaggtagaattaagacttttcatgttcataagcagggttcactaaggtttatatactccatcccaggaaaaaaactagatcatatagtgcagaacaggacagatagatgttaagtctacacttacatagcactacacatatatagtaacattactttgttaaaagtcccttgttacaaagtaacaacattactttgttaaaagtccttttttgcttagagatgattgctctttaatgtttctgttataaacacattagaaacttattcattgttccatatgaggtgagttaagatttattgtccccaacccagagacattgccccctttagaagaggtgtgcaccatgtgctctctcacttgcccaccctactctttgtccacttcattaatgtacgttacttgcctgtttcttacaagtatttgaggtttggttttgtttacgtgttccttaaaggacagtgggaacagactttgttagaaggagtcagcaatggcctggattggtggtgatctttctgaggaaatctttgtccaagtgaggcaagggattgactgtttcccaggaccctttcggtgtgatagaaatagcagctagttgataccccataggttgttttttttttttttttaaaaaagaaaagaaatagcagctagccttggtagatggcagaggaatggggctgggagagattaagtgtttatctggcctttctggaaggaatgaactttggtctggattcttggtatagtagtaaaaaattaagttagcagtgtctagtttagatccaatatttctatttgttttatcattaaaatatagaagtttaaaaactaaaactttctatcttgtatctctgtagctgtctcatttccctaattaatactccactaggtaattattattaagattaaaatttgatatataatctttctgacattcttctatgcacatacatgcatttttaatacttaaaatcgcatacacactccctggttgccggtcccttttccctctattattgtggacatgtttccatatcatttcatatagatcaaccttattctttctcatggctacataattccatagtatgcatttgtaatatctttaaccagattggtagacacttacttatattgttgccttttacatacatccgtgtatccttgtggggagtatactggtagggtaaatttctggaagtgaaattgctggatcaaagaatcaacacattttaaattgataggttcaaactatcctccagaaaagattatggcaatttatgtttccaaaaacagtgtgaaatatcttcttagagattattagtcttaaatatttgctagcccaagagttaattttgattaactcttgattttatattttcttagttatgacaggtttaacatttattttctatatggaaagcaatattattttgataagcaaatcaattttttaaactgtttgtttgtttgtttttttggagacagagtaagcttgctctgttgcccaggctggagtgcagtggtgtgatctcagctcatggtacctctgcctccggggttcaattaattttgcctcagcctcccaagtagctgggactacaggtgcacgccgccatgcctggctaattttttgtattttagttgagacagggtttcactgtgttgctcaggctggtctcaagctcctgagctcagacaatcctcctgtcttggcctcccaaagtgctaggattacacacgtgagccaccgcacccaactgaaactgtttttgaaatgtgattacagccaatactttttaaaagtatacttcgtaaattcatataaaatattgatagtgttctatattttttgaatagttggcataaagagccattttaaaacatacaaattattatttacatctttgaaataattgttatgctttacaaagggactttattcagcataatgtgtctttagcaaacagatcattctaattggttttaaatattttattaagagttctaaattttctggtatttaaatttttgctcatttgtcagagcaatagagaatagtccctatataggtaatatactggtaatctctgaattttgcttctttggatttttaaatcttgttcattggtggctatgtttcacttttcatgattttaattagtaatttactactttgtatatgacttccttattcctgcattctatttaatgtcatattttttcaagacagccatctagtggcaaataagagaaatgaaggatcccaagtacaccatgaaaattgtttcatt

SEQ ID NO: 121753 - DNA, 1136 bp, Homo sapiens
catcagagggagaccgtggaaagagagggagagggagacccgtggcggtgggtgggggagggggagggggttttattttttatttgattctgttttttaattttttattttttcttcagacagagttttgctcttgttgcccagcctggagtgcagtggcaccatctcagctcgctgcaacctccacctcccaggttcaagcaattctcctgcctcagcttccaagtagctgggattacaggcacctgctaccatgcctggctaattttgtatttttagtagagacagggtttcactatgttggtcaggctggtctcgaactcctgacctcacgtgatccaccccattggcttcccaaagtgctggaatttcaggcgtgagccaccgggcccagcctaagagtggcttaggttttagaagaacaacaaaaatgataagattaaaaataaatgagactttcaagaaatacggatttttattaaacccgaacaagtaaaaatctgtatttagcagcatatgaatatatggccttagtattcctgtgcaggtggaattctggaaagatcacagactatgaagctaaacttaggttgacatcttgactttgccactaagtgcataactttgagcaaagaacttaacgcttaggccttctttctttaaaagaagtattagcattggctgagcaccgtggctcatgcctgtaatcccagcactttgggaggccgaggcaggtggatcacgaggtcaggagatcgagaccatcctggttaacacagtgaaaccccatctctactaaaaatacaaaacattagctgggcgtggtggcacgcacctgtagtctcagctactcaggaggctaaggcaggagagtcgcttgaacctgggaggcggaggttgcagtgagctgagatggcaccactgtgccccagcctgagcaacagagcaagactccgtctcataaataaataaataaataaatatataaaataaagtggtggcatctaccaggcagcattgcatgagtgtcacagggtaattgtttaacgtaattttgaataaaatatattgtgatgaagtggaaagagcttggattttttttttttttttttttttgagaccgagtgctgctgtgt

SEQ ID NO: 121754 - DNA, 1949 bp, Homo sapiens
cttaggatgggcgtgttgggatgtagccccatcataagtcgcagaccatctgtatataaaatgttagtgataatacctacctagtgggaaagttacgattaataatatatataaaatgtctgacagtgtgtttaacatattgtagatatttttaaatctttactttataaatatatatccttcggtctttttttatttgcttaaatcaagttgcttataaagatttgttgaaaaagaggcagagagaggagtagtgggaacaacactgtaccaggtagcataagactagatttcagtcttaactcttccactaacttcataattcctgtgggtaatcatttatgttgaacacacgatttttttttcttgtcttagtgttttctaagaaggcccaatttaatgtgtaaaatagaacctgtgaacctattgccccacagcgtttatccttattatcaaagattgacctcaggattacccgcattctccatttacatgcttgttgaatcctaaacacattacattttacacatgcacattttgcttactcaatattttatgaaagagagaaaatcaactaggagaggcatagtctctgtggtacgtgagtgctaatggtctgttttgtcttcagttctttttgccatctgtcagttgtaccatattggaattaatctttctattctgtggaacactggtaatttgtgattgtatgctgtttgtcagatcccttgtcttatagcagatgcttgtagcaatcacaggtaaagtctgttcgttttatatagtacatcattgtaatgaggtaataaattttaatttttttaaaaagaaatcatagatgtaagtgcatcattaaatgaagcaagttgccttcatctaggttatacgtacacatgcatgactgttggcaagctttgagatggagtaaatttatatgaaaagaaaaatagtggagatttatagaaaattgaggtgagcttattttaaaagtggtacagttacataaaatgcttcatactatatttttccctcatgaatagatacgtagtttattagtctatacccagtgtacctctctgtgtgtctctgttgattctaatgcttgtttaaatcagtggataaaaggggaaaaaataaaagtactgcatttttttttcatgatcagatctgatttaatgggtagagattgcttatagttatcatcagttagttacatataaatgcttgtaaattcttaaatagttggttctccggtgtttcttaattttctcagaattactatataaatttctactggctataaagaaaggtttttttttttttttttaactgcagccagtctttgtcccagtaatgacaaattataactgacttgatagtgtatgaattaatggcattttattcataaaaactatctaaatatttaatgaaaactaaaggtatattgctctatattctaatataaaaccattttgtggcatatttctattggctttttctttagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttggtgagttgatctttttttttttaaagaaatatttgttaaataagaatgcaaaataggctgtgagaattcatataacttaggaacataatttaaaatctttttaagacaaaaggcttatatttagatattacatgctgtgcaaacttattatcgagtagttgttacaactcaaaactttgtgtattaaaggccacacaattccttagcatgcataccaggaattatctttggtcaggaaatttttaagtgttagaaagtgaaagaaagacttgttttgtctaatgccaccataacatttttttagatat

SEQ ID NO: 121755 - DNA, 1653 bp, Homo sapiens
gttggtttttacaaaggcatcaaaagctgagtttcatatgctaagcaaaagcagtccattataagctcttgaagggcaacatagaagtttatgtttaagaaacactgttgaagataagcagttgtgagttgattgatgactcagtagtgagggcagagttgggcaaagaagtagtagtacagagttcagacagaaaatcacctggaaagccagtaaatcaactgggaaattactgtggcacagattggtttcttctgggttttttgtcatcattggttcttatattcatctaataataataaccttattgtcaattttaaatttgttagaagataaaagagaaatgctgtttaaaaatcatgtcattgattttttttatatatatattatatatacacatgcacacacatatatacgtacacacacatatcttgagctttcttattacataaagttcacatgtggctcaaagtcatcatctgtaaaacttgtttaaatgttaaatgctggccgggcacagtggctcatgcctgtaatcccagcactgtgggtggccgaggtgggcggatcacctgaggtcaggagtttgagaccagcctggccaacatggtgaaaccccatctctactaaaaatacaaaaattaaccaggcatggcagtgcgcgcctgtaatcccagctactcaggaggctgaggcagaagaatcgcttgaacccgggaggcaaggttgcagtgagccgagattgcgtcactgcacttcagcctgggtgacagtgagactgtctcagaaaaaaaaaaatgttagatgctttcctagtagaaggtagtgcttctctgggactgaaaaatattaattaataaaatgataaatcatattctgattttatttggtatttagaaaattgggatctgttttcttgcattttaacttaagcatgcatataggattggaatataaaaccagttttaatttcaaatgtaatgactggactgatgtccatgattattaccttactgctccaacttttcttattataactttttttttttaagggaacttactctcttttggagtaaattacaacaaagagtagaaccatctatacaagtgtaccttgagaggtgtcgtcaactttctttgttaacgaaaacagtatatcacattttcttcctgattaaagttattaattcagaggtaagaataatcagaatatttttaaggttaaaatgtgtacattatcattaataaaagactataacttttatgattttggctcccttttcagtgatttttaaattttttcagttagtcctttgaacattttcttgttagtcctttaagatatttgatacagaaaaacttaaaaatgcagttgagaaccagggacttgttcttagccagaagaaaagtaatatgtaatacttaaattatatcattcttctgttttggttctaggggttatactactttgataatttggctatagaaatttaaaaagtaggctgggcgtggtggctcatgcctgtaatcccagcactttgggaggccaaggcaggcagatcacaaggtcaggagttcgagaccaacctggccaatatagtgaaaccctgtctctactaaaaatacaaaaattagccaggtgtggtggcgtgc

SEQ ID NO: 121756 - DNA, 3097 bp, Homo sapiens
ttttgtttcagttagattgcttatgcaaacaggaagtaagagttacaataaggatgacatttattgatcatttactatgtgccagacattatactaaactataacacatatttaatctcctttaatacagcagtttaatgaagtttaagtgctgttttgacctctgttttataagtgggatgggaaaggtcagaaaagtcaaataacttccaagtttgcctagccattaaataattccataccaaagtcttagcttctaatacttaaacattttctgcccttctatgcagttcattttacatacacacataccagactaagctgcagtgctttagaaggggaatcctttcataagttgctattgcaagatttgagtaaaacaaatctcaatcttaactaaattctgaaataaattagtgttgattagtgtagattaaattaacatttcctatttgctttttcacagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagaattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttct

SEQ ID NO: 121757 - DNA, 6445 bp, Homo sapiens
actaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaatacatgggttttctttttcctaaattaacaataatttaaataactgagtaattttaatattaaatttttgttaacaactgaatgtttccatacagttttcttagaaattgacctagctcttaaaggtgggcacttggcaaaactgccctatatagcacagtagcaagtaggtttatttctgatcattgtaactatgagccactgttaagtgaaaatgccaatgtattggggcttttcttttgctcattagcttaagaaaatttataactagacatttctaattgttttacatgtcatg

SEQ ID NO: 121758 - DNA, 1051 bp, Homo sapiens
agaagttttaaagaatgccaaatactgtttattttctagtttaattgaatgagctaaggaagtgaaagcaggtagttgttacttaggtaggtaggtaagtcgtggatggaacctggtccaagaacacaggttgggagtattaacattacaaagtaggaaggatacctcttagactaagtctgttaagtagaaatgttgagctccttgtcaggaaggaaagaaacaacattaccactcaacagcaagccttaggaaagtagaaaatgaagttttgaatggtgaaaatttgaaacaaaagataggaggaagagctgagtaggggatatgaaaggattaccaatcagctaataaatgctgtttctcacattcaatgcccaggtgatttaggaaagcataatattttagtagcaccctctgcatgattccatggtatacctgatagtgttcctcagttggatgaaagaaggaggtggttgtgtagtcctggtagaagtaatatgttgatgagttgagtctggatagggaaggaaacagccaagaggacacatgaaaagggagtggtcaaggaactggaggtcttaatggtgacaaagagggtatagtgggaataaggctaaaaatgaggtatggaagactgggacattgaaatttatgattttaggagtagtacagttcacagtgtctggaaatggccatacaattagattcctgaattcgatgtagattaactttggtccattttattggatggactgtacgcagaagatgcccttagtagaaaccagtgtgagaaatgctgaagtcctaaatttgctttagcagggccaggcctggtggatcatccctgtaattccagtgacttgggaggctgaggtgggacaatcgcttgagcccaggggttcaaggctgcagtggattatgatcccagggtaggtggcagaatgagaccctgtctcaaataaaaaataattgataaggagtgtacctacaggctgtgtggtacacgtaaggagtttgggaaagcagcttcttgagagtattgtcttgggag

SEQ ID NO: 121759 - DNA, 1011 bp, Homo sapiens
gcactcgggaaaatatttatattgaagaacctgtttccttgtaagatccaaccatactgtatctaaagataatctgtttgaaactcctgttttatttccctatgaaaactatctttgaattgtgattaggctcccaaagcagtgaacaaaatcttacttagcatataatgtagttaaagtagcaggctggagtcacctggtgtccttctggttcttaacctggagttgtcaaagtatggctctggaaagcctaaaatatttgtttctggccctttgcagaaaaatttgctgatccctgtttaaccttgagcctaaagatttgaatggaggtgaaggggaactgggggacaataggtgggaggtgggtgaggaaagtagaaatagtttgatccttgggtgatggcagtacccgagcaggtctgggaataaggaagtatgagggagacttggtacccactgcttatggttttaccaaaggtcttggacaggctctggtgcctgagagatggctgctgctcagatatacttgcaggcaattcttaaattaagtgtttatatgtttcctgcatttctagttttatagaggtgtgttcttaatattcttttcctgtgttatgaattattgttttgtataatgcaatgaaatgagtggctagttgtaagttcttattgtgaaaaagttttatattaagccccactcatttctcaattattattttctttctgctgcctttaaatctagaatatacattgctgcagttggtttcatgctttgcatccacaagtttgtaatcataaaaatatttaaaatatgtgctggggccaggcgtggtggctaatgcctgtaatcccagcagtttgggaggccgaggtgggtggatcacctgaggtcaggagttcgagaccagcctggccaacatggtgaaacctcttccctactaaaaatacaaaaattagctgggtgtagtggcgggtgcctgtaatcccagctgctcaggaggctaaggcagg

SEQ ID NO: 121760 - DNA, 1027 bp, Homo sapiens
taatggccgggcacggtggctcacacctgtaatcccagaactttgggaggccgaggcgggtggtggatcacgaggtctggagatcaagaccatcatggccaacatagtgaaacctcatctctactaaaaatacaaaaaattagctgggtgtggtggcatgtgcctatagtcccagctacgcgggaggctgaggcaggagaatcgcttgaacctgggcggcggagattgcagtgagctgagatcacgtcactgcactccagcctagacgaaagagcgagactccatctcaaaaaaaaaaaaaaaattgataatatgataaagagttaataaaaactctttttaccataaaagattctgtgcttttcattatcattaactccacttacctggtacactgctgcatccagattgctaagagctaggaaagccatgttgttctgaacagcatacactaacgatggcacacttaacttcaacagttccttggggctccccaagacattttctcttaaagatgctttgaatctacccagactaccagtttctctttgaaaacaaaagggggagatgagagggtggtaaggaagaaaattaaagagtattattttaataagacttcttcaaacacaggacaagcatactatgcttgctgtaatttagcaaactaataatttctaactagttttagattaaaagaaacataccaataatgtatcctctttaaaaaattatagttctgtttgggaaaatatgacaacaactagatttaccactatctctagtcaaagctctgagagattctgagtatattgaataatgagattaggaaaactgttgatattacctataaaaaaattcatcccctgctactttaactatttcatcaagttcaccctgattactttttaattgatcagtttgcatatccatttttatttttatatttatttttgagatggagtcttgttgtgtcgccccggctggagtgcagtggcgctatctcagctcactgcaacctccacctccc

SEQ ID NO: 121761 - DNA, 1036 bp, Homo sapiens
aaattggggagtcttaagaggcagcactgtatcctgtaggtgatgaggaataaataagttaaattgttatcattttcaggattgatgctataagctcttaaattagagtgataatagaaattaaaattaagtagtatgctgacttggcctgttcaaaagttcatgctagagtgcttattggtattaggaaacagtgggcacatattatattaagcatatactatggctgtgatttgagggacacatttttcacttaagccaagtgccctggttaatttctggaatggtctttttgtttagttgtcttattctgtagaatagctgtgtctgatgtggaatatacttttagtaagactgtaacaggtttttgtatttatttgtttggactcttggatgaactctgtttattagtcactaaaaataactttaacaattaatattgcaggtggaacaaaatccattattagggtttggcgctatagctattgctgtattgtgctcaggatttgcaggtaaatcatgaaagcattgttttattcttttgtcatatttttcgaaaacatcaaactttagacaccagtctagtttatcttgctttctcagttttattcccattaaacttgatcttcttgcttatatttagttttatgtcagctgtttttccagtaaatgtatagcattgttcaactaagttcagactcagtccctattcatacttgcagttaactacttctgttatccttgaccatctcagtccggccaaaaacccaaaagtaaatgaaaaaagacttctgaaaatggaggaaattagtcttcagaaagccctttccttttttctggaactgccactatcaagtcagatcctgctgctttaggttgttaatgttaccagctaagtatctttttttcccctataacctcaagttctttctctgctttaacaggttaggagctatggagtaggatcatgaggtgggtcgagagtaccttagaaaacataatacataaagctaataaccaaacagggaggaaagac

SEQ ID NO: 121762 - DNA, 1070 bp, Homo sapiens
ttctgggagaagcatttatccagtgctcagttaccgtaaacacagagagatattaaaccaccctccatttcctcaattgtgtattaagagagtgaactaataaaatgttggacataatcatttaactgttcaaaatattgcaaaaaatcaaatagcatattttttaggtaactcaatttttgttcccaatttgttggtttctagaacacaatgctatcagtaagtatattcctgaatttaaattttcccctcgtataaaacatcttatttacaagcagtattttacttctgtattcagcctgctttcctagtcaaaaatagtcctgacttgaaataggtacaaataaataataaagatgtatagctataactaatatattctactaaaagctttaagcagaatatattaaaaactaaatctctgctggaactatttctaaaactttttttatgttacacttaatattcatactttcttatcttgatgcattggaggagtgcttgtccctacacatacaacgccagacttccgtggattgttgatgttagtgattttgtgttgtctttcctccctgtttggttattagctttatgtattatgttttctaaggtactctcgacccacctcatgatcctactccatagctcctaacctgttaaagcagagaaagaacttgaggttataggggaaaaaaagatacttagctggtaacattaacaacctaaagcagcaggatctgacttgatagtggcagttccagaaaaaaggaaagggctttctgaagactaatttcctccattttcagaagtcttttttcatttacttttgggtttttggccggactgagatggtcaaggataacagaagtagttaactgcaagtatgaatagggactgagtctgaacttagttgaacaatgctatacatttactggaaaaacagctgacataaaactaaatataagcaagaagatcaagtttaatgggaataaaactgagaaagcaagataaactagactggtgtctaaagtttgatgttttcgaaaaatatgacaaaagaataaaacaat

SEQ ID NO: 121763 - DNA, 1055 bp, Homo sapiens
gcctcccaggtccaagcaattctccttcctcagcctctcgagtagccgggaggagcatgcgccaccgtgcccagccaattttgtatttttagtagagacaggatttctccacgttggtcaggctggtccccaacctcaggttatcacccgcctcagcctcccaaagtgctgggattacagacatgagccaccatgcccggcaccttttttcattttaatcttaaaaatcaggatgcaagaaaccaaatcataacttgtcctaacttgacaaataaatatatttatatgacatcaagctttattttagttcactcctaactaaaaaagaccagctttgccttcaaaaaaggagaaggtaggataaaaacttgtatctaaacagttaactgaaagattgctaagacatgctagttgaccatcagtaagaacattaaacaaaagcattttctactgttcctatatatttcttatgagcaatggtataaggattttgttgaacataaagatagatcagaattacagctaaaagttcacccaaatcaggtagaaaaacatctaagggaaagcctataagtacctgatactgaaatggtaagtggttggtaagtagtgtcaaacactactctaagcacttcacctgaaaacaccactaggcaataggtgatattattcccattttacagatgaagaaagtgtcacccagggaatataacttccccaaggctgcacagttaagaaatggtacaggcaagatttgccacagactatacatggttttctaaaatttctacaacactatttccatttatatacaggagtcaattttaaaatgaaatgtaaatataagccaggtctcttttacttaatatatttaacagatattcttcatacattggtttatattataataattgatcagtaaagaaaattattacactataaaagcaccctgaaatgttaagtcaatatcattgcttaaataatttagaagccaaattaatgctgggtgtgagagttgggaaaattatattaggactaacaaagcagtggtactg

SEQ ID NO: 121764 - DNA, 2239 bp, Homo sapiens
gactcctgtatataaatggaaatagtgttgtagaaattttagaaaaccatgtatagtctgtggcaaatcttgcctgtaccatttcttaactgtgcagccttggggaagttatattccctgggtgacactttcttcatctgtaaaatgggaataatatcacctattgcctagtggtgttttcaggtgaagtgcttagagtagtgtttgacactacttaccaaccacttaccatttcagtatcaggtacttataggctttcccttagatgtttttctacctgatttgggtgaacttttagctgtaattctgatctatctttatgttcaacaaaatccttataccattgctcataagaaatatataggaacagtagaaaatgcttttgtttaatgttcttactgatggtcaactagcatgtcttagcaatctttcagttaactgtttagatacaagtttttatcctaccttctccttttttgaaggcaaagctggtcttttttagttaggagtgaactaaaataaagcttgatgtcatataaatatatttatttgtcaagttaggacaagttatgatttggtttcttgcatcctgatttttaagattaaaatgaaaaaaggtgccgggcatggtggctcatgtctgtaatcccagcactttgggaggctgaggcgggtgataacctgaggttggggaccagcctgaccaacgtggagaaatcctgtctctactaaaaatacaaaattggctgggcacggtggcgcatgctcctcccggctactcgagaggctgaggaaggagaattgcttggacctgggaggcagaggttgcggtgagccgagattgcgccattgcactccagcctgggcaacaaaagcgaaactccgtctcaaaaaaaaaaaagatgaaaaaagggttaagactagtaggaaatgtagttttattcagtaaattatcgcctcatctccgattaagaaattatcaatggtttgaatgattggtcacctgtcttttactctaaactttcacaggttcctggttgtcacggaaaagccaatcctaccacattttcttttgtacttatatatatttatacttacatttaaaaaaaattatatattttatagggaaattagttatgttctttgtcagagtggtcagatagtgtcagttaggcatactcatgttctaaaaagtctgtaatcagtgatcaacaaaacactgccttgattttacccgccctgcctccccctctccttttttttggctgtaatggaagacctttctaaaccttgccatcataaaaatatgatctgatagtgtaaacccacaattaagagttttcaaaattttaaactgatcattaggcattttaaagacacacatacagataaagctatttttttttttcttttcagcactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttt

SEQ ID NO: 121765 - DNA, 1937 bp, Homo sapiens
agttacaggataataatatggcattttgaaaaataacagaagaaatgccagtttagtcttaaataggtattcttaccctggggatctgtggatttagttggaaagaaaaaattatactttgttttccctgacctctctcggaaattgagtattttcctccattactatatcacaaattaatttttggctatttggttatttcagagtaattcttttctttgtaaccctgtgtattttattttatgaatttagaaacattttgagaaggggtctatatgcttcaccaggggcccatggcaaaaaagaaaaagttacactctgtaatgtacccaacttggaaaattttaaatgagaattctcagaatgtgctttttttgctttctttccgtgttagagataacaatgacctgttatgtacttcatttaatgtactattgtacttttaggtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaaggtattggttgaccctcccttctgctttcccatgatgcagtgcagctctcggctgttacctgcatagtaaagttgcgtgttaagcttgtgttttaaaaatagatttgtaggtgaatttaaaattaagactcaaattttttttttgggctgaaagaactgcaaaataatcctgaagcagtgtcaggtgatattctcatacttcatttttatctgacttttctgttctagcattccttcactttttcatatttattttttgttctttcacttccttaggctggtatgtgatggttaataaactgattcatttaataaacatttggtgggtaggggataatacacaacagcgaatagaagaggaaaacccttgttctcgcagaccttatattctagcctagagacagcacaaactaaacaaattaaagataaagcaagaaacaactatgtttttattaagtggttctagatgctagctggggagatcaggtatggagtcttcaggtggaacgacagttttgtaaagaagcccgtgtgactggagtaagtaagcaagatgaacgacaggagaaggttgaagagctagtagcatatggggcatgattctaggatttctctagggctgtccagtgctttttgtggtaatgggaatcttctgtatctgtggccgtctccttaagtagccaccaaccacatgtggcttgaagggtgaatagtgtgacagaagagctaaattctcaattttgcttaattccagtttaacagtatagattgtcacttgggcctagtgattactgtattgcacagcacagtaccattgtgaggacttgactggtatagtggaaactattaggaggtttgagaagaggagtgatttttttttttttttaaacaaaaataatgaggtcctcgccatcttgcccaggctgggcttgaactcctgggcgcaagtgatcctcctgcctcagcctcccaaagtgctgggattatgggcatgagccaccacactcagcccttgatttaatttttattgtgttcatgtgtgtgacaggtggtagagcatccttaattttgccttagggtaagaataggagattcaattaacatttctttgtctttttgtttctgaactcttttagcgtctgggagtatattttgatgaatattcaggagaatcattttatcgtgaaaaatctcaagaggtcttaaagttgctggagagtaaaggactcctactgaaaacaatgtatgatcaggttactattcttcagtaaaattatttgttctttgaaattgttattgatgtatcctttgagtaaggacaacagaatgcaat

SEQ ID NO: 121766 - DNA, 1054 bp, Homo sapiens
cactggcaaaagttcattagataccctgtgtccaaggtttttattgagagttggtcatgtaggtaccctctgcttagaatgtcctaaatcccaaactcccagaaggaaagcagaagttcagcctaagctgtactgtttgcatccacagtgtaggcacaatgaccacttttatcagttaagttggtggagacattcccaaaaatctaagttaatagatgccagccagtggccaaccttgcaagcaggatgttttaaatataacagtatcagacctgctagttaactcttttctagggggaaaaaaaaaggtaattttaactttatttagcagtatttatttatttaagtctgtcattccagtaattaacatagatcatctatgaaaggtgaaacgtttttaccttgagagatgtttaatgccctgtcccatttgttggtagtatctagtgggtataagccaatgtgtcctccagcaataaaatcattttttcctatccaaatactgctgtccggatgttttgataataacattgtaagggtttagaagccttattttttcatagtttattcaccaatttttattgctttcatgagactttaatagctttctggaaataatatagtaaagttatcattgatgtttcaacctgcaggtgagttacaatttgtaaatatttgtccatatgtataacttcagtactacttgaactataatattaatattttaatgtcatttattaacattatattttggagactgaaaaatgattgaaactacattgggaacacagattcctagagctggaagagtaagcctgagcccttaataaaccatcaactccaccctagttcttggctgagtatggaactaaaccagctaagacaggtgatgcaaaataaaactccagaagaggtgctcaacacagtttttaggatcttaagtttagagtataattatactaactatccaaaagcagtcctttttaccaagatcacctattgtattggtctttacacagtaagctatttagagaacagttttaaaatctttgat

SEQ ID NO: 121767 - DNA, 1050 bp, Homo sapiens
agggtttatttgcaaaaaactaaatccattcttagtaaaggcagaagaggatttattgtagaatattgaatggtttacaaagttgttggagggctgcagaagctttggattaagctgacataaataactcccaaaactgcactatggaaccttgtcatcaagggagctcctgcctcttctgcaatcccttgcactgctctagaaccatgctgccactgccatggtcaagaaaatgccactactcctgccatgccatctagaattcatacaggcataagaggcagccccatatactttcaatttctttggtggccatcatggaatactaggacctctgttcatggtgtcacaaaaaaacacagcccccaccactgtgcttgtcataaaaaaatagaagtagctcaccttccaaatcttacagacactgtatctgattgcccaaacctagaagactactggaactctaaccacaggagactctgggaattgtactttttacattttcagcctcggcagtagatgagggcacccaagaaggaaagcagaatagatgttgagtgtgaaaccagcatcagcagtatgggaaagtgaaggccttagattattacatgctgttagggagcaggcatgcagagggtagatgttagtgattaaaaggagatagaatgagctatttagaaaacacaaaaagggaaaatacaacagtgaggcttcggttcttagggcacagacaaatatatttcttgttaattactgggattttttttttttctcttcttgaaattgactagaatagcagttactctaacatgtcctcaaatcctattaataatgtaggtgaaagttctgttactgtgaaaatgtgagattctttggaataactgccctacaagtaatttcttactccctttccataacacatgaaaacacaatgatgaatgttttagtaaaaaacattgagttggtaaatttagtgaaaagaattttctacttatgtttgataatagagaagtacatggttcttatgtcaaaaaatggataacaagaatg

SEQ ID NO: 121768 - DNA, 1051 bp, Homo sapiens
gggaacactaagaactaatactttcattgtacagccgacagattgacaaccctaggaaattatcagagatgttgcatttgtcttcctaaagctgaagaacagtcttgatggactgtttttctacttagaaagatagaacttgctaagagccttttgtcttattaagtatttatgtctgtggaagatttttaaaaattgatatgggaagtattatctcatgtttactaactcattattgcagtttaatagcttttaaacttagttatgattagctcctggacaatcagagaaagagcgggttttatgcatgtgtaccgtctgccactcacttgtcttcttaaagaaggcagaccctctaagagcaaactcatgaatttgtaataaggaccaattactgattaagcttctactcctatggagtagacacatattatgaatgactctaaaactgccagtacaccacaattatgatttttaaagttgagtttaaatatttgttgcatcacaaagagtagagggattcctacagtcatcttcacactagagaggaactacactaaggccatctcctaaggaaatttgcctgctttatctccacttgaataagaaaccactgcaaaccttagtgtagggattgttaaacctaagcccataggcaacatccagtttgccgcttgtttttgcaaataaagttttgttggaacacagccatgcacatttgtttacatcatctacattggctgctttcatattgcaatggcagttgaacacagtagagctgagttgaatagttgcgacagatcagatggcccaaaagcctattaaaatatttactctctggctcttcaagaaaaaaaaatgccagcttctgattagtgttttaaaacaacatccattttggtacttatgacaccatggattaggaaatggggagagaggggtatttcaggccagtggttcttctacttgcctgaggtcacttatgtaactgcggtcatctagagactagtggggctacaaatcaaaaatggctctttacttctctagccag

SEQ ID NO: 121769 - DNA, 1087 bp, Homo sapiens
taaattgttagtgtaattccctcagaaaaggcagataatgttggacaaggttattaacatacatccacagagtcagtgtctgggaactcaaaagaattggaacaatgaaagtcactatcatagaaaaagatgcttatttaaagggtgactatgataaaggagcattggtagcttagtaaatatttatttgatcagaaaatcactcccagatatttaccaggaatagaattattcaaaatacagtatttagttccttttccccatttcttgtaagttcttaaaaataaagactagttgctctttagtgacagcagatatctcttcaagttccataggtttttcatgagatggcttcgaacatctaataggttaaaaagtgaaggcatatgcatagaagacagactatctaaattacatcttatctgttggtgcaggtgctttagcgtagaccctgacagaatgtcatgttctgtggctctcatgaaagctaggtgagataaaaagtgttcatcgtatgtcagagtaggtagaatatgggtagagtgatttttcttacttgttacaaggtgaatttgaggggagggaaagagaatgaggaagagagagactgaatacagaatagcatgttagttgggaaaaaaagaaaatgtgtttacttaaatagaagtatggaactaaagagattgcctgagaactgggacccgatatagggaccatgaaagatgacttacttgtgtctttgtaagccaaaaatagcattagaactacctatctcattaggcctattatataacatacctactttgtgtgatttgttcttttcagctaagatgtgatacagtggtgagtgaaatcagtactggtcaaaggactgtaaatttcaaaataaacagagagctcttaacaaaggtaagaataagttaatatccagccattgtgctttcattctgtctgcttcagccacagtggtcttcctccagtttttaaattctttatgcctcctctggcctcaaaacctttgcacatactgatccataacttggagagtaccaccccaagttaacacctactcatcctttaaatcttg

SEQ ID NO: 121770 - DNA, 1125 bp, Homo sapiens
ttgaatctggcttccttcacttggaatgcatttggagctcattcgtgttaagtgtattaatagtttattcttacaagtggtattccattgaatggaacaaatatgtgaacaatcttacactgttttgttctttttgatttttagctttccagagtgttgaatcttccaccagaaaacttgatcacatcaatatctgcagttccaatttcccaaaaagagttaagtataatacacttgtaacaatctataaaatgttgctgactttgttgatacaccaaaaaagcaaaaaagaattgttactcttcagtttgtggaatagtccttgaaattaactgtaagatatgattcattatactcagcctattactcctgttgacttaaataataaaattaaaatctgtattttaaatactctgatatggcagattgtgtattcttatgttcattattttagttatgctagtaactataattgtggcaaagtctttgggaatgaggttcaaattcaattctgtaacaataaataaaataactaaaattgtggttagaatctcagggtttttgaagggatattaaagattgtacagccatctggtgcttgaatactgttgtaccatatttatctactaggtttttaatgttgtttttgtttattgagtttccttttgagtactcccagtgatagaaaactgttggttaggactacacacaactaatagttgctttctcagttacagagaggtatctctttgtgagtttggtcatcctaaatgattcttgtttacgatttgggtagaaaacttcaatacttggatagattattgtctgtcaattaataatgacaagaaattagctacatagtagtcatttaagtcctaagctttgaaaagaagttaagatataattaccagtaccattctgtccttgtattttattcacttaactttgtcaggactttaagagtagaatgaatattcttctcagaatagaacaaagaagtaagtggaaaagaaagagaaaggctacatttggccttctagtaaaagcacctttaaaatggcccactgcggctttttatattgactttctgtaagagaggcagccactaccaagaggatctcatga

SEQ ID NO: 121771 - DNA, 1829 bp, Homo sapiens
aaagtgctgggattacaggcgtgagtcaccatgcctggccacacatttctttaatgttgcagattgctcaacttactagaaataggtcagagaaaattaaagacttgttcccccattatcattagggacacatagcatgcagtgacatctaatatcatcaccaatgtaattataactaatacagttgttaatatttcttggatgtttacagtgtgccagactgttttgtttttcaagacaagatctcactctgtcacccaggctggagtgcagtggcacaatcatagtccactgcaaacttgagctcctgggctccgggaatcctcctgccttagcctcagctaggactacaggctcatgtcaccttgcttgctaatttatttattttttttttaaggtgagatctcactttgttgtccaggctggtctcaaatcctgagctcaagcagtccacctgccttggcctcccaaagcgctgggattatagacccagactgtttcaatcattttatatgtgttaatttgattaatcccctcagcaaactacaaggaatgtattatcgccattgaaatatataaggatacttagacatataactttctcaatgttataatgttagtaaatgatagagctaggatttgaacccaacctgtctgattccagagctcatgatttaaccatagcttaatactgcctctcattatataaggccaagtttctatttagaactttttgtattgaatttaagctacaacttattaggattggtttatagtttttagtactagtaaacctgatgtgtataattgtatgatttgaattttgctttagaagtttgctaggcttttttttttttttcattatgtggctctaagaccaacgggtagtgttataatacgaaaatctttgaggaattgaccctgattataaggcagatggagcaggaatgagggaaacatacccagactttaacatttgccttcactggcttcagttgttgaaacagattgactgaagaagtaggaagatgctctgcattttgcccaccatctgtcccctgactgaagacacttgggcacgtaattaagactggtaactctccctctcctcagtattctgtggatgactgcatatccagcaaaacaactggataggaactggagagagagagactggcagcagcactggcactgtaggagatacccacactgaagtatagcactgtgaataggagccgaggcaggtagaaacctggcaacagtgagagcttatattcttcagtgtagtttttaaatttacctacctgatctgtaacagactgagagaagtcatggtaacagtttaaagtatcctactgctgtgtttcccagtttctaagaggtttttcatgtgtattttgatgcggcattattctgcacataaaaattgtgtcttgatttgccactttcatgttatgctatgattttacctattaatgtaaagtgactatttttgttctttttaaagctaccttgttgttctgctttgtctcttttttttattatttatttatttatttatttatttattttgaggcaaggttttgctctgtcgcccaggctggagtgtagtggcacaatttcagctcactgcaacctctgcctcccaggttcaggtgattctcctgcctcagcctcctgagtacctgggactacaggtgtatgccaccacgcccggctaatttttgtatttttagcagagatggggtttcaccatgttggccagggtggtctccaagtcctgagctaatgaaccgcccaccttggcctcccaaagcgctgggattaca

SEQ ID NO: 121772 - DNA, 1052 bp, Homo sapiens
tcttaaatatgccataaatatggtaaaaataaaagattataaaaaatgaaatacagaggatattgaatgttacctgtccccaaatatatgtttttgatgaatgtaaaaaaaattaaggccaggcaaggtggctcacacttgtaatcccagtactttgggaggccaaggtgggcagatcacttgaggtcaggagtttgagaccagcctggccaacatggtgaaaccccatctctactaaaaatacaaaattgagcgggcgtggtggcacgtgcctgtagtcacagccactcgggaggctgaggcaggagagaatcacttgaacctgggaggcggagatcgcactgagccaacatcatgccactgcactccagcctgggtgacagagtgagactccatatcaaaaaaaaaaaaaatttcacttctgtcacttactgtgtaactttgcacgtaagatctataacttatactattatatgaaaaaagaaactgacttatttctttctgtttttagaggactattttaacaaagggaaaaatgagcctgaggacagtaagcttcgattcgaaacttatcagttgatatggcagcagatgaaatctgaaaatgaggtgaatactttttttaataattttctgtaacaccctaagtctcatttttgttgcatctcatcttcctttccaccagtttacaagagtattgatgaaatataggaagtattggtcaagcatagcctgtatatccttaaaaaaacaaccataatccagcctgggcaacttggtgaaaccctgtctctacaaaagctacaaaaactagctgggcatggtggtgtgcacttgtaattccagctactcaggaggctaagttgggaggataacttgagcctgggaggtggaggttgcagtgagccgagatagtaccacggcactccagcctgggcagcagagagagatcttgtctcaaaaacaaaaacaaaaaaaactcatatttcttgtgagtggaacagatgtttatgatagctgttaaggcaaggagctttcaaatggtgacgctc

SEQ ID NO: 121773 - DNA, 1992 bp, Homo sapiens
accagcctggccaacgtggtgaaaccctgtctctattaaaactacaaaaattagccggtgtggtggcacatgcctgtaattccagctactcaggaggctgaggcaggagaatcacctgaacttgggaggtgaaggatgcagtgagctgagattgagctgctgcactccagcctggatgacagagcgagattctgtctcaaaaaaaaaaaaaagaagctttcaagtgcacatcccagtaatttgtttgaaagaggaattgtgcaaaatatctttcctgacaaatatagtttatgcctttggatagctattgttaatggatatcatttatatagtatatttccttggtttctgttattaatcattttttaaatgtttttacttgtttgcttgatatgttaaatagcttttgtcattaaattattattaataaaaatggtgatgtaatattgatgtattatctcataggtgtgaatgtcacagatcatgatttgacattcggaagtctaacagaggcccttcagaataatgtcacaccatatgtagtctcattgcaagctaaagattgtccaggtaaaaatataaatgccataataaccttgatgagatgttacagacttctttcatccttttctctctttttcaggctttctttatccctttttttggtggaaagaacacagtgctatgttttaggcagggtgaggtttgggggctctcagagtaattgtgactattacagaactctgccttcttttgctgtctttgttcttgacccatttctgccctatcagcttaactgccggtagcagtccaggcattttgtgagatgcattctttaacccagtgaaacgtttaataagtagaaagacttaggacagaaagctgagaattggggaatgaggagctcttgtcagctcaaaagagagtagaccacatgggctcatgtttcagccataaatcatcttattgtcccactttgaaaagccaccatggtgaaaaatagtccactgacagaggtaatcctgagcatgtgaacccatgaaatcataaagagtgttcacactaatatattaaaaagctttttttttttttcttttgagacagggtctcactctgttgcctaggctgtactacagtagcatgatcatagctcagtgcagcttgaactcctggcctcaagcagttctcccacttcagcttccccagtacctaggactacaggtgcatgccattacgctcagctacatcagctacattgtggggttttgttgttgttgttgtttgtagagattgggtcttgctgtgttgtccagactggtcttgaactcctgggctcaaacaatcctcctgccttggcttcccaaagtgctgggattacatcttgagtcaccatgcctggccctaatgtggtaaaatttgtttggattagattgataaaagagatttatgtgcttatattgctttcatattcataaactgattgaaattaagtaaaagcccttaaaggcatctttaaaaatggctatatgaaagatttataatcagtaaaataattcatatgacacttgatttttcttagggaacttgaaaactgtttattttcctatgtaatttaaatacatattcctaaaatttatagtttgcatatctacacatttgcttctgtgacctttttattatagataatatacataaatggctgggagcagtgtttgatgcttgtaatcccagcactttgggaggctgaggcaggcagatcatgaggtgaggagttcgagaccagcctggccaacatggcaaaaccccgtctctactaaaaaatacaaaaattagctgggtatggtggcacgcgcctgtaatcccagctactggggaggcttgaggcaggagaattgcttgaacccgggaggcagaggttgtattgagccgagatcctgccactgtactccagcctgggcaacagagcgagactccatctcaaaaaaaaaaaat

SEQ ID NO: 121774 - DNA, 1038 bp, Homo sapiens
tccaatcaacatttttgctgaaatcatcgtaagtgaagtttcattttgctttatatagggactaaactacgtctaatacttaccataatacctgatttgctccacaattttagactttccagataaaatgctacttttggtttatgtcagatatctttttaaaaattgagattggaccagatgatacctagtatccatttcaggcttgaaatttcacagtggcagagtagcaagcactactattcattatatttttttcattaaaaatactagttctcactataaagcaaagcagaatataactttctaccaacagaaaaatcaattttgtagaaaatttcctcttccatgtttttttctgtcatttccttagcagaaaatataaatatttcatatgagttatagatttttactgaacctttttcttcttggttattattcccatgtcagacacagcaagattctagtaacctgagtttctatttatcgtgtggtagaaaaaaaataaacagtgttattgtgaaatttaaagagagatatgtcaacatgtggcattataacattgtttgagtggtaaggcttacctttaactctttctttctgcaatggcttaaaagaagacggacccaaaaatgctaagcaaaaaaaggactacttctagccaatggcagtctcctcctgttgtcgttatcttgaaggatatggaaagctttgccacaaaagtactacaagacttcataattatcagcaggtagatggtgtattacctggcttttatgaaaaactccctttttaagaaaatactacttttaacttgaaaagtataatcttcattttaataccaactggataaaaatcaaagtattcaaattctttataattgaatattcaaagacttcctatcagattttccatttgctttttgagccaagaatgagaatcaaaggcacatttagccagttttaaattgacatggtaagatagtattaaatatggtttttctcaccaagattgactgtctcttactcacccattaaa

SEQ ID NO: 121775 - DNA, 1119 bp, Homo sapiens
cacgcacatgtagtcccagctactcgggaggctgaggcaggagaatcgcttgaacccaggaggtggaggttgcagtgagccgagattgcaccactgcactccagtctgggtgacagagcaggactccatctgaaaaaaaaaaaagaaaaaagatggtataatcttcaggaaaactttctggacctctctgttcttatttataaaatgagaggatttattaagagattgatttcaaagctagactgtctggaaagtaattatttctctgtttaatagaagaaagtgaaagacttagaaaattttagtgtttgcaatgataatccttaacagtgtcttataaagtaagcattaaaataaagtttgtcttatgttgaaatatgatgtattgaaatatatttgctaaataaatttcacttttgtgtctgtctttcaaaactagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataaggtaaaaagaataagttttaccagtgaaataggatgaaaagaaaactgccaataatagattgttaagataactgttaacaataagcctctacaactctctgagtactatattgaacatattccttcacatactttaatatttttacttaataatttttgtagtgttttatagttttacagtgattttgtatattacctcttcaggtaaaatataagctttatgaaaagagtgatcatatctctctatgtacttaatctctttatatctttactcaatagaaaattataggtttataatgtaaatttttacagaatttgtagactttgtagtaacaatgtattttgactcttacattttgatttttctaatttttatttttttgagaaggagtctagctctgtcatccaggctggagtgcagtgacgaaatcttggctcactgcaacctctgcctcccaggttcaagtgattctcctgccgcagcatctcaagtagctgggacttcatgaggtgtgccgcca

SEQ ID NO: 121776 - DNA, 1977 bp, Homo sapiens
acctcccaccaggtccctcccacagcacttgggaattcaagatgggatttgggtggggacacagccaaaccatatcattgaccttccccaaattgcttctggactcacctcctttaagatgtgctttatgctgcttatttaaggtaaactaaaaacaacctgcccactagccacttacacatgggttttagtgtttttctttttttccataaaggtgatttatagacactttaaggaaaatgttttcaagctgctatttttaaatttgcttggctaggccggaaagggtggcaagcacctataatcccttttacttggtaggctgaggtgggagaatcacttgagcccagaagttcaaggctacagtgagctatgatgccaccactgcactccagcctgggcaaaagagcaagaactttcctctacaaaaagaaaacaaaaaacttggttatagccaagttcaattggccttttacaactatgcttctgtttaagaagccttgtgtgacttttcatttccagatgtaaaacatcactatagacaattgaaaattagccaaataatacaaattcagctattctatacttttgaaatagacatctgtgaaatagacatttgtgtttctcattcaacaatacataatatattactcttcattaatttgaatcagtagtaatgaaaaaaatctcatctggtaataagaattgccaaagcctgcagcttcttcagtggtttctggtgaggaaaaaaaaaaggatgatatagttaataggtggtatttttttttaattaggaatttgatggaagatggtatagatctttggttctgaagatacagtataagtagcttctttttgttactcttgtataaattaacttaaaatttttgttgacatttgagcttaaaaaactagctattattgcagctttcatagttaactgtgtcataatatcattctttgcctcattattaatacttagtatttatgaagagtgaagactaacaaggagtgtgtccccctcccttttaatctctttcagctacttcttacaactcagtttccctttaaaataaatgaaaaagtattacaggttctgaccaacatctttttgtatcatgatttctcagttcaaaactttataaaaggacttcaggtaagaacacagtaatgggtttgaaaattctcaagctgattctaaataatttgcacattatttcaggctgtctagtgtgataggcattttaaatggcaaaatctagaataagtaaattccagttattttattctaggttctacaattcctttgttaccttgcagcaaactgtagagaatgcactcattaggatatcaataatgggaaaagacttctattccagcaattcttaaccattttgggggtaggggcaagcagacttttttggtttgtttccgagactctcatgagagcttatggactttttctaccaaggaaatgctatatataaggggtcagcaaacttctgtaaagggccagatattaaacatttttagcttttttttttttcgagatggagtttcactttgttgcccaggctggagtgcagtggcatgatctcagctcactgcaaccttcgcctcccgggttcaagcaattctgcctcagcctcccatgtagctgggattacaggtgcgtgccaccacgcctggctaatttttgtatatttagtagaaacagggcttcaccatgttggccaggctggtctcgaactcctgacctcaggtgatccacccaccttggttcccagagtgctgggattacaggcctgagccactacgcccagcccatttttagctttgcatgctacatgtggtcactgctgttgctgtttctgtttcttcttctttaataatcctttaaagatataaaaaaggtttttagtttctggaccatgcatgtgtgtgtgtgtgtgtgtctctgtaatttgtattctgata

SEQ ID NO: 121777 - DNA, 1043 bp, Homo sapiens
acatccgacgtctaccatcttttaggaggtaaaaagagaagtacatgtttaacacatactatactagaatttggtactaaataagagatctcagatccagttatttctgaagtagggaaagaaatagtaacctattctgtttttaattgtgggatttcccttgttggatttgaaaatttggcaaaaagaaaagtatttttacaaagggacataatttgcaagttctccagagttactttttagaaataacatttcctattcctggggtttatggccttttttaatgtttatatctatagactatgaagtccagctgatttaaggagtttaaaattaccattaaaccataaatgtcatactgaatttatttttgtgaagaaatgaaaaaaatgtggctaccaatctaggtagttctttttcccaatatgctatttaaatatgttgaatgtttaattttctctttttatgtatggaatggtgaaaattctaggtacgtggaaaagcaagcttcagaaaagcaagttgcgctcttgaccaatgagagatatttgaaggtaggaatgtgaatgtgtttcagtttcattctctttttcctttcataaagaagaatatgcatgtaacatttattgagttaataaaacatatttgtgcatcttaatatttatacagtgaagtactgggtcttgatagtcacctaggaatgtgagttttaaagatgacataaaaccttagctctaaaagttgaggctttttttaatcaagaaaaaatattaaacaccaagtttctcttgtggcctattttgaaagcacctttagatctatagagatctgctatgtgaatctttttccacctagcagttttggaatctgccagcaatttcgttgtaatgttctttttaaaggctgtgataaataaaagcatttagaagccaggcagcttaggcgtctgctgctaagtgggtattgatttgatttgaagaaatatcattatatattgataatataaagctaggaaagaagtaatgagcttagaaaattatcag

SEQ ID NO: 121778 - DNA, 1131 bp, Homo sapiens
cttctttgtcttaaaaatcttttggctttaggaaactgcttttgcaaaaatcttcccatatctctccatagctacaatgtgaggcacctgatgagtgctcagtcatggaagatgaaagagaatgtttgcctgactagagtggcctgagcagccagagtgaggaagtcatcagcaggcactaagggattttctttcaggttatgtgtgggcattgctcttgccactgcagcatgaactcaaccactcttcagaacacaaaaacttttaagggctggatgttggtatcattaagatcattgagttcagctatataaccagaaactaaagtctaggagaagacggcagcttgtttgagatcacacagctagctagtggtagcactcagaccagagcccatctctcttaaccactagttcattgtttttctgtcgctaattcacgatataaatacgccctaatagtgatcactggatcagcaaggggccaaccttaagtacataaatagggtaaaaggcttagaaaaatagaaggtaaatactgtgtaaatttcagtcttttacaaaatgggacttatggagattgctgtaaaaataaactgcacatataattttttcttctttttttgctgggcaccattaacgaggtaatctagatacatttttaattagagttcatataatatgagctagtaaacaaattctgtgatatgctagagctaaataaaggaatgcagcttttgaaatgggaaggtcgaagattaagatgattagtagcctaaagaataaagaattttacaaattaaagcacaaccactgtcttgaagaaatgtctgttatttcctgattttcaaaagtgactcattattaataataaactgaaactaaaactccccacgttggatgagtagaaatatttggctatatgctatctgtgttccttaacatttattacatattacagtttgggtttaaaattacagttgggaagagttaagtaggacagagtgtcatatcagattttttttgagacaggatcttgctgtgttgtccaggcttaagtgcagttgtgcagtcatagctcacagttccctcagacctcctgggctcaagtaatcctcctgcctccacctcc

SEQ ID NO: 121779 - DNA, 1042 bp, Homo sapiens
gattgtcgaaatgaagaaccttctttgtactgtgataccaaattatgataaatgtagagtaaaatttcaatctaagtaaaataaaacacatggaatctattctgttagtatggcaaaaaggcaagatttttttctttatcctgttaagtccttttcttaaatgacttaatggactgaatagtgagcactctgccatgtaatttagtagtaaagtgaactgcccttttcttctttccctaaaaatttgcttgtatattataaagcaaaacacctttgaggcgagattcttgccagaccttaaaaataaaaagaataaacaaaacccattttgatctttctctgtacatcctgtcttatggaaagggcatcaggtgcttctatagaacttaccaacagagctccctctgaggggttttctgtctgaggatcaccagaaaagctatgttcttttatctatagtccttattggaaatgaaggagttaagaagaagtaagaagcaaaccaaatttgaagtactcagagaaaatgttgtgaacttcattgactgtctagtgaggtaagtctaaatttagctcttaagagctaaaaatcatgctgtttttccaaataacactggtgtcatagctgtctatagccaatccagaacatttttctcctaggttaggctttatgcttttcaggtctctccatctagcttagagttgtaatttttaggccaggcgtggtggctcacgcctgtaatcccagcactttgggaggccaaggctggtggatcacgaggtcaggagatcgagaccatcctggctaacaaggtgaaaccctgtctctactgaaagtacaaaaaattagctgggtgtggtggtgggcacctgtagtcccagctactcgggaggctgaggcaggagaatggcatgaacccaggaggcggagcttgcagtgagccaagatcgtgccactgcactccagcctgggcaacggtgcaagactccgtctcaaaaaaaaaaaaaagaattgtaatttttattctttttccatcattat

SEQ ID NO: 121780 - DNA, 1278 bp, Homo sapiens
tgaacctgggaggcagaggttgcagtgagccgagattgcaccactgcactccagtctgggtgacaagagtgaaactccgtctcaaaaaaaaccaaaacaaaacaaaaaaaccccacaacttttgaggtgtcatttccatgaaagatatcaactaaaaattttctgtgatccaagaagaatttcctgaactcttaattccaggcctgtgtttaatattgccaaaggttaaatgtttgctgtgctagaaaatgtagatatctgttttctcatttactttaagaaatgctatcttaaagatttctaagcagaaatgtagtatatatacatttgttcctaaaggtttaactcagaactgaaatatacagcttcttataaagagtctagaggtagttttaaaaactattatatggaagagatgcagttctgagtgaaactgtattagagctgatatttgggtttgtttcattcgtttgtttttggttgttaattttgcttttagtaaatggttcagtcctctacagagagaggattgacaaaaatgttatagtgaaaattgaagtccaacagagcttaaaggaaaaaatatatatattatatataaagaaaataaacctgtgcttatctaaacatggatgcctgactggctgtttcagagaataccttctgcctcctgagacacagcctctccatgaggtggtgtacttcagtgctgcccatgcccttcgtgagcatttaaatgctgctccgcgaattgccctccatactgcactcaacaatccttactattatctcaaggtaagatgaacatttagttttctgatagtttagctcagactctgggcgtcattgtcataaaaatatactaaatttgcagttatgttttaatgagcagagagtcggcaattcagggttgcacgtctcatatatttttaaaaattctttagactgtagaaaaaaatttctaaccccataaagatagcaattagtagtcaactgttgctgccagtttttgaccatgtgtaatctttgcccttcacatgctaaagtcagatcataggcacaaagacttgagagtataatgttaccactcttgtgaaaataaaagaaatgtttcctgtaaacataacagcagacagggattaaacaatatggcctaataaattactgaaagaccgaaatggttgtttctagtgggaaagagaaatactttgggacttcatcttggattttaaaacaaagaaaggtctattctgagagcatctgcagagctgagtgtag

SEQ ID NO: 121781 - DNA, 1369 bp, Homo sapiens
atggttttcagtgatggtgaaaaccactgaataatttcatacttaaccaaaaaatcagttaattttaatatataaaccataaattaaaacttacaaaatctgtcttcttcttggctggtgggtcacagaagagaactggtatgatttcagttgtctttgggtgggatatattataatatacccctgatattataatatcagagcagggtgtgtatgtaagactttgtgtttctcagtaaaagccatggatttcaaataggttgaagaaacactgatggtttctatagggcttaaggtctgcagtgttgacaacgtagtcttttctttaaaagaaatttatacccctggtaagtggtattagtatttactaatacagtatagtaattgttagaattcagctaattataagtgttggaagtaccattttattaagtattcctaaagatttccataaactttttacattaagtgcattcaggtctgagaaattagtaatttatggattgaaatgaaaaatatgcttatcttctaatcctgggaatattcttctagtgactaagaactagaggggttatgaccaagacataaacctaaacaagaactagctaactattgaatagactcactcactaaataagggaaaccaagattccatttactggtttactcagtttaggttgggggcttcattaatgtctgattttattcctaataatttataaaagttagtcatcttagtttactgttaattgttagaatgaagcactgaaaagcgaagaaggctgcattccgaatatcgccccagacatctgcatagcatacaaactgcacctagagtgtagcaggctcatcaacctcgtggactggtcagaggtaggttgtagggaaaagaacaagctagatatttttctaaccatccatgatgactttctcagaatagttttatacttttagtgctttggaatttatcttgtgtttaatgccttgtcttttatttggaaagcataaatcatttcaaactttaaaagttccttaggaagtggtagttcaacagtccccactcccaatcccctgccctctgatcctgaattccttaaccaagccaattctgtgttcatgctaggtcaaaataagtatgtgatctaacccaatagttagcattaagcaaaaactaaacaatttaggtcagttctgttatttcacaaaataaagtatattattaactagcatttctcttcttgcttaaaagaaaaaaaattgaagtaactacacaacagatttagcaatcaggaagtataaggaatacttggcaaggcaataaacaactgttgttattctttaaaataaacaactattctttctgtcttca

SEQ ID NO: 121782 - DNA, 1256 bp, Homo sapiens
actttgggaggccaaggcgggcggatcacaaggtcaggagttcgagaccagcctggccaacatggtgaaaccccgtctctactaaaaatacaaaaattagctgggcttggtggcaggcacctgtaatcccagctacttgggaggctgaggcaggagaattgcttgaacccaggaggcggacgttgcagtcagccaagatcgcactactgcactccagcttgggcgatagacgagactccgtctcaaaaacaaacaaacaaacaaaaaaaacaaaaaccaaaaaaagagaattcaataatggcagtttcatttttggtaaattttaaaatataatcttgatataaatttgataccaaaagttttaggtttggtctcattttggattaaattcaaaataaagattcagaaatttcagttattctagcaccatatggttaatattaacaagtaatacggttgtttggagtacgcctttataaatatctagtgtagacctggagaaattataaacttatattttatgtgtagttggacattgtagaaatggttttaaaaggatactggataatttcattcatttcttctgaggttgcagaatttgcatccattttttcagcagctgtcacaactgttgcaaaagccttttgaatagacaagacagaagaaaataaaaatgtctacagttgccaaacatcttttactatacttcttttaatggctgttgatagctggcacatattcttcattatatcaaatttaagattgtcaaaactacactgatgatcactttaaaccacttatatattaaaagataaagtaatggttcctgaataatcttgtttcagagaactaagagtatgcagagaaaagaaacgaagctagtcaaaggtaaaagaacaagaaagccctgtttcctctactaatcttactccaggaaaatatctatttttcttggaagcagccaattatggatattttttaatggtgacaagacatctgtaaggcctttaatagagttaagatctttgtaatactattctgaagacagaaagaatagttgtttattttaaagaataacaacagttgtttattgccttgccaagtattccttatacttcctgattgctaaatctgttgtgtagttacttcaattttttttcttttaagcaagaagagaaatgctagttaataatatactttattttgtgaaataacagaactgacctaaattgtttagtttttgcttaatgctaact

SEQ ID NO: 121783 - DNA, 1089 bp, Homo sapiens
gtagaggccttactggctccatgacaggtcatcccgaagtagaatatttactgcctaaataaagccaaacagtttgggacttttttttttgacacggagtctcactctgtcacccaggctggagtgcagtggccgatctcagttcactgcaacctccgcctcccgggttcgagcaattcccctgcctcaggctcccgagtagctgggactacaggcatgtgccaccacacctggctaattttttgtatttcttaggagagatggggtttcaccttgttggccaggatggtctcgatctcctgcccttgtgatccacccgccttggcctctcaaagtgctgggattacaggtgtgagccaccacgcctggccttttttttttttctttaaagttgtaagactacaggaaatggagaggcagagacagttttggaacctatgtagtcaccaggagaaacaacctgtaagatattcatgttacttactgcctactacactaaagtgaggaatgccaatgcagggaattgggagaggaggaatgaggattgctaaagcaactgcaaataatttatactcctggataacggaatttattacatttacatactctaagttcaagaatgatttactcacaatttagtaatgactttggaaagtacagtaaaatgtgtgagcagttttagttacattattatttgttggagtctaaagtactccacaggtgttttgatacatgcctgtttggggttagcaatgtacttttctggttaaacatcaatgggggttacacatttatcttctcaacaaaacaggctcctctaatatatgtaaatatgactggtcacctttttctcttaagctaaatgtgatagttctggctttgcttatttgctttctagcagcctccccatgttagtcttgccacatggtcagtcttctgtttggtaggttttataaatcctaaaagttctagttcagaaacagctctaataaaccgagcactggaggctttaattaaggaaactggccgtgctgtatttttgacaaaaagggattaaaatctcaatgttaaaatactagttggtaaaat

SEQ ID NO: 121784 - DNA, 1134 bp, Homo sapiens
attcctcactttagtgtagtaggcagtaagtaacatgaatatcttacaggttgtttctcctggtgactacataggttccaaaactgtctctgcctctccatttcctgtagtcttacaactttaaagaaaaaaaaaaaaggccaggcgtggtggctcacacctgtaatcccagcactttgagaggccaaggcgggtggatcacaagggcaggagatcgagaccatcctggccaacaaggtgaaaccccatctctcctaagaaatacaaaaaattagccaggtgtggtggcacatgcctgtagtcccagctactcgggagcctgaggcaggggaattgctcgaacccgggaggcggaggttgcagtgaactgagatcggccactgcactccagcctgggtgacagagtgagactccgtgtcaaaaaaaaaagtcccaaactgtttggctttatttaggcagtaaatattctacttcgggatgacctgtcatggagccagtaaggcctctacaaatcacatcccaaacaaatacaactcagatgagcaaagtaaggcccagatgaaatgacatctcgatctcttctatggcagaaactcagcaagacataatgaaacaaagatagctaaagttcattatttaatgctctactcccaagagaattatgggactttaaggctactcactaacatacaaaattaccatgcagatatggggggaaagtccatgtccagaaaaaacttggtttgcaaaccttagaactatgtcattgcaggattatgtgtgtgtgcccgtgtgtgtgctcacaggctttgaagagttttatgagtatccattatccaaaatgcttggaaacagaagtgttttggattttagattttgaaatatttgcattatacttaacaagttcagttcagcatccaaaacccaaaatgctccagtgagcatttcctttgagcatgtcagtacgcaaaaagtttcagattttggagcacttaagatttaggatttgggatattcagcctgcataatcaaacctccttcattcaggaatgtaaaaggaggtattaatatgagcttagaataaagaacaccttagacctctggcagcgtggtgggctgagatgacattaatgg

SEQ ID NO: 121785 - DNA, 1002 bp, Homo sapiens
agatgactattaacacaattctgtagatacttattacaagcaatttcagggatttggggaattcagaatccctaggtagctaaaataatctattgaaatcatgtgtggttggttatttggactaatcaactaccggacccatctaaagtcagagtagcccataagctaggacttttgcataagtgataatgcagaaatttggctgtggagcaaaaaaaaaaaattttttttttttttttttttttttgagacagagtctcactctgtcacccagactggagtgcagtggcatgatctcagctcactgcaacctctgcctcctgagttcaagcgattctcgtgcttcagcctcccaagtagctgggactacaggctatcctgctaaccagtggttcttagctgggaactgttttgtccctcagggacatttggcaatgtctgcaaacactttggttatcacaattgtgggagggggtttaactggcctctagtggtagaggccagagatgtggctaaatatcctataatgcacagcaatagccaccacgacaaagaatgatctggcccaaactgccagtagtgctgaagttgagaatctctgttctagaccattaaaagggggtagaattggccaggcgcagtggctcacgcctgtaatcacagcactttgggaggctgaggcaggcagatcatgaggtcaagagatcgagaccatcctggccaacatggtgaaaccccgtctctactaaaaatacaaaaattagctgggcgtggtggtgcatgccggtagtcccagctactcgggaggctgaggcaggagaatcacttgaacccgggaggcggaggttacagtgagccgagatggcagcactgcactccagcctggtgacagagcaagactccatctcaaaaaaaaaaagtaggggggaagggcatagaatcatgcaccttattgctaccctgtgctataccaatgtttctcaaccactaattggcatataa

SEQ ID NO: 121786 - DNA, 1809 bp, Homo sapiens
gttcacgccattctcctgcctcagcctcccgagtagttgggactacaggcggcctgccaccatgcccagctaatttttttgtatttttagtagagatggggtttcaccgtgttagccaggatggtctcgatcttctgaccttgtgatccgcccgcctcggcctcccagagtgcttggattacaggcgtgagccaccgcacccggtcccagcctttttgttaggaaataaataaatctcacctagcctttatgtcaggtcatgtgattggactaaaacctaggtttcctgactaataagttgcatgctgtttttatttgatacactattagtactactgaggttatgtaagtgattttgtcaacttagaattgttttactgtatattttgtgttttcagtttatctggctctaataaggcattttacaaatgtaattgacaagtacctttatttatagaacaatatgatgcgtttgtgaagtttacgcatgatcaaataatgcgacgatatggagaacagcctgctagctgtaagtatttcacctttgaagttataaactgaaaataagactgtcttttaaggagaagacattataattattttcatactcaaaaagagaattcaacaaaattactgagaatgtatggaggaaataggcagcataactttgcaagtcttttggttacttaaatacctaggggcaaaattgggaatcaagatctagtattcgtttggattttgacctgtattttgcactaattttctttttctcaccctttagatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggctaacacagtgaaaccccatctctactaaaaaaaaaaaaatatatatatatatatataaattccttcttctgtaacttactgcctgatagaatgttacaggta

SEQ ID NO: 121787 - DNA, 1332 bp, Homo sapiens
taaatctgtggctaaacattctatttatgttaccatacataataaattttatttacttaaattatcaaattttactgaattttttgataactaaaacaggactccagtttgatactccaatgacttacacagtgacagccaattagatattttaaatgtctacattgatggtaacgttatgaaaaatataaagtcaaaaaatccacaaccaaattgaggtaaactactaacatcagtttttagtacagggtacctactaatattactgctgatctacacggctagccaatactcttttcctcaggttaccaaggcgggcatgagctataagaaggttaattttctttcctgaactgaaattttctcattctcagagaatataccgcaccagtgtatagaaagtgaaattaaagtacacgtggaaaatgcatttcacacaactgagttcctcagaaactctaataaacacacctcatacctgcaagttttgtgttcaatatttcttcatattcttctcgaactttctcttcacgttctttcaacaaacgttcacagatcatcccaacctgccgtagagtaaataagggctgttctttttttaatggtgaggatgctgcagatgaagtccctatgtacaatgaggacaaaaaatagcacctggtttagagccatgatataaagcagtttctaaatgaagaggttttatttggatctcttcaatcttgatataaaagcattttaaaatcagattttaagcacagcatttcacaagtcttaaaacaaccaaaataataattccatcagctggtgacgctggaaaaacacggcaagatgtaattaagataaaaaagactaaaggtgagtagaaaaaactttaagacataagaaaggttgggcgtggtgctcaccgcctgtaatcaggccgaggtgggcggatcacctgaggtcaggagtttgaaaccagcctggccaacatggtgaaaccctgcctctactaaaaatacataaaaaaattagccaggcatggtggcgggcacctgtaatcccagctactcgggaggctgaggcaggagaatcacttgaacccgggaggcggaggtttcagtgagccgagatcacgccattgcactccagcctgggcaaagagagtgaaactccatctcaaaaaaataaaaacaaaaaattaaaaattaaatttaaaaaagacataaaacttaaacattacaatgatgggtcccattacaaaacatcttatctcctttctggaaaataccataccatgaagtattttagtgactaaattactttcctacactaggaatgaagaacacc

SEQ ID NO: 121788 - DNA, 1686 bp, Homo sapiens
gcctcctgtgttcaagcgattctcctgcctcagcctcctaagtagctgggattacaggcatgtgccaccacgcctggctaattttgtatttttagtagagactaagtttctccatgttggtcaggctggtcttgaacttctgacctcaggtgatccgcctgcctcggcctcccaaagtgctggtaatacaggcgtgagccaccatgcccggcgtattttctttttcaataaaggaaaacccctttctaaaggtgtgaaatgatggtagaataattaccagttcattgtgtgtaggctcttaagatattaatggtatggctttgaagactaagtgtctttttacaggcataatgatttgttattctgggactaaataaaattaaatttagacctgaggtgttcttcattcctagtgtaggaaagtaatttagtcactaaaatacttcatggtatggtattttccagaaaggagataagatgttttgtaatgggacccatcattgtaatgtttaagttttatgtcttttttaaatttaatttttaattttttgtttttatttttttgagatggagtttcactctctttgcccaggctggagtgcaatggcgtgatctcggctcactgaaacctccgcctcccgggttcaagtgattctcctgcctcagcctcccgagtagctgggattacaggtgcccgccaccatgcctggctaatttttttatgtatttttagtagaggcagggtttcaccatgttggccaggctggtttcaaactcctgacctcaggtgatccgcccacctcggcctgattacaggcggtgagcaccacgcccaacctttcttatgtcttaaagttttttctactcacctttagtcttttttatcttaattacatcttgccgtgtttttccagcgtcaccagctgatggaattattattttggttgttttaagacttgtgaaatgctgtgcttaaaatctgattttaaaatgcttttatatcaagattgaagagatccaaataaaacctcttcatttagaaactgctttatatcatggctctaaaccaggtgctattttttgtcctcattgtacatagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcaggtatgaggtgtgtttattagagtttctgaggaactcagttgtgtgaaatgcattttccacgtgtactttaatttcactttctatacactggtgcggtatattctctgagaatgagaaaatttcagttcaggaaagaaaattaaccttcttatagctcatgcccgccttggtaacctgaggaaaagagtattggctagccgtgtagatcagcagtaatattagtaggtaccctgtactaaaaactgatgttagtagtttacctcaatttggttgtggattttttgactttatatttttcataacgttaccatcaatgtagacatttaaaatatctaattggctgtcactgtgtaagtcattggagtatcaaactggagtcctgttttagttatcaaaaaattcagtaaaatttgataatttaagtaaataaaatttat

SEQ ID NO: 121789 - DNA, 1095 bp, Homo sapiens
ggaaggggagtggaaacccctaggcagggattttctggaggggccagatggtaattattttgagttagaaatctttctgaaatgaatcatagtggcctaaaggatgtgccagatataattttactcatttgtgtgattgtggttcaagataattgcactgtggtatagtggttcttatttattgaggacctgtcatgtaccaatcactttacatggtctccccctcaccctaccctccagccccaagattcagaatgctgtagtattcttaggttttattgagcttaaaataattggccatggccatttaatgtatgatgactttttaagttcccatctactttgtcattttgttgacctattatcacttcagactgttgtgtgcttgaatatacataatctcccaagccccttcttatttatgggcttggaaaaggcataaaggcagtaaaggcagttggaaaagcctgttagtgtaatagttctatgtgatgaataaatgagctttaagtttggaactcttaagaatctgagtaaaataggtgttttggttcacagactccttgaccattattttgactgaaaaactttatttttgctagtcagtgctcagcaagaatattgttgaacagctgaattccagttggtgtgtatgtgctaagtgaatgtccccatttatgctgaaatgagttcctaccaaaatgtcagttttctggatattatttgaaaggagtattttgggtagattggtctactaaataatgttggaaagccaacctcttttttaatgtgaaagtttttatcttgccaaattttaacttttttattttagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccaggtaataacatttcttgtcatttacaaagtttattatttagagtgggaaaagtctaatccaagttgtctttagtcatttaagctactgtatctcctctgagttttaaaaaaacatttata

SEQ ID NO: 121790 - DNA, 1276 bp, Homo sapiens
gacttcttttttctttaatgaactgtaaattgtgttggcaagacaatgtcagatattacatgtaccttggataaaatattaacttgctggtatgataagagatggccagatctaagtagcttaagactaagtaggcaagtacttgactgatatatggaaggcctttatctacctggtatgaaagcaactcaggttagccaagtatctagatcgagcttagcaatgtagttgtagaatattgaatctgaggaaatttcttgagttatcagcttcaagactgtttatatccctgaactgaaataaattgagcttgaggccattgcagttagctgtttgctacttgtgcagttgagatcttggccaagttaaattggacccttcactgcataacattgttgatcacatgttaccagtattagagcatttgagggcacagtgtggcttagatgacatagttgcatcatattagatgtaaaaagcaatgcaggcaatagtattaaaaattcttcagctctttagctgacaatatcaagtgttggcaaggatgtggaacagctggagctgtaatacttttatggtaggaatgcaaaatgacaaaatcactctggaaaatggtttagcaattttattttgtaagaacaaaataaacccttcatttgccatatgattaggcagcccattcccactcctaggtatttatccaagagaaatgaaaacatgtccaccaaagactggtacttgaatattcgtaatagtcccaaattggaaacagcctaaatgtccattaacaggagaaaggctagctgtgtgtgtatatatacatacatatgatggaatactcaccaataaaaaggaatttctgattcatgcaacatacatgaatctcaaaagcattttgctgagtgaaagtagttcagacataaaagtctacactctttatgattctatttatgtgaaattctagagaaggcaaaactatgtagtaatagcagatgagtgttggtggactgtatgggggagtggtgatattggtagtgaattaactgcagagaagcccaagagaagtttttggagtgataaaaagttatttatcatagttacgttagttccaaaactgtatgtatgtacttgtcagaactcaaatggattgtacatttaaattggtgaattttgtcatttgtaaattataccttaaaattgttagtgatgtccctaagtatctgatggtatggagttttacaaagataaaatttttaaaagttttaccgtttcttaa

SEQ ID NO: 121791 - DNA, 1382 bp, Homo sapiens
gggtctttgttttgtttttgttttctgagacagtcttgctctgtcccaggctggagtgcagcagcacaatctcggctcactgcaatctgcctcctgggctcaaatgatccccctgcctcagcctctcaagtacctggagatacaggcatgtgccaccatgcccagctaatttttgtatttttttgtagagatggggtttcaccatgttgcccaggctggtttcaaactcctggggctcaagcaatctgcccgcttcagcctcccaaagtgctgggattacagatttgagccactgtgcccggcaggttttttctgctaagtgttttgatagatctagaaagacagtgatagaaagctttcgttttgaaagattgagaataaaagcttcagtggaagtgcccagttgtgagtatctttcctatttgaaaagagatttttctctttataaaagaagaatgtgaagtaatagcatgggttaagtttgggcctcttgaatagttggttcatgaaactagataatggtattaggagtgggagtaggtattttcaagtacctatcactgaattagttaaccagcaatttgtagtctctgtagtccttgtgttaaccctatgcctagcactgttgattcaaagaacgttctctatatatgtgaaactacagggaatttcttgcctttgagagcaccgcctgcttttaaaaaggtatgagagaaaatatttatttaagcctatacaaaactatcaggcatcttaagtcttgacatttcccaaggttcttagagttgctatggttggaaaaaaatgtaatttcagttttaccctgtaattctgtaccaaattttctttttagactgttctatgacattgtcataatgtgtaacatttttgacaaaaaatgtgactccaacgagtcgtaataaatactgcaattagtttaagactttgaataatacttttctgaggaactttaagtatatttctctcttcatttttctggataatgatgagaacatggattacatgaattacaatattttaagtagccccatgtataagaatttttctattatcaggtatttgctcattggaagaaacattttaaagggtttcacaggatttttagaagaaaatactttttaataagaagttgtgatttatttccaaagaaattgaattatttgttatagcaagtttctcacatgagatgatattgtatctatattaagcagggaatccctgcaggtaatttaaaattctagtggatgttagtttttcagctttgatatttattttgggcctattaatcagaattttacagtataatagattttgtaatatttttggtgatgaggattttacagtataacaatttttgtaat

SEQ ID NO: 121792 - DNA, 2022 bp, Homo sapiens
cccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacaggtgggacccggccccgcggccgccggggtagtggagagaactgggaacaggggtcctggggtgtgggatgcggcccctggggtgggggtgccggactgtgtggttcttgttcttagcaaagtagtagggcagccacgtttttcactaggtcctcgtagcccgaggacctaataagacacaatagaaatgggctgatgtcaaggggatagtgtttggaggtgggtaggggctttgccttgcccgtattgggtagaacagggacatctttttctttgggccgaatgattggaattgtttccgtagtcgctggagccccagcggaaatgatcagagaggacgatattattcgtaaatttaggcgaaagggtcacatttcaccccaatctggatgtgtgcttgccgtaatcgattggttgcagctattaactctgggactgggtggtttgaggcgaggctacagcccctccttcagttcagacacggctgattttagtatagtgggggtggggggtgggggatggatgtcactagggcgagatctaggcctgtcattaatcacccacaagaacgccactttggctgagtcaagacctgtttccctagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttccatttgaaactgactttagtgtttttttttttttgtcacatttaaaaatattttctaaatccatggagtgaccctcgaatatgcaagctaccatttttgctattaaatatttggtctaatttaaggacatactgttttagagttgtagtgagtttttacggaaattcttagataaatttatttaatgaccttactaaactgtgttttaattagattgaaaaggcatttgttgattaattgttaggctttactttgggaaaaaaaaaaggaaacagccaatgtcaagaatgagctactggtggttgacatttttggaatttgtcttttagtgaaatggtatcattggaaattgaaatggattctgtacttaactaataaagccatttcaaaataaggtcattaaggagctaaccagcaatacatttcagtcgagggagtgaattaatacagtgctaggtttgggaattaaagtactatatctcaatgtcaaaataatcttgggcatgtatgtgaacaattggggactataccatgttcctcccctttaaagcacacttattcagaattgtgatcctttgtaaacgacttttcattggcatatctgtagcgttggttaatacagttggctccacattatctcaagtttaaattaattggactgttgtagtaaaacgactggaattattggaatt

SEQ ID NO: 121793 - DNA, 1056 bp, Homo sapiens
tgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggct

SEQ ID NO: 121794 - DNA, 1002 bp, Homo sapiens
ttataaaagccactccatctagtggttgaattttcacgtgacttctcttgagaagttttggaaacacgctcgcaagtggagaaacccatttgggaaacatcaatgcacaataatgtgcatttaggggaagaaaaaaagtccattataatagtaatttcatatattgtctttaaaggtctatcaacagcatataattaagattcattcaaggttgtgcatgtcacaaaagactcttgatacgtcattgctaagtggctgaactttgcagttcataatatgtactcaggctgaacaaggattggaataaaaagtaaatacctgatctgtgcccataacttccacttgccatcaatataatttctatgtgatactgaaataagacatcctggggtaaataattgatggattcaatataattttcccatttggacactttttcagatggttgtttgtatgagaccaagattcaggtttaatgccctcatgatcagctggctttatgccagaaaaaactgtccatggttaaaagctgttctgttacgttggatcttccatgttgctgatgcataccaacatttacttagtaaacaggtattgaatacctactctgtgccaggcactgtgccaggcagaggacctataagatagttcccagctctcaaggtgttcatggtctgaagggtttagacacaataaagacaactacaggatggctcagcaatgcccatcacctctcctgggagaaaatctcaaagcatgtagagaaagagaattcacacagcccagtactatctgatgattaaatatattccctttatatgtttttataacctattctactctttcaactaggaaaaggaagacagaagggtgggctgtattcgaggtggaggggtggaggggagaaccatttcccttgctttcttgacctgacccatgtcccttacatgggtgtgaagcatggatatattttgggggtcatctatcacagaaaaatgttac

SEQ ID NO: 121795 - DNA, 1072 bp, Homo sapiens
cttcttaaaggttaaatctacttccccttctcatttagtccttttcatatgtctccataatctttcacagtggttcttaaacgtcagaatgtgctagagcctcctaaaggccttgctaagaatggagatgcaccccaaccctagagtttttgtttccatagatctgatctggatcctgagaatttgtgtttttcgtaagttcccagatgctgctgatgcttctggttgggagaccaccctttgagagccaatgacctatagactaaccctgcatgcacttacaaaccattgtgtaacttctcagactggtctttcagatgtatattataattttcagcccgttggtacctgtcttatttactaattcaatatgttcacatcactttttctgaacacttttcagttcctggaatctcttaattcttaattgtatcacacaaacgctaagaagggctcgatccggaatgaatacaatagaacagcctcatggtttcaatggcataaaaattctgcacttgcatccaatttgcatacatacttcttaatcacaactacatttccagagcatattttgcattgctactgaaacctcgttcttccagttctgtttgtatgtaattatttacatcttgaaagcatatttttctgtttatgtcttgcattgttagcacacactgaaaatttcctaaacatttcgactaaagtaggtgatacataagtacctagttcttaaaataatgtctgaaggaaaccccggatttacgcaataataaaaacttatttaaaattattttagtgagagaatgataggaaggaaattgaattatttagaaagtcactgtgtcctcaatttgtatgaatatttgaagcaagattcatttctcttgttaaatattccattttagtccctacaataatagagattaattttctgttctttttcatcacagagttaggaccagtagtgattattgcatatttggaaattggaaagctgaatgttttacaaaatagaatgagttggttattaatattgattgtgggttcctgagaccacccctcttacttttaa

SEQ ID NO: 121796 - DNA, 1012 bp, Homo sapiens
caatggggctgcacggggctcttcctgaccattctacggggcgaagaagctgagttttcaccacctagcagccatgagtgggagccaggtctcagccttgcctgacacatagaaggcacttggcgatatgtagagcactgaataaatgagtgggtgggtgggtgggtgtgggatcagtcctcttcccaggctgatgcttgctcttgcgggctatgccaaatcactgtgcctcttcagaagcaggccatccctgggtaggaacactctgaggcatggccagcaagaaataagaccagagaaagcatggtcaaataagcacagataaataaataaataaaaaatttaaaaaccttagctctttgttttctttgttgtggagagccctgccataaaaatgacactgggcttattctctccagtatctacatgttttagaaaatcccctttctgaagtcttttctgtctgatgttggctatttctctgagatttatgtcataaaggcagacaaacaacaagggtctgtctgtgcctcatggtggagagtgtgtctgtgtgcacaggcaggccccgggtggactggttatcaacctgccggggatgcagccctgactaagctggcattttgattgcagccgccgagagagaactcaccatttgttgactagagattgagattttccagtcctcaactaggacaaaccaagatgctcttgtagcatgctgagcttcactgacaagttccatgccccagttttccctcttatgaaagaaggtcaggtaccaattcaccatgtagagctgttttgaagaaaaattaaataaaaagacatggcaggtaactccaatctcccaggccccgcttgaggtctgcctcattcctctcattcttttaccctatgtgaccccattttttatgctactgatctatcaaagcagctgagatcccataagaagaataatcccaccttctgagctaccatccaaagaagttcatggagtgcacagtgttag

SEQ ID NO: 121797 - DNA, 1045 bp, Homo sapiens
aaataaaatcctccctctccttccttcctgcctgcctgcctgcctgcctgcctttcctccctccctccctctccttccttccttctttcctcccttcttttgttcctcacttcccttccttccttccctccctccttaccttctttctgattcacggcaggatgagagtgtctccaaatgcaaggtaatgctaccttttactttgtagcacttgtggcttgatctttggactccaggggtacttaggaagatgaaatcaattccactgaaatctcctttcttcctcaggcttcttacctgctcactaagacaagttcttttgtaagagggaggttttaaaagtctgttaaaggacattaccaagaaggcagacctatgaatttacagccttttgggatcctcctaacactgtgcactccatgaacttctttggatggtagctcagaaggtgggattattcttcttatgggatctcagctgctttgatagatcagtagcataaaaaatggggtcacatagggtaaaagaatgagaggaatgaggcagacctcaagcggggcctgggagattggagttacctgccatgtctttttatttaatttttcttcaaaacagctctacatggtgaattggtacctgaccttctttcataagagggaaaactggggcatggaacttgtcagtgaagctcagcatgctacaagagcatcttggtttgtcctagttgaggactggaaaatctcaatctctagtcaacaaatggtgagttctctctcggcggctgcaatcaaaatgccagcttagtcagggctgcatccccggcaggttgataaccagtccacccggggcctgcctgtgcacacagacacactctccaccatgaggcacagacagacccttgttgtttgtctgcctttatgacataaatctcagagaaatagccaacatcagacagaaaagacttcagaaaggggattttctaaaacatgtagatactggagagaataagcccagtgtcatttttatggcagggctctccacaaca

SEQ ID NO: 121798 - DNA, 1103 bp, Homo sapiens
ctggggactgcctaataatgaaatgaaggtctcagggctcaccagcaaaccacaaagcagctaatttggtatttcttgcagaaaaagaactggaagctgcacagtgtttgtttaggaaagaacttagccaagttagttgattagggtgtttcaggaaggacagtttatactccaataatcgtcagaatacaaaatagagatgtgaagtgaattctatcgaggaacagccttttccagaaacccacgttggggctggtgggagtgttacacacaaaagaaaattgtatcttcctctcctcaagactccaggcaaaaaatccacataactgctgaagaatggcgccttcctatacacacacagaggtgaaagaataggggacactagtcttctgtgtggtctcaggcaggccctgaacataattagaagcccactggagtaatgaaagaaggtaaagcactgtaaaccgggtgctgggcttgcaaccagaaagggaaggtccatgccactaggtaggagaaagttcacagggaaaaaagagctcctgacctcttctgataattctcagatgaaggtggagactggcctagcatgtctctagccatccggaggccaaaacaggagagcaagatcttctggtgggtggatgctgaagaagaaagaagcagcagaagaaggaagcagaagaggaggaagaggaagaagaagaaaaggagaagaggaagaggaagcagaagaggaagaagaagaaaaggagaagaggaagaggaagcagaagaggaagaagaaagaggaggaggaggaagggagataaagaagaggaagaagaagaagacaaaagaggaggaggaggagatggtggtggcccttaagagggaaacattgcttttgagccttctgccagcttagatattgtgagattgaaggtggtgacctcaagtgttgtgactcatgtgtttatggatcattgagctgtagctgctgggaatgggccgcagggttgcagaaataatgatgccctcagctcaaggccatgaggcagccagatctccttgttggtggcctcgggccatgaacagtcgcatccttgccccagcgtgctgct

SEQ ID NO: 121799 - DNA, 1129 bp, Homo sapiens
ggttacataccatgtgacttaatttacataacatttaaaacatgacaaaattatagtaatatagagcagatctgtgtctggcgagaggactgtaaaaggtggcacaggggatttcacactggtgatggcattcttctctatcctgattataatggtgtttgcataagtaggtctgtgtgctaaattagtgagatctaaataagatctgtagtttgggtattggtattataccagtatcattttcctggtcttgataatgtgctatagttatttatgtaagatgttataattcatggagtttgggtgaagagtacatgggaactctctactatttttacaacttcttggaagtccaatgtaatttcaaaataaaaagtgaaaaacaaagcaaaacaaaaaactgaacaggagcaatttctgatggttactctgcatatagacctgcagtatccctgcctctcttactttgaaccatcacatgtacccatttcctctaagaacaccttgagagcagtgcaagcaaaccctgttgtgcccaaaacacctgtgtgagagaagctgagcctctcttttccaggtgctgaagaatctttaacccttcttcattcacctgctcctctcatttacttcactgaaagccagtgttatggaactttgtggctaattttgacctatcagcccatgtttactaagcatagacaatatgtgtggaaaaaaatgtaatttgtttattattttggtatccatacctgtataagtgtccatagatgtcagggctatccttaggagggttgaaggtccaggacaaactcctagggtcagaatcgagggcaaatctgtacccccttcattaccctaaaaactctcccctcagggctcccacagatgctattacactgtggtgtatttgcttgcttttttctatgtgtcccttctcactgggataaagatcctgtcttctaggaaattttcatcaaattctggagctgccatttgctgggtaagcctcagtttcctcatctttgagtggtgataaagtaatcccagcactttggggggcgaaggtgtgtggattacttgaggtcaggagttcaagaccagcctggtcaacatggtgaaacccagtctc

SEQ ID NO: 121800 - DNA, 1056 bp, Homo sapiens
ttctcccagagtccatctctgacgtaccttgatttcatcctgattaaaagtatcttttctgttcttgccctttgcactgacaatgagtgcttctgacagaaccttctcagcaggaaagatcttttaaaaagtgccctggtctccttgctgtgataccctctgagggaggtgtgaggggaagagtgtttttaatcatgtcttatttttctagtggtttcactgaacttgccagtatcttaaactagaaggctccgtctccctacctactcattctcacctaatttctgaggtatccaaagagaagagaaatcttttggtaactgctgaggcttttcagttagttttaaaaacaaatttcagtccatgatcccttagtatgaatttgtgcttctagccttgcctttgaagtgggaaaggcaagtgaaagatattcttgttgctactactgaatgctattttccaggatctaaaggaataagaaactttatagtttctgtagttctgctttccttctgaaagccatcaggggaacactgtgtagttttgacctggagtataaacagtgtgctctgataaagataacacctacagagactgattgaacaccaccacaaccaaagctcttctataaaaaagattcttgaaaatgtgacatgtggataaaaactgtacaccaggagatatcacatacaatggggatgatgcagaaggtgggaggagatttaggcatcgatggatggggtgactggggcaggggaggtgtggacggtgactgtggggcagagtttgatggaggggtttgtccagagctgtgtgaaggagagtagtgggaagcagagctgtaatcactccatcttagaactaccaaaccagccaaccaactgcccttggtcccttgatatccctctagctgctgacccatttctctcttcctgtttcctacaacattctctgaaggagttgattgcacttggtcactccccatccttccctcctaggctctcttgagcccactgcccacaggcattcaactccatggaaactcttcttgtccct

SEQ ID NO: 121801 - DNA, 1051 bp, Homo sapiens
tcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattgg

SEQ ID NO: 121802 - DNA, 1042 bp, Homo sapiens
gtacattgcctgaatttgatcctagtattcactattgatatgtaactttttcatttaactagtacacggcatttcttagattttaacataggaatttagatggttagacctttctgaaagttgatgaaacctaggcagtatactcaatttctgaaagccgtagagacacagacaatattgaaggtattggtccccatggtaacatatttgcatttggcccagcatggctggtttctgcctagcttcttttaattgctatatattgacagccattttcacaattatttataaaatgtcggataagtgagcatgtgtacaagggagtgcacaccataccttaagcttgattagatacttcagatgacaaagagctctctgcatgaagagttactgaggtatttttatcatttcctaatgtgcctgtcacatagtagaagcaaaaagcctttcaagttatttaaatattttcctcaattctctttcaaaacaggtgacaaaagagctgaaacagtatgacaacaaaattatagaatgcaaatttgagaacaacagctgggtcttcatgagacagagaacagacaaaagttttcctaatgcctacaacactgccatgggtgagtatgacaacttaccagtgcttattatatttaaaacaaaaattaaggtgttagacccaaagtgtgctgcctttgttgttttgcttaatggggcatagtcatttggacttcatccttgtttgatgggaaagatacgtcaagtctgtattctgtttggctccagttggcttgtaggttctactctctaaactggtgatcttgtgcccatgcacccaaaagagaagtttaaagggcaggatactgggctgtatacaagttgaatttattgaacaacaacaacaacagaaaccatgataatttcagatctattcaaaactataaaaaccattgtttgccagatggtaaaagacaaaattatcaggggaaaatgtaatttccagctcttaaaatagctttataaacaatggagaacaaagtaaacgaaa

SEQ ID NO: 121803 - DNA, 1104 bp, Homo sapiens
caacctgagagttttcagtggccaaaactagaacaatttgagcaatgaaataagtgacgagtattttattataaaccaaataataaaataaatatccatgagtccataccaatacagataagcaattaaatgaataaataggggagaagggacaaatctttcttatggaagaactctagataatagatgtagaaggaatggaggatacagaaaaatcccattagaacaccgcaggaataattgctcaggcaagagttacagatgaatgccaaaattaataagtgaaacttttctttgagctgctaatttaaaatcttgagaagtactagatccgttttcatctgatagtttcttaaccccagattatttatagattcaaatagtataaaagtgtggtatgcaatcagatggatacaggcaacaaatttttttcaacataaaatatatggtgtgttgctctgtttttttcagaaacagtaaaacctcatcagttcaatgtaatttggggtacagatgtgaaatcttgttttataaatattttattctttttactttcaaggtctcattaactcaaactaggataacagttgattagaagacctgatggggtcctgttttagtaaataataatatgtaattggctgaggatgattattgtcatagtaacaaattagatctaaaattaaactcctctcccttataccggtcattcttttgatccgaccattattggaaactgtttttagtttgtatacatgtgggagatattatttttattagttaaatatattttaccacctaaccaaatgagtaacttgtagtgcatctatcttgggactataactggtgtgatcaatgaagaatgatgtattgttcttaaatacggaaatacgtttaggttagtagtggcaggtacgtgcattttctggaaagctctgtttaccagatttttagtggccaaggagatacacagatagttaatagtactgcttaattgttacagtcagattgagtaacataatttatagcaattctgaaactgagaacacaagaatgataagctatatgataaagaccacagttgctagtcagcaaaagtgcaga

SEQ ID NO: 121804 - DNA, 1050 bp, Homo sapiens
gagcacatattatgtgcctaagacatattataccttctagtgtttatagcagtcttactaagtaaatattgcttttattttcatgtgagaaaatggaaactcagagaggttaaataacttgcccatggtcataaattcagcaaatgatggaattgagattagaactcaggtttttctgcctttccaaccccaccctttttgttcttatgacactgttcttgtataaatattgctgacttacatttgagaatgtcaggtatttcacgggagccagcacatgcaagagtgcattttaaagaagaacctctatagaaatgtcagactgtatatacttacttcagttatccaacatcatcatttaatgaagtattttccctgtagctttttaaagcaagcatttatgtaaaattttccctttgatatgttagaagtatccctaccttcttaaagtgttctgtaatttatataacatttatttggggtatcatattaggctcttgctgtgtgctttaataaggcagtggcctcaggatttgttaaatgtccttaagtcagttactgccttgaaaagtggtccatgattagtatatttttgtagttagtgatttgctgtcagctgtcatttctcaaggtcaaattctggcagttccttgcatcctattatatacatccataagctttgacctgtgagcctaaaggtatctctacaccctcctggagaaagatatagtactttgattcactgacattacattcctattttctctctctctctctctctctcaaatgacaaggtagctaattcttctgtgtgttccttaaggcactattaacactctagtagtgccagtgtttgtatgtttaaaagacctacagacttactttttatttcttttaaatacatatacttctcctgtgatcgtaaatatttgaatgtgatgctactgtatactggctgtgtatgtgtgaatacagccaagatgacaaaaagcagctgcagttatgctcagaaagagtgttgtttcatttacagtggtttcttttcttcaa

SEQ ID NO: 121805 - DNA, 1046 bp, Homo sapiens
gcacaatcacaactcactgcagcttactgcagcgttggcctctcaggctcaggtgatcctctcacctgagtctcccaggtagctggaactacaggtgcatgctacatgcctggctaattttttgtggagatggggtttcaccatgttgtccaggctggtctcaaactcctggactcaaatgatccacccatctcagcctccgaaagtgccgggattacaggtgtgagccaccatgcctggccaccacaatatcaacatttttaaatgaaaaatcttatcttagttaccatagcattagcacctctttaaataactccattaatttaacctaaatctaaacgttctctaaagttcatcattaggatcttgaattatggaacctcttgacttttctagttccttaaataatgacaagtattcaagtacatttttgtcttccatttttaatatccctgtaacatgaggggaattggcaagattctcttcataaacccccctcgctatcccattcaccgaattcatcagtatagccaggaatcctaataggtttcagcaggaacatttctgacagctcaatatttttctgtccaatgatttggaaaatcctgtttctctttattagagctgaagtaactaaaaagagagaagcttatctgatatatttcagtaaggagagaattttttgtgtgcatggtgtgagttacatggtgtctcaaaagcacagtctcagagttatgtgtatcagagtggtagttgccctaccacttacctgatttattaacataacattttctttatctgcacatttcctaacaagctcggtgacaaaagtcaatcttttgtcaatcctttatgcctggataatcaatcctgtagaaaaaagttcatgattttagggtgtccttttcttttgatgttgttgtgggaaaggtttctttcattcactgttaaaagattcttatccttattaattgttgaagttctttcataattcctatggctccaccaaattacatgcatattaattagaatgtaagttaatggga

SEQ ID NO: 121806 - DNA, 1050 bp, Homo sapiens
atcactaacagaatttaaaagagatggttacgataatcttgtgttctaattttctatgattatatcagtatggcatgccgagaactttttgattgttttgagtttgcagttgttgtttagttttttgttttgactctagataccacacagtgttccattctcagattcatgcaatggaatttatagtcatcctagagatcattagaattctattatgttaaaaggccattaacttttaatgttgagactctgagaagtgacgttgcatagttcctctgggcaaggaatatgggcagtttttttcttcttctttatgtgtaatcgtgttcagactggagttgtatccatttattcacaatgtccattatgaaaagatttgtgataaaagaaagatgagatatatctacatttaggtcagttaaacacaagaatatttaattatgtccttcctataccctgtaccactaccagttccttacatactccacaagcacagttataatgatagtatttcttcattctcaatgtttcattgcatttaagagagatgggcatattagaactgtgggaataagaaggaagggataatgcagagaccataaccattaccatttttttatattagacctctatttggtttgatttttattttcatgtttattgttttataagaaataagtacatcttttaatatgactccatattgcgtgcaaaataaaatatatgccatttgaaattcttcatggttaatttgaaacttcgagttctcatctccaactaaattatttcttactctgtccatacttgtgccctctttatctcaaatctttttctcaggacattgtgtaagtttctccctttgtgtacccactctttgagtgaggctaatcccaaatcccatctattcaaacttttccagatcccttcatagcaaatacctttattccgctactttccaatggtgagtttctctgttataccccttattggagggtaccttttgttaaggttataggtatttgtcaggttttcctgttagattttggtacg

SEQ ID NO: 121807 - DNA, 1033 bp, Homo sapiens
tagagacagggtttcaccgtgttagccaggatggtcttgatctcctgacctcgtgatccacccaccgcggcctcccaaagtgctgggattacaggggcaaaattcatattttaataaaagggatgcatatctaatgtttactaatgaattattcaagttaaaattaatagtcactatagtaaagaccaatttaacttatattctgtaagtgagactgaggtgattctttgtattttgattatagttcatgtttctgtcagcattttgtagagagttctatgaagctgaactcatccttgaaatttagaattgccataattctttttaatgtggaatataacagtcagtctttctgggatctgtaatttcaaaaacaacaacatttttctttttgattgatcatagctattattggaacagctggtaacatgtgacatagtactataatttagactgaaaaaaattgatttgtgaattatatccactcagcttaaatttctctgtttctagtctccagagcatcttttgtacttctttttctgcagaaacggcttcctaacataatgttcttacattttcccaggggaagaggaaaactccatagtcaattttcttacttgtctgaagtataaaaaaagaaactctttacacaaaaatagagggaaaaacaaagtaagattcagaatttcccaacacaggaaataaaagatttattccatttaaccttttaacaaatgcactttacacattttgtgtgtgtgtgtgtgtgtgtgtgtgtgtgtgtacttcaggatttctgttcatcctgcagtcaatgtcaaggagatgagaatttatgaatatgatgattcagatgatttcagatttgagactaattcccacataaatcattctcccctctcatcttttgtaggtaaaagtaagccatagaatagtttgtaggatcattagataacaagttaggtagggaactattttgtatttaatgatttccctgttaaaattcacttttcaactatttacttaagtattc

SEQ ID NO: 121808 - DNA, 1081 bp, Homo sapiens
gtagtatagtttgaagttggataatgtaaagccttcatctttgttcttttgcctaggattgctttagctattcaggttcttttttggttccatatgaagtttagaatagtttttttctaattctgtgaaaaatgatggtagtttgataggaatagcattgaatctgtagattattttgggcagtatggccattttaatgatattgattctttcaacctgtgagcatggaatgttttctatttgtttgtgtcatctgtgatttcttttagtcatgttttatagatctccttgtaaagacctgtcacctccttagttagatgtattcataggtttttttgtgtgtgttttttgtggctatcgtaaatgagattttgttcttgatttggctctcatctcgagcattgttggtgtatagaaatgctactgattttaataccttgatttgtatcctgaaacttcactgaagcccaaacttattaaaacaatgtctctacagcatgagaattagaaacaaagagccagagaaagtgaagtttgattaccagttgtacttacaatctgtgtgcctttagataaattggtcatttccattagcttccatatctattaaatgaatataatcatgggacctaattcatggcattctttaaaaagattaaatgacaatcctaaattcataatactaaaagaatattcaaattaaattaatagcagagagaaaagcaatgtaatataaaattatacttaacacagagccttgcatattgaaattctcaataaataattttttgttgttgcatttgtaattatcagtactaatttacagaaacatatgcttactaatatatgctatatatataaatatacacacgcatatataggataaagtacacacatacacatacatgctcagggctgccatttagaccatcttatttgtaatctaactactcaggaaacttaattagttatcagaagttggctttgtgaaaatgtgatcaaagaaaaagagttagatgatcctggaggatagttcatccaggctttagtagagcttggaaaattaggccttccacattac

SEQ ID NO: 121809 - DNA, 1069 bp, Homo sapiens
catgagaacaatttttgtgtttttggactcaaggaatattggcaaattcagtttttgcttggcttcttaactgaagtctctttattgttgggatctcttatggtattctactcatttctctttccttctctactctccattcttcctactgccccaaataattcacatataatcacattagactcctgacacagaagtgttagtcttagagaggctcttttacatatcaaccccattttgagtatcacctgctagaaagtgaaaggaggctctgagtttttgagttccataataataacaaccaaacttcagaaaatgaagtggaaaatttcagtttgaccacagcaataaattcactttatctgtgctgaccatagtcagaacatttgcaaagtgatgtttcttgactcttataccacagatgacttcagatgtgttagtaccagctaaggatgtaataccacagcatttaaaaattttgcatgaatacctctggtttctttttcttgaactaaattaaggaagaattttaggaagctgttaagcttcttcattacatatttctatttatgcttcatctgtcatctcatttataggaatccttccttaaatttccctaagaccaggtaatctttatcttgttcagatcatgtcagaactttagctgtcagttttggttttgcataccaaaatattttagggaaaagtaatctacatataagtttgcttcatattctttcactaaaaaatctgtattacatttctcaagtatgttttagactgacattataccactggttagtttttctacaaggagatatgtgtcattttttgtttgtgttgctttttcttatctaccgagcaaccattgatcacctgccatgtgtcacacactatgcttagaggcttgggattatgatataaaatgtcttatgatgacacttgacagcttttgataagagactcttaaaatatgaaatttttatcagtggtttcaatgttgagtcatagtgcatctaaaggaattccataaaaccagcaatttagtgttagggttgagaagtcttta

SEQ ID NO: 121810 - DNA, 1012 bp, Homo sapiens
caacctcccaggctccagcagtcctcctgcctttgggctcctgagtagctgggactacaggcacatgccaccacacatggctaatttttaaatttttgtagagatagggtctcactgtgttgcctaggctgttctcaactcctaggctcaagcagtcctcctgcctcaacctcccaaagtgctaggtgtgagccactgtgcctggccttagattatgttggtaaggagtaagtttattattttttcataaccattatttcttcttatgtcttcctaaacaggaatgtttccattatggtgtaatttgcaaaaatatataattaccttaattttagggggaaataaaagataacattacagcagctttcactgatttgtttttttaaaagttaatttgaaatattaattctatttatatttatttttacaagaagctttttctccaaagagtatataaagacattttttgcttttagaatcttgataatatctgtaggatcatcagaaacgtttagattatgaaatctttttttattttttaaaatttttgtgggtacatagtaggtgtttatatttatgaggtacatgagatgttttgatacaggcatgcaatatgaaataagtacatcatggagaatggggtgtccatcccctcaagcattcctttggtttacagataatccagttacattctttaagttattttaaaatgtacaattaagtttagatggtgaaatcttgaaatgtggagaattcccacttctaaaaacatatttgtcttcctaagtttgtattgtatatatattcaaaaagagtatttttcatgacattgctttagtctactacaagaacaattgtttatagtaaaaatattactaagccttggtaaaatgaagcagttatattgtagtctggtggcttatatttgatataattgtaggtggaattttttaaattagcaatttgttatagtttgctctattaagatttagcctaaagtatttatgaaatt

SEQ ID NO: 121811 - DNA, 1528 bp, Homo sapiens
tagttggttttatttaactcagtctgtagcctcttatttttaacacaagaatttagtccattcaacatttgtatgctaaagtatgtcgctttattccttctactttgtttattaattttacctcttttttgtttgcttgagatggagtctcactctgtcacccaggctggcatgcagtggcatgatcttggctcactgcaacctccgccgccctggttcaagtgattctcctgcctcagtctcccgagtagctgggattacaggcgcgcaccgtcacgcctggctgatttttgtatttttagtagagatggggtttcaccgtgttggccaggctggtcttgaactcctgatcttgtgttccccctgcctcggcctcctaaagtgctgggattacagacatgagccaccaagcccggcctaattttacctctttaactttcctttttaaaaaattgtttctgtgtgataattggtattagttgcattttcctctttgttaacctgaactgtctattaacttttcattatattattggttacctttcctttccttatattcataatcagatatatttctctgttattacttgaaaataaagtaccaactctcccccaccaagatgttctttttttttttttttttttttttttgagacggagtctcactctgttggccaggctggagtgcagtggtgtaatcttggctcactgcaccctctgcctcccaggttcaagcagttctctgcctcagcctcctaagtagctgagattacaggcgcccgccaccatgcctggctaatttttgcatttttagtagagatggggtttcaccatcttgttcaggctcgtcttgagctcctgacctcgtgatgcacctgccttggcctcccaaagtcctgggattacaggtgtgatccactatgcccagcctcaagatgttcttttcatcctcccctcatcatatagaaattttagaatagtttctaataccttacctttcttcttactttagaagtctttggcatgcttttattctcaccacccattcccccctagcttttattggaaaattttactggaacattttccccaacccaatccctacaggtattactgaaaaaacttagtagtttttttttgtcgttgttgtttgtttgttttatgaatttctcttacagacatgaatgtcacttttatttcaagaatttttttgtttggatcttgttttgtttggatctaaattgtttggatctaaatttaaattgggttcaatttaaatttaatggcatttatatactgcaagatttgtcacctaccactttttccttttcttcattttctctttcttgttcacattcatttgttctttggagtaattttctcagatgggaatatatagatttttaatctgaattttttgcctaactgctaacgtcttcctttttccagacaggcaaatcatgtcttacctggatatagaattcttggggtgcagttcttttctccttctaattgccttttggctcct

SEQ ID NO: 121812 - DNA, 1256 bp, Homo sapiens
agcagatcactgttgccagaatgctgacggagggaattgactgcaaatggtagcaagaaattttttcacatccttgaaatgttcaatatcatgattttggtcatggttacgtaactgtatatatttgtcaagatttgttggttaattttattcattataaattatccctccataaagctgaacaagaaaaaaaagcatttttaaaaatgaagcttcttttaagtcataggaaggttggatagaatcactggttttattctttttctggactttcacaaacaagggtctacatgtctttggtaggaaaagaagaaaggtcatcaataagaaggtagatatctagcctgacttgttggttgaagattaaaattatgtttagaaaagaagtaattttgcttaataaaaagttacattaggtttaatacattgaatgtttaatttttaacttcttagtaacgattgtcatcattttaattggctttagaaatacaaacctggtcgatgtgatgatattttgaaatggaagcctcccagtctgaattctgtggattttcgtctaaaaataacaagaatgggaggagaagggtaagtatgcacttttgtactttttgcatgaaataatactgtttgtgtaaggcttcaccttttacagggtatttcatatatactttacaatactttaaagaaagaaactaaaatactttattttacaagatattttacatatatacttatacaacaatttcgttttcagagattactcctttgacctgtgtcagctaacatatagcagtttcctttaaagtttactgatctttgttttaaaatcattttcattaatataattatattaataacaacaatataaaaggtaataataatattaaaaaacgaattttggctgggcgtggtggctcatgcctgtaatcctagcactttgggaggccaagataggcagattgcttgagcacaggagtttgagagtagcctgggcaacatgacgaaacccccctctaccaaaaatagaaaaattagttgggcttgttggcacatacctgtggtcccagctactcgggaggctgaggtgggaggattgtttgagcctgggaggcagaggtagcagtgagctgagactgcaccctgctgcactccagcctgggtgacagagtgagaccacttcccccgccgcacacctccccccaaagaaaagaactttgttaaattgtaaagtgaaaattttactaaattttgagatt

SEQ ID NO: 121813 - DNA, 1025 bp, Homo sapiens
tgttcattgtttcttttgctgtgcagaaggtttttagtttgatatagtcccacttgtctatttttgcttctgttgcctgtgcttttggtgttatatccagaaaatagttgccaagaccagtgtcaagaagtttttctttgtttacttctaggagttttacagtttccacttttgtgtttaaatgtttaatccatttgagttgatttttgtgtatggtgtgcacctttttgtctttccattcaccccgtacaatgtggtagttagtatatattttggaatctggaataaaatacttgggttcaaatatcttttctaccaatttctttatgactctgttttgtgatccatgagaaaagggtactatgttagattgaactacctcatggagctattttgagaataaagtgatttaagaacactcaaaccagtaactggtgaaaagtgaaaaactcagtcgatgttagcccttagaagttattgctgccttaattattctgtgtaaagggcatagtaggggataaaactagagaggatgaataaggctaggtaagtgggcacggggaggtggtctttggttgttaggttgagaagcttgtattattttcagtaaaccatctaaccagatggattcaggatcagttgtatttgatagggcctgttgataatagggataacagttaggttgatcacaatagcctgggtgaaaaagtaatagagataattggtggaatatggaattggtagagatcgcatcaaagatgattcgagagttttgaacctttctggttaggagcattatgttaatcagaaatggaaatcagaatggagatgaactagttttttgtttaagaatataaatgattcagttttagatttaaaactttaggctgcctttagggtactaatgaataagccagtgcctggcatacttttatttgggagaaagttaggacaaaagatgaagatttgggagtaattttcattgtaagtgtatttggagtcttagaggagtggatgctgtataa

SEQ ID NO: 121814 - DNA, 1113 bp, Homo sapiens
ctatgttttattagactcctatctatatggttttcagttctgtgattacacttccattttgaattgctaatttttggccattcgtcacttaaaaatgaatattttaacgtgatgatttggtattttaatatgcaggtattcaatcttttacatgatagctattagattgtttaatttacaaagttggtagtaaaatgaaatcttatttgtttactagcttttataagttgattttagtgtagatttatgtagcatattacagttttacatgtggaaataacattaatttttaaccttttgaaaaatcagctttgattttacttttatcatctggagaaactatgtttctagacaagaattgtatgccattaatctatcactatgaaataaaaacagaatagtggattgtataattgaagtaagaataaaaatcttgaaaatatttttgttttatatttagaaaaatggcttttcttgttgtacccactaactctactatggttagtaaaacataattgtttctattgagtctagagttatttactttcaagtagtagagatataattgttttttaatgttttcatcactattttgattttcctataaggtggttcagcttgattttatgtatctggtattcatcagtttgcatagaaatttagagtcagctttgattttaatattgcattcttttgaaatattaatatttttattaaatctttactactgccaggtatattgaatgttatggatagattgtaaaatgaaaattggaattagcctaatgccttgtcttgaagtacatgacaaattagaatggttttcctctgtagcaaggatgttaccatggtgagagcttctgtttccatgacatttgcttgcatattttgataggtcttcatttgaagaagggctctgttttctggcaggctgcaaaagtgtcattctatcttttctcaaaatgtgttacttttattgaaaaatataattttccaaggaattgtaatagcaaagtgccaagaaagaaaatataccttattttatttttttttccttgttcatcttttagagcacagcaaaatattcttagcttgctttgtgtaaggaagaaa

SEQ ID NO: 121815 - DNA, 1905 bp, Homo sapiens
attaaaaacattctctaagggttcttggaaaacacaatgtatttatggattataatctccatgtttgagctggtttgtggttacaaattcttgcccccaagcaagtttgtttgtagctttggactataatcttcatgtttgagctagtttgtagttacaaattcttgtccccaagtatttctttgcttctcctgtttttgtgtgtgtttattttttattccttttatctattactttccagagtttctactttcactttgtttttgcttctatgtctttcttccttttgtgctggcttaggaatacatttaaaaatatgttttcagtgctttattcattattttggttgttgtagttaggactattgtttagaatatctagcctgccaaggaatggaaatttgtgtgtgtgtgtgtgtgtgtgtgtgtgtgtgtgtgtctgtgtgtgtgtattcaaatcttacgatgtattaacttagattcctttagacctatccctttctcttattttgtatttcagttcttataacttatatattaagaagtttttataaagcttagcaagaagtttaaatacttttaaagtgattattatatttttaaagaatacatgtgtatttattttatagctacttgaaggaaattttgccaaagaagtgagccatgaaatggatggacttatttttcagcctactggagtaagttcatttgtctgtgtgtgtgtgttcgtttgtgtgtttgtgtgtgtgtgtacacagatatacatatacatacacatacacatgtatgcctcaaacttatttacttgggattgattactgctgtgattgccacttttccttaaaacaaattgctcattatgaaagattttatttatatctaaatacatgtaatactaaaatgagcacccatctgtttttcactcagcttaagaaataagcatttttggtcgttacatttcaaagaaaccagtcttttaatataattagttattaaaaaataattttctaccaatagcattacataaatgtttatttccttttgtaacttggtatacttttatgtattaatctctctaaaacttcattttgctgtagtttactgtagagtaaaattcatactttgtcactacttgagaaagaataaaacttttgaatattttttccatgttaaatttttgaaatgcactgaagaacttttaccaacttaatggtcgaatcatatatttgaagtaagttgtattttactctatagcaggttttctcattctcaaccactgatgtgttgggccagataattctttgctgtgggagctgtcttgtgcatggtaggatgtttagcagcatctgtggtctctactcactagatgccaggagtatagatgccaggagcatgctccctattcccatttgtgacaaccaaaaatatagtctgacattgcccagtttcctcagagaacataattggccctacttgataacccatgttctgtaggacggtgtttttcaaaatgtggcctgtagaggaggattagcaccacccaggaagtttcacagatgcagctcagccccacacctattgagtagaaactctggggatggagtttagcggtttgtgttttgacaagttctccaagtgattctaatgcatgttcaagtatgagagctacttactctataggaaagagtttatttcatgtgcaaccacctcatcatatgctgctttttttcttcaccaactcttcttttagtaattagagtataagctagttgagaatttatatatggagacatcagactgggtgcctggggtcaaagaaagggaactaataatttgaacacagtgtattaaatactgtacaggttgagtatctctaattcaaagactgatatgctataaaatttat

SEQ ID NO: 121816 - DNA, 1782 bp, Homo sapiens
ccagaactgaaaggtggaggtagtttattcttttttaagtattccattggtatattttccatactataatgaattgatattgccaattcgtatttctaataacattggagattgagtttcttcttcactgtagtcttaagctgtcattttgcttattatttttaaaaggctcctttctatgctttgtaactttgcagtttctattttatttctcatgtttctaatgtcaagccttttgcattatgtttctctgcttatgcatttataacaacttggttttcggttacatcatgattcatagacataaaacatcaactcagagtcaatcatatggtaacctttgtcagttcctccaatctttggtccatgctacatgccctctgtaggatatttcagatggtattcaaagataagattatgttcataagtaagcaaatttaagttttataggaaaaaccttatgaaaagtatcatgctttattaaaaattgatatataatgtctactgttttacttttcatccaattatcttcgaattttgtctggagggaaaattatcaagaaaattgtaattctgaaaaggattgtatcctagtttagggtgattgaccagatattccactttaaatttctccaagatttttcaattaaccatttctaaattaagattcttttatttgttagaagtgttttaaaaacatctagggtaatttaagtagaaccacgtttctgaagaaagattgacaaggagaaattgtaattatgtcatcacatttaaatgtttttactgtcaaattgaaattaaggtattatttaggcacattggccaaggcttatgttgttattgggtcctcatatcccattagcatgtcctaatgctggcttggtttctagcattggaaggcagtcaggaaatatctatctcatgaacactgcatgcaattgtatttttattgggatgttaatcaaccagtgaattatctatgaaaaacttagcttagtacttcttacattaggataccagtgcaactcatgaataagttttactttatatatagaaaaggagaaaaagaaacagtaggttattttttgaatgtaatatcagacacaaaagaatatcaaagtgagtttaaaattatatctgttatttaaattattaaataaaacctgacttttcaagtcgtgctattttaagcacattgagactctctttttgactttttgctaactcctttttttcatggagactgtgcctgacagactcttctctcaaaggctgcccatcatcgttgctgaatacacttcccaatgtttggtttgacttacaaccttggcctctcaatttctttgaaattttcatctcagcgacttaattttgaaatttggaaattcattcctacctattactcagtatgctaaatttggacatactgctttgatacaacttccatctttaaaggcagctgggacatttcatcagcttcaccatccagtgagctatggctgttccgtcttcagtgaagtccggtcttagccttaggaggggagaagttgtttttattgtgtacactatctcagcccaactggctattttttatatctgagattatgaaattctttacagttctccttactttcttaaagtggaagttgaggtcgttgatttgtaacctttttcttaattttttttattataaaaatgggtaaaaaatttttttttgcttttgttaggcgatatctaattctgttgcccaggttggagtgcagtggtgcaatcaggact

SEQ ID NO: 121817 - DNA, 1035 bp, Homo sapiens
atcacttgaggccaggagttcgcgaccaacatagtgaaaccccatctctactaaaaaaaagaaagaaaaaacaaacaaattagctgggcatggtggcacacacctgtaattccagctactctggaggctgaggcacaagaattgcttgaacctgggaggcggaggttgcagtgagccaaggttgtgccactgtactccatccagcctgggcaacagaggaagactctgtctccaaaaaaaaaaaaaaaattattatttgtgatactttaatctacatgataaagagactccagtgaacattagtctacagatgtttaaggtctatggaaaaccagtatgttatttctcatgaccctgttcttgatattatactgtaaatattagctttttaatgtttcatttacaggtacatgatgttgattgatggcacaaatgaagtttttatgattgatagagacaattcagtatttcatgtttcaaatctggaatttccatttcgtaaagatcttcgtatgcatttatcaaatactctcttggatggcgtaagtcatatttatgtatactataaaattaaacattgccatttttcttttccttgtaagtaaatgtgtatttctgttggttaagaaatttcgaatgaaatctaacttttttttttttttttttgagacggagtctcgctctgtcgcccaggctggagtgcagtggcgggatctcggttcactgcaacctttgcctcctgggttcaagtgattctcctgccttagcctccccagtagctgggattacaggcatgtgccaccacgcccggctaatttttggatttttagtagagaaggtgtttcacatgttggtcaggctggtcttgaactcctgacctcgtgatccacccgcctcagcctcccagagtgctgggattacaggcatgagccactgcgcccagccaaatctaacttttattaggatgttaaatttcatttatttcttatgtatacttatattgaattaaggtcctcttaaagagagatctgccaa

SEQ ID NO: 121818 - DNA, 1025 bp, Homo sapiens
ttatttaatgtattctggttttaaacttgcttttttcccactaaatatattgtaaatctctttccatattaatgaatatttttatcattgtttaaaaaatgcttgactagtatgcttttacatgaatatgcaatatttattttacctatttgctgaatgatggacatttgagtttttatcctttcactgttataaaatattatgatgaactttgttgtacatacagctttgcttaacaaatattgagtgccttcctttagtgtgtattcaggtagactgtgcaagatacttaagctgtgagaaggaacaaaatagataggatttctgccttcatagagtataagataaattcctgaattgatgatcagagttgggtctaaattggtgataactttaaattaccaggagtttaacgaccattttactctcagactactgggaggaatgtgaattaggactctaaggtggtattagttaccattgttttctgtcagttttccttctctttaattatgtacttcctaattttattaatgtatatttggttgttttacttaattatatatctcacatctcagcaactgctctgaaagattatttccagttttggtagaaaacctgcatttacagtaaagtagtctatacatctggcttttctgtaatccatatacctttggtttatatactttagcattttctatctgggaaacgtatactgaattaaattttgccttttaatgggaatgaatgaatataatacaaatacctattgataattctgaatattaaatttgcagttgagataatttcctaattaataagaaattatattgcatcatagttatatactaaggcagtatctgacagtttgtgaggtagttgcttctttttaaagaatctggctgctttcagggactttggagtgatgtggaaatatttccacattccttacatgaaatagctccttactttttgttagtatcgcataacaaaagaacatatgatttggaatgactggagttcaa

SEQ ID NO: 121819 - DNA, 1021 bp, Homo sapiens
tttcagatctcaatctgtactttttgcatgacagtgagctttaaaatttttcctaacttgatctaattttatgtttgataccagtaaatggagaaattacaactctcttaaaacatttggtgcacttagatacggttttgttatttagatttttcctttgtgcatgaagcaatattaaataaaatcaagcatcatcatgttgtacatcttctacatgtgtttttaattctctttcttaaaaataccttaattgtgttattagcacatttctaaatttaaaataatgggtgatctttatagtaaaatatttatggtaaagtataatgcctgtgttaaaagtaaatttatttcaagtttcttgtagattattaaaatccctttcagtaaaatttttttctgaaaatgttcattgttctatagaaataacatgagagtatgaaaaagatggtgcttgctttaaaggaaattcctaatttctgacaagttttaaatggctgctgttttgactacacactcagagctgccaaatacaatattttgatatgtggtcaatttcaatggcagtaaagttttaaaaggaaaaagagtttgtgtgtatttaagaaaagaaaattgaagatgtggttcatgccctaaaataggtcaaaatctaatgaacaatatgaagtataattgcatataaatgacatgacatagactctaataatgtgggagttcttaggaggatgatgagtgaaggatgagtaacaggggtgaggggagcaatgtgaagaaagtcatgaggtagaaacagcctgagctggaccgacctgattaataattgatataaatccacaatctttgtaagctcttacagttaaggcagttaggtgcttatgagaaaattgttacactggtggctgcataaaccctttgtttatattttgaagcatgtcagagttttaatgattgctaagccataagcttctgatttaaactttgactatgatgtcaactcccactccttgaattgttcttagga

SEQ ID NO: 121820 - DNA, 1010 bp, Homo sapiens
tagatggcagcagaggaccaggtttaattcagactgcttttgtgaagcagtagaattctaatggtatccagtgcattggacatctattttataatacaacccagaatattagctggggattattaagaatttagtaaggattagtgggatcatatatacagcattactgaaagcatagccattttgacaatgttggtatgttcttttgtgcattgcatctgaattattatatttgcaaatgaccttaaagtgccattttggaccttttttggtaaaaacaatgtagccgtattaaagtccctagaagtgttttttctgtatcaggaaactgagacattcttaagttgaaatctcagaagggaagaatgatatgaagattctcttttatcccatttggatttttttttttttttttgctcttaattgtgttgggagcaaaggagtctaatagaaaaacatgatgttggaatgtagctcttttatttataggcagtgaaatttatgttcataggatagaaaagttatttgacttgtatgtggtatatgaggaacagtaatttttatatatgtgccctaatgatatattttggggaaaaaattctataaccatatgttttaaaatcatatataggatttttattttctggaggaactacatttggtttttgcatgtttgatggtaatttgcttctcaaaaggcagtaacatgtgaactaggtaaagaaatcagaaaatgagcaattctgacagtgcttttaaattgtgaagtctgatttgaagattatataggtggcccatcttagtatagtatcactctggctttcagcccagatttaatgttgctgctatttttgctggcaggtgagcttccttggactcattttattttagtaacatttttgaatttagaaatttaatttttaaaatacttttgcatgggcagaaaactaaattttgtctccctatgaattatctagaatggcatttaggtcttttacatcttatgtcag

SEQ ID NO: 121821 - DNA, 1059 bp, Homo sapiens
tgcttatattcctgttctttccttagtttgggagttaatttattttatcaagtgcctgcttagttttagtgtcttgaataagactttgataagtgatacttttattatcaattgttcaggggcaaagtacatacagaatctccctcaatgtaaatgaatgaactgtagtattgccatttagtctacttatttgggaacaaattaagttactagtaaatttgccctttcatttttttttttttttaggttaaaatgggcttgttggtggacctgacaaatacttcaaggttctatgaccgaaatgacatagaaaaagaaggaatcaaatatataaaacttcagtgtaaagggtaagttatatattaagattctttaatattgaaacctttcatcacaatttgtaatctcttttttcaaaaaaactttttctatattactagacatggtgagtgccctaccactgagaatactgagacctttattcgtctgtgtgagcggtttaatgaaagaaatccacctgaacttataggtatgtttggctttactttgccactgttgaatattttattttgcagttaggtttctgttttcttgtttgcaaataagttgatatgaaagttttttctgttttaaataatgaccaagtagtgtttattaaaatgagagattgacttgtgaattatgtaataaatgtattttcataatttttacatttttctagataaagccctgatttcctctcttcaggtgtcctgttgggaaagtctatcctaaacactacatatttattttttatacttctacattttataattttacattttatactatattattctgaaacttcattcttttttattcaggatttctgagagcaatgtatggtgatgtaattgtagttcatttttgcttctatatagtattccattatacaaatacaccacagtttatactcttgttgatgcacaattccttcatcagatttttattgattgctactctatctataccaggcaccagctcgtggaacacatcagtgaacaaaatagaaaaaaacat

SEQ ID NO: 121822 - DNA, 1012 bp, Homo sapiens
caaagtcttgtcagaataacgttttatggacttaagttcaatgacttaatcttcgtaataatgaaatgaaaaagttcccgttatttagtgaagaatgttgcattgaattagagatttgcggtttatctgtgcccttgggaaaaaatttgcccaccttgtttctttaaattatcgtctcaatgtctcccttttaaaattccacgacttttgaaatatccgtgattacctaaaagcttttgtgcttgtttcctggcctgttttctagaacaggtactaactagggagctctggcagtgaaccttattgacgtggaaagttgtggtcctctttcgtgtcgtgtcttgcttactaccgcgttacaagtgttggtagtgcagtgatctagtggattaccttacgcttttccatcctttcaagacttcctataaggcccacttaagttgggaaagattaaggtgagtgaagcagcgttcttgaagcagttactaaaccagaaaggaggtacacagcaaagattgtttctggcactcgtatttggaagagagctcattagtcttccttacagttgtagaaaggtggacttgggttatttcagactttttttagtttgacattttagaactggttcacgttgcatactggtaactagcagtggtgattaactgcatttttagtggcgaacaagagtgaacttaaaagtcaagggaaatttaagttttttgttgttttttttttcttgagacagagtctgcctctatcgcactccaggctggaatgcagtggcacgatcgatctctgctcactgcatcctccccttcccaggctgaagggatcccgcctcagccagcctcccgaggcgcgtgttaccacgccgggctgatttttatatttgtagtagacatggggtttcgctatgttgcccaggctggtctcgaactccttgagcttgagcgatctgcttgccttgacctcccaaagtgctgggattacaggcgtgagccaccatgcccaa

SEQ ID NO: 121823 - DNA, 1654 bp, Homo sapiens
ctatatccatgttgtacccagtgtttagctcccaaattcacttgtaagtgagaacttgcgatatttggttttctgtttctgcattaattcgtctagggtaatggcccccagctacatacgtgttgtcacaaagaacataattttgttcttttctatggctgtgggcaaacttaaacacaacaaaactagatatgtgatatgaggttcataactgatttttatctagaaactatatttacttttgtgttcttgtctttgtaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaa

SEQ ID NO: 121824 - DNA, 1320 bp, Homo sapiens
tgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgt

SEQ ID NO: 121825 - DNA, 1050 bp, Homo sapiens
tcagggggccattgacatgtgcagcaggtggtgggagtataagagactggtgcaaaagtacccactgcctccaccagaagtctaagagttacctatccatgccattggtgtcaactgcaccttcccactaatccactcaaggtttcatgtccaactcaggcccttctcgtaagctatagatacacagaacttatggtgactcaacatcttcatttcccatagagtgaaaaaaatctctgtaagtataaagacaaaactcatcagttttcttctcctcccctaaacttgcagtttaccctagtatttcatatctcagggatagacagcactcaggcacctatgggagtcattttttatttcttggtcgcttccttgctccatccctgccctgaaacacacaactcaatacacacacagaaacacatatatctaatcagtcactgttgtcaccagatcaatcaaaacaaaaactgattacccccaaattgaaaaattttcagtagctttctgatagctgtcaataaagttcaaagtaaactgcttagcttggcctacagggctgctcatgattgaccctgcccttcctcaccagcctcactgtccaccactcttatgctcttcctcattttctttttttttgaggcagggtctcccagcctggagtgcagtggtgccatcacagctcactacagcctcaacctcctgggctgaagtgattcttccacctctgcctcccgagtagcagggaccacaggtgtgtgccaccacacccagctaatttgtgtattttttgtagagacgagggtttcaccatgttgcccaggctggtctcaaacgcctgagctcaagtgttccctccaccttggcttcccaaagtggtgagattacaggtgagagccactgcaccaggcctgcgtttttacctatccattttgcctgaatgactctctagctggagtagcttttctcacttaggtgctttggttcctgttggaacctctgcttagaatgccttcctttaaatccatctgaaattcctatagttcttca

SEQ ID NO: 121826 - DNA, 1043 bp, Homo sapiens
attacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtacagactggatgtaatttgtaatcaggtatagtccatgttttactttaagcagtacatcacttaataaccattgttaagccattgctttcaagaatgttaactgccaatttaaaagcatgtgtcctaggttcatgctttggtaaagctctcatttcaagtgtattcatagctaagctttctgggagcagaattgtctctttggtgaaaaggaagtacagcctttcctgtttctgaggttgcttaccatacatgtatgtcactgtttcattggccctgttacatccatttggtaaaatttatttgtcctgattaaccagc

SEQ ID NO: 121827 - DNA, 1114 bp, Homo sapiens
tgccccctactggcttgtcctggccatgggtcccatgaaaagatggagattatttctacgtgacatttataaatatttttgttctcttctccagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcaga

SEQ ID NO: 121828 - DNA, 1003 bp, Homo sapiens
catatcttcagcctttcttagtctttcatcagaccacgcttttgacagcctggctattctaggtgagaaaacaagaagcccttggccacggaggtggggagagctaacctcatccttcaactggcttcttcaggtgcctggagagtgtcccagctgctgcagacagccactcattgtcagtaggaaatgactgttgaggactgtgtatgtttttgtgcctgtgtgtttctgagctcttttgctgaaaggcactgcaagtgtaaacaacttatgattatcactttttgtggcttaaagccggtctcttgtcactggcttacagtttctagttctttctcaatggtcacatgttttggtttctgtccccatttagtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaaggtaactttttggtgtgatttaaaagaagcattaaaagaagcatcagactgctactgcatgtattgtttgttgaatgtgggtggacaacagcatagccctcgaaacttccagatgccagtcacaggccctcttggcttggagttcagagcggggcgggctcctgcccccagtgtcagcttctgggccagtgaactggcctgccctctagtggtgcatctgcgattgcagcgaggtggaagtggaaccccatgatcctcccaggggccttggcatctctgctagggggaagctagttggggcactgttgccaggctgtgaatgaagtctcttaccagggagcagactcccagcctatactgagggtggaggtctccactttgctccacacctctagaaggtcttaggtaaccgtgtgatcttttgttcttcccatgtaaaggaggggacaacaggtggtttgacttctgttcagcctcaaaat

SEQ ID NO: 121829 - DNA, 1162 bp, Homo sapiens
cccggcgcgagggggtccccccggggcgcctccctcttcgcctggcatcagttgcctccctggaatatggaacttcgggcgagggaggtggagaactttcttctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcggggactggaggggaagtgcagcattatttgtgacccaagagggacttgaatgtctcaaagctggtcaagaatgtttcccccgcgaggtagcatgagatgggtcacgtggtagtaaagagccacttcgggcccgtgagatggagttctgactccaccacttgttaggtgtgtgactttggaaaacccacttctttaaaccttagtttttagaactctaaactgcaggtattgtacataacctcgtagtattgtgttcatgcagtgaagtgatgggaatgaaatgcttggcattgtactcttgtgtgttagacaccttttgcgaacctgttggatgttgaattcattcatgcttaggttctgttaggccagtgtaagtggaaagaacttgggcaatgaagacaaacacacctgggtccaaggtggtcccatccatggtatactgattgggggtttctcatccccaaaacaccaatagcagccttggcggggtttttgttgttgttgttttgagacagagtttcgctctgttgcccaggctgtaagctttgacctccttagctcaaccgatcttcccacctcagcctgggaccaccacacctggctaattttgaatttttttattttactagagacagagtctcactgtgttgcctaagctggtctcgaactcctcctgtctcagcctcccaaagtgttgggattacaggtgtgagccactgtact

SEQ ID NO: 121830 - DNA, 1032 bp, Homo sapiens
tgtgatcatggttctgcagcctcaacctctcaggttcaagcaatcctcccacttcagcctcccatctcagccacctgagtagctgggactacaggcgcatgccactacacctggctaatttttgtattttttgtagagattttgccatgttgctgaggctggcaccctttaaataatttgagcccttatggcaatttgtcttttggttcctaaaaattgtttcgtagctctagataaagttcttgtctcaaccagcattgaagccttgcctacctgataggagagcttggaaccaagaggggaatgcccaatggcattaatcattagcttctgagcagagcagtaagcttgtcgtataaatcaaatcactcactgtgtgagcttatctacagagacctctgcagcttcgcttccgaatagaaatgatagaaaaagttggcactggggctttagtgaatgtgaatggtttatatcggagctcagtttgcctgttgatgctaagagaaaacaaattaaagttaaaatgagcactgtggccctgcattagccatcttttttaaaaatcaaggtaaaagttaataaaagaaagagctttgatgagaggaaggacctaagtccaggcactttaagaacaaatacttgtttgtttataattttctgaatctccagaaggtactatcctgagttacagaatatctattgaacggcttgcttactgaagcctttgttttcctccatttgctgttcaaaaacttaggagagagtggcagatcagtaatgaataacagcaaaatcccctggcacctgttggatttttatacaaaacagaaaaagttaaaacttgaaggaacaatgaaagaacctcacatctccagtactcaatatgattgaagttaggttgctactgtttagaagcactgttttaaaactgaggttttgatgccttaaaacatttttcatctttgttaccttgctgaaataaaatctaaaagttgcattgggtataagccaggatatattgtactttgaaat

SEQ ID NO: 121831 - DNA, 1934 bp, Homo sapiens
ctaaaattcagccgggtgccatggctaacgcctgtaatcctagcactttgggaggccaaggtaggtggattgcttgagcccaggaattcaagagcaacctgggcaacatggtgaaaccccatctctacaaaaaatacaaaaagttagtagggcatggtggcgtgtgcctgtggtctcagctgctcggaaggctgaaatgggaggactgcttgagcctgggaggtggaggttgcagtgagctgagatcacgccactgcactgcagcctgggtgacagagtgagaccctatctcaaaaataaaatgaaataaaattcaaagtacatcctcttttcaggagctcatccttgtcaggaaggtagaaatacctttgtggactgcattctctaaagtttgcaaaataaacagccatcttctattattaaaatggtagctctgtatcatttctttctcccctccaaaatgtgtgacaggtctaatttctctctagataccataatttccttccattttattactaaatcctggagaaaagcccattttgaagaaaacagagcttacagctttaaaaactgattgttattttgatataccaaaacccagttttgcctttatgctcagtgcatttctgtcattgtacgtcctaaactaactaatttatattcttcccttggtacttaaagaatcaaaaaccctaacactgtacttgtaattgactggttgtgttaaaagtgaccatgtttttgtgcatctaaaaatagaacataaaatattgtatctgattttgctccaggacttctgtggtttcttattataaccccctctgctaccctttgaaattcctttaatgtcagggacatttactttaagagtaagataatacatcttaagagacttttaggctgggcatagtggctcacacctctaatcccagcactttgggaagccaaggcaggaggaatacatgaggccaggagttcaaaaccagcctgggaaacagcaagaccccatctcagcaccactaacaaaattagccaggtgtggtattcccagctacttgggaagctgaggcaggaggattacctgagcccaggagttgagtctgcagtgagctatgattgcatcactgcactccaacctggtccacagagtgaggccctgtctgaaaacaaaacagaagacttttagtatatgctatgaatttactagctaagtaaatcggatggagttaatatcccagttacgtaaagttgttcttcttacagtgttaatgaaagatgggtacaagagaaaacattttccccaaatttaagcaagtagaagctatgtaactcctgatggattttgtatgaaaaaacaacatcagaagctattcgatatttaagtgaggggggaaatgttataatactaaatctagaagggaaaccaaagtattgattgtaacctactcagatgtcataaatctacagcagagctgcctgagccccacagagtaaatgacattcattaaggctgaatgtattgttgcactaggatcagggaggcaaactgttttactattgtctgcaaagcctgaaccctccacttgagaaataatttaaataaataaatttttttgaagccagtgactctcttttggcctgacaattttttttttctttctgattagcagtaagtaatgtgctaaatccccagaccccgcacccaaacctggctgaattacctcacttggaaatggacaataaagatgccctttacgagaagtctgtttcatgaaagactggcaggttttaaagagaggagtgtaaacctggcggccaggaaggcctgggttctgatttcatgtcagacagcagcctttgtgccctctgccaagtaactttctgtggcttttcttttcttttttcttagaaaggtgaccgctggactgatggtt

SEQ ID NO: 121832 - DNA, 1003 bp, Homo sapiens
gccacatgggaagaagaattgtcttgggccacacataaaatatgctaacactaatgatagttgatgagctaaaaaaaaaaaaaaaaaaaaaaaaaagtccgtgcataattttcatggtatctgtcaccacagataagcaaaaaactcccctcattcaaagggttggacacctgcggatagcccttttctagctaaccttttgtatttccctggcccgtaatctgtatttagaatttttagtagtattttgacaaatatagatgctttcctaaggcatatcattttgtaaaaattgtattgcaaacctttttctcttgattttcccttccttagcttctcccttcctttcctcccgccccttacctcctcacctctcatttatgggtctgtttatttttcaccttaagaataatgattgttgcctgggacttgtcttataaattcagttctttctaatgaggcactaaagctgtctcctggcttttgggttttcctgagaactgttaattacctttgcactttcctatacccagctcaaaagtaaattgcagagggaagagaggaggatgcacctgtttataaaaatgtggtagttgagcaaaatgcttaatggaaaatattaacagcataacctcatataatcaactcaatcttgtctagagtatgtttactgcagttgtagctgtcaaatgtttcatgttatatatagacccctaccgtgatgcctttcatatcactcttatttgttgccactgttttcattcacaaccttagctcagatctctgccacattagctttttcattgggcttttcctgcctccatgtcaaatcctttcaatttgtaagtccaacaagcagctgctgggttttaatatgtccagaggactgttaggagtgggtcactgcacacccctcccaaaattcctcctgagtacaaagttcttacctacttccagcctttttaccataagccccagcttaattttctaaccttgtcagttg

SEQ ID NO: 121833 - DNA, 1028 bp, Homo sapiens
aggataattttatttttggcattgtgttttctgtagtcctcctctctctctctgtctctctctctctctctaacctattttgagacagagtctcgtgctgttgcccaggctggagtgcagtggtgcaatcttggctcactgcaacctctgtcaagcgcttctcgtgcctcagtgtcctgagtatctgggattacaggtgtgcccaccaccatgccctgctaatttttgtatttttagtagagatgaggttttaccatgttggccaggctggtctcaaactcctgacctcaggtgatccgcctgcctcagcctcccaaggtgctggagttacagatgtgagccaccgcggccggccaagaatgaatattttgaagtgttttttcttttttcctctgaaacttcagtgtcctatattcaatatgtgaattgtgaaatacgtgatgcgcttaccacagggtagaggatatatgtctttgtcatgctgtgggcttattttttttataagtcctttactaactggccagcgattatttaaaatataaattgagatttcatattcagaatgaggagtactggattgagtaagaggaaaatcttgatcttaaaaaatcttgaagtaaaaggttttgtttggtaaagttttcccacataggactcacttccttaactgcttacagagatggtgcttttaaagaaaacattttcttaataaaatacaaatgttttcagatctctctgtctttggtacagatgccttttgcaatatgagttcagtacacagtgtgcatccttaagccttgaatattcagatacatttttgctcttttaaaagtaattacagtaatagaattatgtttacattccagaatacccataatgagattggaaaaaaaagttcaagcagtcagtcttctatccagaagccataaattctgttattgagtgtgaaatctattcttaatttttaaatgtcttttgctctaatgaacttaattagtggagtttggtacagtggaaagaatactaaa

SEQ ID NO: 121834 - DNA, 1053 bp, Homo sapiens
ttattttcatgacccacaaatgggccatgacctcccgtttgaaaatccaattccagaggtggtttcttaggactgtgggttgactgataacgtgtctcatgcgtcgcacattgccttcctcttggtaccgggtccaaggcaggctgtacatgtccagggcattgctcctgaaggggtctcagtgccacagggctgggcaggaaatcaaggcagagctctttgtgttggctgcctggggacttgaagagctttgcttttgagaactttggtccttccctgaaccggctgctgcagctgacagctctgcctgagtgggaaagtttaaacgaggacaataattcagtttgagtgcccctgaatcatgtctttgtctctgctcttgacagaacagaaggaagtttttcattattaaggatgccagctgcccacagattgatatatctgtagccagggctggctcactctcaagtaggtacagatctggctccccagttggtatattttgaagaagtccagaaaatattttccttaaatgtctccactcagtctcctatgcctaaaatttcatgattagaagtttggtcttttgcatcttctaagtttttggtcttctagaattccagatcaacataaaaacatcattggaaaagagactaccttaggattgtatcaggtaatatataatggggatttggacagtgctgagagcaaggcatgcccatttcgttggagctggggatacaggagcgaggacctgtggactagagaatggtgagcaggaggaaatggagtggaggaggccgcagggcaggcttggcctggtgaagcctgtgtctaacggtaattggaaagctccatgaactgtggagccctttaaatttattaatgagaattttatgaagaccttgtgacttggggtggacttcagcaaggcttagtgatgaaggaaccaacactcaacaagagtgaccagaactcttaggccacttgctactcagggattctgtgtcctgggttgtccactgtgttttgtttaacaaatttattcccatg

SEQ ID NO: 121835 - DNA, 1010 bp, Homo sapiens
aactcacctctgcggtttagaaaacaagagcagggaaggcttctggggagaagtgccatctccgcttggcctgtgtagtgggtcaaatggtggccccccaaaagataagtccatgtcctaagccctggagcctgtgaatattcccttattttaaaaaaaggttttgcagatgtgattaagatgaggcagtcatcctggatcgtttgggtgagccctaaatctaacaacaagtgttcttttaagaggcagagggagacttgacatagaacaggacaaggccatgtgacgagtgagactgaaataatgaggccacaagtcaaggaatgttgttgcagtcatcagaagctggaagggttctccccaagagcttccagagggaacacagctccgccgacaacttcattttggactcctggcctccaaaactgtgagggaacacatttctgttgtaccaagccaccacatttgtggtaatctgttatgacaatcctagaaaatgaacatggtctggattttcataggccgaaattacagaagggatggtgttgggattcaggacacgtgaccccaaaatatttcaagttgaagaaacttgagaaaactgcagatataggagggttgctcttacttcccccacaacccctgcccttttcccctgaagccgtccatacaatctaggaagaattgtctgaactttccctgaagcaggtcttgagatgcttatgtaagaagtcctctcctttgtagggacatggttgaagctggaaaccatcattctcagcaaactattgcaagaacaaaaagccaaacaccgcatgttctcactcataggtgggaattgaacaatgagaacacttggacacaggaaggggaatatcacacaccagggcctgtcatggggtggggggaggcgggagggaaagcattaagagatatacctaatgtaaatgatgagttaatgggtgcagcacaccaacatggcacatgtatacatatgtaacaaacctgca

SEQ ID NO: 121836 - DNA, 1043 bp, Homo sapiens
aattctccctgaagatgaagggtcacagagaagaatctgcacaaacaggtcgtgctgtgtttcctccagtctattaccattagatcctatcgcctttgtccaatcatacttcatcgctctccacttcttcatcatacccagcataaaaaaatacatgtttccctattgctttgggtctttatttccttatgaagactcccacgtcacctaaaacttacattgaataaatgtgcatgcttttctctggttaatctttcttttgttatggggcctcagccatgaacctagcatgggtaaggaaagatgcttttcctccctataagggcatttctggagagagcgccggggctgggagacagagccctgtttgggaagagagaagggagcagcctggcctgagcgcggattttgtgaaaggcatgacaggagatactgctggaaagcatgtagctgacctggtgcctttgtgatggtttgagtaattccttgtttgtagaggatcatttggtagttcattgtgctgcctcttaggtaatggctcttaacaccgggtgacccagcaaaaaacacagggtgaggtttgtttgttacccaggtggctgtacttgtgtgtgtttgcagggagagtaatgctccctgatatgtaaatgctccttgattttgcctgctgaagacaaccacgcacaccccactagagggttgccttagccactttctgcattttgttcttgaacctgcacttctcactgctttttcctaaacagatatatttttgtggcattttatgtccttgaaatgatcaattaatgtatactcattcctgtgaggtgtagtaaacatctttaagccaggtgaagaggttcgtaacatgaaaccagtccatgcctctttcagagattcacaacaggccctccccattctagaagaactggaccatttggtaccttttttttctttagtgagctagaatttaagaatgagtacattttgggacctaattaaattttatatctaccagttgagaaatagccggtgaaagtctt

SEQ ID NO: 121837 - DNA, 1068 bp, Homo sapiens
aagacttaacgattaattgttttcccttatggaagcctaaggcttgtttctacgtatttccagggttttgttctttaaggaacacatgcttatgaaaaaacacaaatactttcagcaaaaagtcttctgtgtctcccttcctcaagttgagcttggagtcagtggagctctgatctgcatttgcatttgagagggatgccttcttggcaaatacagcatgccagatatgtcagtattgggttgcttggaactccttaagcttacttaaacattctttagaaacacattcctttgaagagctcagcagagctcccagccacgagaatgctaggcttattcacagcgtggcttttactctctgtaactaatccacagcacatctctctggaaggaagcaaaatttagcaagttgcctgttgattgtgtaccatacagtatttttgcattaaagaaaactacttatttcagatacctggggaggggctttatggataacatccatgtggagatgcttgaaaatactgtttgttacaccaaagtgaatgggtgttttgtgcttgtgtgatgcagtaactatgattcttatttcatttatttctcatttagaaggtgtcgtggtgctaagtctctgatacaaggagttatcttaaaaaaaaaaaggcagtgacttgaactgagtggtaggaataataatatgtcccatctcatcacctccccacaggatttatgtgttcttttaatgggtctggtttgtggatcgtttcaccttcattggtttccagctgaaagtgctggtgggcagctgctgcagatgattaacactttcacctagcctcccatattcttattgttaacattaaattacacttgccttaaatctctttttattcagtttcttcattggttgttagatgtttgtaacttttttcccccaaggtccaccatgtttcttcatagcaaccatggtaattattaggatagtaggcatatctggggtttacactgcctgtttatttgaaaaatattttttcagtttcaggtatatagttatttcaaataatgtaacat

SEQ ID NO: 121838 - DNA, 1033 bp, Homo sapiens
agccactgagatttgaggcttgtttgttactacagcataatttagcctatcttgagtcacataataatctctgatgtgcctaacgttttaaggggcacattagcaaataggttggccacttaaaagtctttccaaatagttttttttttttttagcctcattgggaagcattcatgttattctttatatacagaaagcacctggtactgtggcaatagcatagagcagagcttgagatggaaagttctgttttttggtccttattatttttgctaattcaacagctttattgatatctagttcacataccataaaatttacttaaagtgtataattctgtgggttttggtatattcatagagttgtgcaacaatcatctcaattaattttagaagactttcatcacctccagaagaaacctgtacttattagcagtgactcctatttccccccaatctccccggccctagtctacaagtgatacaatttctgtctctgtatttgccttttctggacattttatataaatacaatcatataaaatgtaagttctgtgaaggatcttggctttgctctatgctgtaactctgtacccctcacagtacctgtacatagtaggtgctcagtgtatatctgttgggtaagtgagtggttactgaaggtcggagtggagagccggatggtgatggctggtgttgcttagcattgccctggacagggaataaagggagcggtagaatcacctgctgacaacatctcctcttcatccagagacttctgtgtcagggcttattataaggatgtgatcataggcccagtgaaagcagctacccttgacatggggtaagtcatctataaaacaccgcattgcaaggctgaggtcatgaaggggtacgagtgggcccaccacagcccgattcctcttcctccgtagactcttcccaaatacacacttttctcaggacctcactggattccttctcctctcaggttcctggcttcccttccctggctacctggccagggctatggc

SEQ ID NO: 121839 - DNA, 1004 bp, Homo sapiens
agaggcgatctggctgaggctggggaatgtgcaggactgtcctcgcccagggctttgggagatcccccaggaaaagggttgtcaggactggaatgtccacccaggagaaggtctgtggattttccctacaaaggactccccaaagactgggttccaggcccctgagattagggaagaggcaagcccaagagagaaagctccatcatctaccacagcaaatgcagattttctctatgaagagaagaccaagccttttgctatgagatcagtagggaaagggcacagggttaacctgggactattcacagaagagtcttaagctttgtaatttctcaggttattttggatcctgcctcctgaagactgctgaatctcagctaatttttgttgtagaaataatttgcctatgataataatgagactatcctgagagagatgtttattttaagactgtttaaaactctcaggaataaatatccctggggctgattctgggcattaaaaacacaattcaaggtgagtttcatttctcttcctgcggccttcacattaggaacctctttttacaaagatgtggcagaattttgattttaaataattcataatgatactgttgacaattttgtatgtttgtcatgtgacataattattggttaaggaatgtagtggaccaaacttgctcatggctaatctgtggctgaaacttaaaatatggacaatatccaatttggaagaaagccttagctcggaaataatcagatataaccaggattagggagatgctgactgaagataagctgacttcagacagggtattcttgcgaagcatgtcctccacctaactggagcattaccttccttaggggtcagagtccaccaggttagagtgcttcttcctgccatggactgcacatgcacatggctaatcatcatgtatgatgacatgagtataggagaggaccctcagggcctccctgatggccagctgtacctgaagtcctcct

SEQ ID NO: 121840 - DNA, 1035 bp, Homo sapiens
ctgcccccaccactcagtgtttccctccctgaaggcacctgtcttacctgcttcttacattgttcctgagatatttacgtacatacactcaagtagatgtatctctgtgtgtttccccattttatacaaattgtgggatactatactctccttcattttaattggcttaaccaatcccctattgatggatatttagattatgttaatctcctgcccttacaaagcatgctgcagtgactctgtttggaggtcttattgcacagtacgattatgtttgtgggataaatttctctaagtggtacttctgagtcagagcatgcatgcccttgcaattttgacagctagagctaaattgctctgcagagaggttgtgccagtctatactccaccagcagtgtgtgaggagcccaatgggactgacctttaaacacacagtgccagtggtacactgggctccctctgctgcctctcctggcccttcaccatctgagctcatcttacctttctagccttctctccaggagctctctgctaaggtgcatttggcctctggcctcggttcctcttcacttcagcatgggttttgcagaattttctctgggaatcccagctgcctgggaatcaaagggaaaagtgggggagtgactgatgggaggggaatagaagagggggatctccacacctctcctccccttccccatcctccattccgaaatggaaaatggaattccttcccaagatgcctgggtcttttgttctgaccccaagtattccagtgtgttgtcacatccagagcaagggcaggagcccatgcagggctgctgcagtgcttcgttctgctccgggttagcacatccacacactgtgtggagcaggtgtcttttcactgaaacaaacagggcattgagggtatacggttacatggcaagtcaaacaaaatctgcttgtgttctacaatagctagaagcatcactctgtgggaagaaaatctcaactgggaaagcttaggcttttgtagtttatcatcaaaaatct

SEQ ID NO: 121841 - DNA, 1026 bp, Homo sapiens
ttgttctaagccaataatttagggtatgtgggtgaataggtagcagctctgcctagtctgcttttagctcatcttttcagtgaatttattgagcaatgtgtaagaattataaactatgatgaagtgaaatttattccaagtatgcaagactgggtcaacatcagtgtaatctaccatatcaacaagtgccttagctcaggctgctataacaaaataccacgtattcggtggcttaaacaacagacatttatttttcacagttttgtaggatgggaagtcttaagatcacggtgcctacagattcagttcctggtgagtgctctcttcctagtttgtagatggctggcttctctctgtgtggcagagagaggggtctctagtctctcttcctcttataggggcactaatcttatcagggccctaccctcatttcctcatccaatcctaattaccttccaaagggccccatctccaaataccatcacgttgaaagttagtgcttcaacatatcaatttcagggagacacaaacatttagtccataacaagctaaacaagaaaaatcatctgatcatattaataggtacagaaaaagaatttgacaaaaccaaacatgcatttggggaaagaactctcagaaaaccagaaattgaggaaaactttctcaacatgataaaaagcatctaaaaaaaaccaagagctaacatcatatttgatggtgagagactgaatgtttttctgctgtgataaggaacaagacagggtgtctgctcgttcactatagtgctggaagttctagccaccacagtaaggcaagaagaatgcaagcaatttaatccccaaagaagtcctagacatggatggtggtggtgcttgtgcaacattatgaatatacttaatgccactgaattatacacttaaaaattgttaaaatggtagattttatgtatatgcatatttgaccacaaatttataaatcacaaaaaatgggcccaagaataagcagaaaacttagtctaattagcat

SEQ ID NO: 121842 - DNA, 1827 bp, Homo sapiens
ctgtagtcctagctacatgggaggctgaggcaggagaatcgcttgaacccgggaggtggaggttgcagtgagccaggatggtgccactgccctccagtctggcgacagagcgagacttcatctcaaaaaacaaacaaaaaaggaattctcttatcaattaaacccaattgttaggaataactgattcctaacaatatacatttcaaatcacctctccatatcatttatgattattattattttacagggccatcctaatacttccatccttgtgtgatgggactgttggcccccagtgcaggaattaccctctgcccccattacattttatctttttaaaattagcctattccaatctgagattgttttggatcctgatttgtgtcagccaaggaatttattcccttgccgtttcttgtcaactattgtctgattaagatatgatgtgtcactcatgtaagtagactagtagataaaatatatttgcaacaaggaaagaaaactctgaaagcttcttaaattataaattgtttttaaatgtaaagttttattttctttgatcgatggtactttttcaatttttttctcgaatgtgttccatttttttcttgaatgtcttcataactttgtcttcattgaatcataagcctgagaaggactttgaacttttctgacccaaatttacaccattccaggctgttgaagctctcagggaacaccatctatgataagaggacccttggggcacttagaaaagttggtggagtcttccactttttaaaatctaaacgaggagccaggtggccagaattccaccttgcagttcttgcagttctgccagaaataagattggaggtattgagaattcatttcatctcttcagccaaatgaaactctcaaagactcttcccattctgaatatcatgtttgtaaaatatgcgccactcttattttagtaatgttacaactttcttgcctcctactacctctctcttaatgcgacagataatataggcagactgactcaaaaaaggcttgactcaaaaaagactgcatgaccctgatccaatgtatttctcatggtctcttgaagaaaagaagctttatgaaatgattacactaatttaacctaaattcttcccattacaccatttctccttgtctgggtcacagcatgcagctgccctccttgttacagtccccagtagagatggttaaattgttttattgtttgagccaatgagtctcaattcctttatacaacctttccctactcccttccttcagattttctgcccttttattcctttggcttctgccccaggtctccttttgactctggtcataagaatatcattgagaccaggcacggtggctcacgcctctaattccagcattttgggaggccaaggcaggtggatcacctgaggtcaggagttcgagaccagcatggccaacatggtgaaaccctgtctctactaaaaatataaaattagctgggtgtggtggtgcacgcctgtagtcccagctgaggcaggagaatcgcttgaacccaggaggcagaggctgcagtgagctgagattgcgccactgcactccagcctgggtgagacagagcgagactctgtctcaaaaaaaaaaaaaaaaaaaaaaaaggtgttccaggaatggctaagcaccacacctttccttctcacttttcaggtgcattctgttgggacgggtcttgtccaggtctgctctgttagacctgtcattcctgggacaggtactgttggtctgaaaggcctgccctttagtaagtagggtccaagatactgaagcagg

SEQ ID NO: 121843 - DNA, 1031 bp, Homo sapiens
gggatttttgcctgtgtcctgtctcagcataaagagacacacacatgcacattagtgagtatgggcaagacttgccggaaatgtgtgtcaatgaccaaatttaccattggagaaaaaatggggattaaaaacttaatttttttctcatcttaatttctcttggtcagtgaatatgacatggaaaatgatctattcaagttggggagttgggggaagacacagatctcatggaatctaagaaaaaggaggcctccagaaagagtttactctgccaccatgctattattgagacatggccatcaaccaactcagctctgagtctattcattcaggttatctagagatggactctgattggctcctctggcatcaagtggccaatcctgagtgagtcagcagtggctggggtggagtcacgtagtacagtgggctgccctactgggtctttggagaaggtggttctctaagaaaggaccatataaattgtcctccaacagctattaggaaaaggtcttttgataatacagttgaaaactatttttagaaatggttgcaacactaattcatgtagtagaactctaagaaataagaacttttatggggaacacagaatgttggagtgtttgcacttataacctcttccaaattcacctttaataactgtagttatagagtgtgattcaaatttcacatcttcagatatgctacagtgtggtttactaaagtgcttctagttttctttgggtctgtgtataatgtcataaaacttggcaaacacacagtaagaaggacagtacttgcaaagaaataactatgactgttttatgcatgggcagaaggccatccagtgtctttcataaatctctggttatatctggaacttgctgggtcatcaaagatgttattttcaaaaaatgttgatttagctttaagccattgatttctaccttaggtcataatacttttttattttcctgcactatggtcatcataacattctcaactatatcatatccttagatgacaggaac

SEQ ID NO: 121844 - DNA, 1072 bp, Homo sapiens
tgggaagagagtctgtgacagggacagtcctgttactggggtattgtttctgctcagacttctaataagtagcggtttttcctgatgctaaaagttatccgtgttaaatataaaaagctggaaaatattaaaaagtataaaaagttaaaagagaaaaatcctttcatggatttttaaagggagactttttaattttaagaaagcaattttgagttttaactaggattttttattgtaataaaatatacatagcattaaatttactgtctgaacatatttacgtatacggttcagtggcattaagtacactcacattgttgtgcaaccatcaccaccatctatctttagaactttgtttcagattacatgtttttaatgtgcattgtttgttacagatctggggagtttagtaagtagaatcagtatttcgttaaggttgtttataggtagcagtgcatccttcttttaaaaaatctgttttatcttatgatggcctctgtcctcttttgggccaagcaccagggacgccccagaatgttttctttgcccctctggtgctctgccaggaaacttcacaaaactctgaccagccacatcatagaatccaagaaggcaatggagggaccctgggatcatccagggtgacacacctgaggtccagcagggtgacaggcttctagcaagccatgcacagcccaggcctcctgaccccttgtctcgtgctcattgctttccaccagaacatttccacactgcccacccatcctccctttcaaggctggaccacaggctcagcttgatttacctcaacttagcttcctgaggacctgtcagagataaagggtgctcttagagacttcagaactctcctgttacagtcttgacctgcttacctctgggagtgtttcatccttcactcaactgcaattaggaagagtcaagttccctttggcgcctaaaggagaacaacggccggcaatcccaggaatccgatcatagagaagagggctcagagtgcagcataaatcagtgaggatgttgtcatgaactctctgaagaggcttcttagaaa

SEQ ID NO: 121845 - DNA, 1045 bp, Homo sapiens
ttccttctgtagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtcaggagacacagaaagcagcccagaggggtggctgggaggcagggtggcgagggtcctggcagagcgtcatgcccatcagctaaaaagccactcacttggctggctggtttggagccagagcacagaaattaaatctggctaacatcagacataaggtgaatgtgctgatatatttcttttgacatgtgtggcttggagtaggacaccatgaggtgaaacaaagtggggctctttgcccaaatggggtgacatgggcgccaccgactggtgtcagtcttgcagaggtcaaagcgttcaggggtgttgtctcttcctctcttacaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggtacctgcaaagcagtgtcaggagaagggaacataggccttcagcaagggtttttgtttaacggcattcctgggggctgataggcactttaggcattgacttagttgagcacaagctttgaaggtaagccagatggcctccccacctgcacggtgcagatccactcctgctgctaaggccaaggcagacagggtgtgtagctgcagagcttgctgcacaatcctcaggtgactaggtatcttgaggccccagggtatataaaagcaccttgaggagagggaccatatcttaccctctgaattttagtgtctgctacacccaaaatttggcctataagatgttccaaagttatgacaaggatgagcctatctcttccatcatctct

SEQ ID NO: 121846 - DNA, 1750 bp, Homo sapiens
gggattcccttcaacctgttcaatctgaaatatggcctggatcactcagtcatactgagaactcccagcattcatagtattctgtcaagtaccattgtaggcacttgtaagtattttctctattaatctttgcaataagccagtgaggtagggatcattattcccactttacactgaaggaactgaaacacatagaggttataggtaatgagtgggagagccaagattcagaatgaccatcctctgtgggtcatcatttccctctatgcaaagtcagtgcaggtattgcagccttgataatgggtactgaccactttgaaatggagattaggtgttgccacacttaacttatgtctcagtagctcctcacagcaagaagcatcaatcatcttagtgaaatatgcctatagggcagttctgttccagggaagcattgtctctgtgggtcacattaaggccttgataggaaggtaaagatttagtgtgaatgattccaagtggatgatggggagacaccactgtagggaaagcagattttcctgtctatcccttttcctttttttcagtgtccatcctcctggaaggggcactcagaaagacatctacctccttcttagtagagttctgaaaattctcttttacttagtaataaaaggtaggttcatatgcaggaataagacacaggagatgtaaaagttagcaaaagagatcacagaagagctagctaaggatgctggtttaatcgctgcctccccatttcaaaatgtcttttgttgacaggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttt

SEQ ID NO: 121847 - DNA, 1983 bp, Homo sapiens
acgcctggccctcaaggtcactttttattcgatgtctacagcagaccattcctatcagtgtaatggattctaggtttcaacatttgtggtaccaggccaccaaagcctttgggtttgttgtgactatagtagccttactgatgttattcctctacttgccaaacaaaaaaatgttttctttgggaatcttgatgcaaaaaatagttgagaggctctggtttagaggatattctgattcctaaaatcattaactttctaattcacagcttgcatttgaatctttggctgtgattggaaatgctctaaccctcctggaagtgggtcagattgcagtgtgtaggtaaggttgctttgtaattcctttatgaaaacttttcacaacctgtttggttattttgatcacacagccaaaaaataactcctgttgtatttggttttcctcccccaagttttggagaatctgtaaagctgttacacccatttcatgagcagttcagtgattactctgggtcccagattctacgtctctgcaaattccaacaaaagaaaaccaagattgctcaggtaagaggatgaaataaaatgtcttctgcacagttatttttaaactggtgtaggttggagggagaacatttttatttttgagacaggaccttgttctgtcacccaggctagagtacaatggcgccatcatagctcactatagcttcgaactcccgggctcaagcagtcctcctgcctcagcctccctagtagctaggactacaggcgcatgctaccatgtctggctaatttttattttttgtagggacagggtctcactttgttgcccaggctggtctaaaattcctgggttcaagtgatcctcccttcttggcctcccgaagtgttgggattaccaccatgctgggctgagaaccaccctccaccgcatacagtattaggacagggatagtcccaaacctcagcctgtgtaccactggaatagaagcttccttagcatccattataaaacaaggtgtgacttctttttctcagttcctcaaggatcacttgactttgcatcattggttttctagctccctacttttttttccgagtagtttggaacattctgcaaaaacaaacccatctcccatacccttatcagctgggccaagacctatttttctccctcattaagcttagagaagaaatgatatgaagtaaagccagtgacttacttaagagaacaaaagttcaaaacagcatgggatcatatttctcctgggtcctgctctgattcagtttgctttttctaggctgccctggacattttgtattttcttgccttctcttttgctcagttgttttctgttcttgaaagaagacagctgtttggtttatttgagggagtattgatttcttatgccccagggaagcacttcttttcctttggggtatcttccagaactctagtgggttatatgttagagaaacgtctcacctgtgcttgagaatgcctgtatcatctaggcatggtggctcacacttgtaatcccagcactttgggaggttgaggtgtgaggaccgcttgaggccaggtgttcaaaaccagccttgtcaacatagtgagacctcatttctacaaaagacaaaaataattatccaggtgtggtggcacatacctgtagtgctagttacttggcggcaggctgaggcagagcccaggaatcgaggctgcagtgagatgagatcgtgccactacactccagcctgggtgacacagtgagaccctctctcaaaaaataataattaaaaaacagaatgtctgtatccaaggatcctccttttttaactacatacggccagaagggacagttagttgatggtctgtaaacctgaggtggttatctgataatcacttcaatgtcagaaatactatcagtctctttgacaatgagaagagcattcacatagttttctaattgtctattcctggtt

SEQ ID NO: 121848 - DNA, 1817 bp, Homo sapiens
ttcttttttttttttttttttttgagacggaatctcgctctgtcacccaggctggagtgctgtggcgcgatcttgacccactgcaacctccgcctcctgggttcaagcgattctcctgcctcagcctcctgagtagctgggattacaggtgcctgcccccatgcccagctaattttctgtattttttttttttttgtagagacagggtttcaccatgtcggccaggctggtctcgaactcctggtctcaagtgatccacccgcctcggcctcccaaagtgctgggattaccaggcattagccaccaccctcagctggaaggagagacatttttaatcaagtaaattacatggtagcttgctgggagaagatttaaagtgcttctgttgagaaagttcatgcaggtcattttctaccactttgcttaaagcctgcatcttgctagaagacttggttggctctgacattctgagggtaacttacattttgttgttgtcacaggagaaggttgcagctgagatgtggcagagttacctgatcttaacagcgcctctttcacaacggttatgtgaagagcttcgtctcatattagagcctacccaggcagccaagctgaagtaagtcttcccctctggaaggcctcacagtgccctgagaagacggcagcttcattgattctgttgaacgcggcacctaaccatttatagtgccagcttctaggctgccgcttgtgccgtacaggcaccagtatgctgttccttaccctgttttcctattattgtctctgcacaaaagtttctgggtgtctgtattgatcaccttgttacatgttgagctattcacttgctataggtgttactcacctagatcttttcaaagatgtccaaaatcattcctatttagtgcattttttcctaatttttaaaaatgtgtctggaaggacctaattattattgccacatacgtgtccagtttttctggctagaggtcaagaagatccttagtcgtcaattgacagaaacacttcattgtgccaggttcctagttacttgctattggttttaaggtattattgtgatttttgtccttaataaaaattctcaggaattaaaagttgttaactaatttttgcccccatttgaataaatagaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcaggtaaggaagagaaatgcagtggcagtttgataggaaattaacatcaagctatgttccatgggccaccaaaatgctttaaatatgatatggctaatgctttaaatatgatatggctaaaacattttgaaatacctgttaggcctgttttgagaatgtgataaccatctttgataagacctaagatttaaagagttcaaaagggcaattttaggatgtctcagatgtgttagtttcttactgttgtaggtcttttacattgttttgtttcttgaccttgctgtttgttcttaactgtctagttgcagaataagtaaatctgatagtgcttgttttgcagaaaatgcaacagtgtactcttaaaaaaaaaatcaaagttttcagatattactgcatagtcttagatagtttaggtaggtatctaggatacatttcttttatatctgaaattatccagagttattgttctatcagtgctaatattaagtttaggagc

SEQ ID NO: 121849 - DNA, 1930 bp, Homo sapiens
ggagcgttagaactgttagaacggttgactatcctatgtgacaagccaggctttgcctctcacctcacaagttgaagcaaattattgatcttttctttgcctgtttcctcttctgtaaaatggaattgtggcttttagtttttatttctgtcaaagttttacatgcatatagtttcaagaatcatacagttttacaaggcttcttaggacaacccaaaatttcccctatttccctttccaagaacatctgccttcaacatcaggtgaggaggaggggagtttagagagtaagggttggcaatgagtgtctcagagagaaagaacctctgaaatcaacatgtggaaatgtgttggagagtgaatgaatgaagtttgattaattttcaggattaacaggcaatagcaaaggcttggtcagtcatcaggctaatattataagtaaaattatgtccttaaatgaaaataggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccaggtagtaaaactcacaaattactgcattaatatagtgttaataaattaacaaaataaaattttaaactggttttaaatctttgtctttagaactttatggaacatctggttgttgaggggtttcatgttcttattcaaaatttttaggaatactattggtatgataggtgttcttcaagcacgtgatactgttccagcaattaatcacagggtcacagtgccctgacctgtctgtgatggtgggtctggtccttggcctctgggactcacatcccacttttctaaccatccttgtgtaaggaatcttcaggacaattaggtttgtgatggttaagtaaaaaatctttggcttagtgcctgtatttatgaagagctatttaattaagttcttgagctaagagtttgacttatttgattaatcagataacattttcattattgatgacttaagggtgtttgggttttgttttgctacagtggctttataaatgtttaaagttttctttatccatattgtctctctaagagggaagcagaatgcttgtctggcatcttctcattgtgccactgtatttgctgaattaagttttgaatctcaggagcatttgactatgtactttgagttcatactgtagggcggaagacacccagtgatactaagttggtgattccaacctgggccacctcttatctatggctttttctttttagccctttttaaaagatgtcaatgagctaagacaggagctggagagacagctggaaatgtggcagccacgtgaatctggaaacccagaggaggtaagtcactgctcactgtttttttcataaaatatctcgactttttttttgtttgttcaacatatagcaaacttaataggttcttagcaattaccttaacaaaaaggaccaggcatatggagaatataattacaatcctaaagcctacagatctgtccatcagtttctggctgctttgctgttagatctatagcttaattaaaacagaaattggtgtgcttaattcctttaatttctgttgctggctctgtaatggatgttaatagttgtgacagtggttgaaaaaccgggcaagagtctatgctgtgccatcctaagaagaggccagctagatcactgctggctgacttaacgtggtagtgtggattaaccagcagtcttatttttaatgactttgcatctgaaatttactgtattatatacacatttcacttttatatctattgtcataatcactcccaccacatatatgtattcagtgctctgccatagttggcaga

SEQ ID NO: 121850 - DNA, 1827 bp, Homo sapiens
cagtaaagttaaatgacaacctcaagtgtacatagctggttgatgatgaagcctggtttctaattgaggtctgtcctgtctttggagtgagacataatattcctgcaaagaactaagcagccttacaaaggcccctgagaggttaacataaggtctgtacctagacactcctgtttctgcctgtaggccaggccttagttacggtgagttccagggcaggcaggtaggcaggagtgattatatgactgagaataaaggacagcagtgagagaagttgtattcaatgcagcacagtaaccagggacttgtaatagcttctttcacctcattcttttgtggcttggatttcctaggaacacggaagtggagctgcagatgcaaaccaggcagaaggccatgaatcgaatttcattgcccagttggcctcccagaagcacaccaggaaaaacacacaggtttctatcactcctcagctaaacttaggtgaaggcagcatgtagaaaaagatgttccaaacgtagtgctttaaaaaaaaaaaaaaaaagctatactcctggtttttttgttgttgttgcatcagatatgatagcagccttggtgagcagaccacgaccatggggtttacccagtgggatcccgtcacggcttcttccctgcctgtgtctctccccgacccctgattccggccatgaagtcttaagagccaagtgctgtgtgcggctgcccagcacaaaccgtctcactcttttcattgtccataggcttttgcttttttaagagtaagtttttttttaagtagggtataatttatgcacgtgatgcaaaattagtgtaaaaaaccaatcccctaaaagcctacatcctattcctgtccccaagggaccctcctcagagcaaattggtgttaccaattccttctttcagagatattttctgcatatatgacatatatggatgtgtgaaagtgtgtttctttgccttcattttagatataaaagtatatcatagagattgttctatgtaagtatatagagtcccggttctttttaatagctgtattgaattccattcttgtatggctacacctgatttacttatcctgtcccctatagatggatattatgtttactttgagtccttttgtcatgacaggcaaggctctgatgaatttccttgtatttctcagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatggtacggtcctgggaaagctgctgcctttgcccactgagctctctatgagagcttgtgctatgtgacctataataatgatacgtatttgtggggtacagtgtgaggttttgatacatgtatacaatgtttaatgatcaagtcaagtcagctgtgcctggcagctgattgtatacacttatatcaggggagagaggaaatggctttgtaaacataagaaatgtgcagaaatacagtttgtttttggtacaaaggtatctgtaaccaagtgaagatggttaagatttcttggtttagtataaactctttaaatatccttaaatataatagttaaaaataagttgttcacatccaaaccccgatatcagggtttcttagtactggacatttctttcttcttagtcacctctggataggtccctgcactgacaggtgctat

SEQ ID NO: 121851 - DNA, 1686 bp, Homo sapiens
agaatatatgttgctgtgttccagtaaaaactttacttgtttttggagacagggtcttgccctctcacccagactggagtactggggcatgatcatagttcactgtagccttgacctcctgggctcaagtgatcctcctgcctcggcctgctgagtagccgagaccataggtgtatgccgccttgcatggctaattttttattttttgtaaaagatggggtctcactatgatgcatgcccaggctggtcttgaactcaagtgatccttctgtctcagcctcccaaagtgttgggatgataggcatgtgccacagtgcccagccagtagaactttcttcatagaaacatgtagaggccagatttggcctgtgggtcacaatttgccactcgctggtttagagaattgtaataagacaaaacttgcataagtagctcccagcttaagaaatcatgtacgtttcaaaaattctgcactcctcctttttgttgtatctatacagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggtatcatgagatgtctggctttttatgttaaaaataatgaggaagaggagaagtcaccttattcccattagaatcccttttaggatactcctccatcaacatgtggcacttccgaggagttctaggtttctgttttaagacccttagtgaggagtggggaagcctgcttgttgcaaggtctcccaccttatgctgttcccccagagcatttaatgctgtgtttgatttctctgccgaaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggtgatcagtggtttcactgcagccgccagctgcctcttagtagggtctcttctccctgtccgacatcacattctgtgtagcattagttggtttatgtttggttattttgttgtttgttttgttgttgacatctaacagaccacatctcattctttaagcaacgcgtgactgaacagttattttttaaagacagggatacattctgaaaaatgcctcattcagcaatttcgtcattgtgcgaacaccatagcgtgtacttacacaaacctcaatggtagagccaattgcccttaggctgcaaacctgtacagtatgttactgtactgaatactgcaggcagttgtaacacaatgtaagtatttgtgaatctaaacatggaaaagatatagtaaaaacgtgttattatcttacaggaccaccagtgcacatgcagtctttccttgactgaaacgttgttgtgtggtacatgactgctac

SEQ ID NO: 121852 - DNA, 3043 bp, Homo sapiens
ttgaccttagtggcagttggcctaaggcacataggatatgaccttttgcaaagtataccctgtgcaaagacaaatgaagacaattctgattgagacctgattttaggtgttggaaaaaatcatagcagtatattgaagatggggaggacccatggaaaccacctagtccaaccccatcatttcagacataaaactcaggttgctgagtcccataatggccattcccccagcaccaaaaccagacatcctcataggtatttccttactctttttaccatctgttcacacattatagacttccttgtacctctactttgcaaaacacagtaagactatgtcagtagatctaaaggcatctgcccgtagggtgtgttctgtagaaaaaggcaataaatctcaggtggggcccttgctagggaagcgggtccacacctctcttaaatacacaggactgggtcagtttggagatctgcctaagctcagtgccttccctttcagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggtaattcaaagatttctcccctcccaaacaagctgagaggaggtaatctgcccacaacctaccattctctgtcatttacttctcttctttttctgtatttgttttgttctcttttttctattcctctttttcttttttctatcctatcttattgattacattcagagctaagagtagcttgacctgagtcatcccatgtgttatgaaggaggatgaacaagaccctgtgcagatgttctaagctgattctcctataggccactgattttttccagctcccagcttgggagaactccagggctgagtgtaacactgcaacagcccagggtgaagcaatgaattatcaaactcaccccaccattcacacacttaataatattgctgctgtcatggagacctgcactgttttctctaggtcacggatggcactttatcagccatccatgggataggtccaataggcagaaattatgcatgtctaaaagtcaacccatgcagaagcagtttcttggattgagtgtgatgattgttttttcttcctctgacatttaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgaggtaatgaagatttgaaactgatccgctctcttgactcaaggccagagctcttgagctgtatagttctcaaggtgtctcaagatattttttcccctgttcgtcgactgctctcccattacctcataaaagaatatgcaacagaggctcttaacaggacataaaatatataactgttggttcctgacagggtagtccacatgttgtctgggctcatgctatagatcagaagctaaaacctgtgatcccttgtttatttcttcttgtaagtttcttcgagattaagtaacatagcaccatttgtccttggataacctgcacagaaagtgaaatctgagattccaacatgaaaggtctaaaaataaaatactaatgtgtgcagataattttagggaatagatattgtgttctctcacagtgtaaatacttagagctgattttatgggaattctactttttaaaaaaatatttgtatttttattttatccctgttgtctccattgtcccaaagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaaggtgcgtctttcagaaacaaagagaccggttagaactcacattagtgaacagtaattgatttctcttttgaaagctagctcagtgtcatggccaggtgataaatcacgtttggtaggctcaatcccagtctgagaaaatggtttgcctttcctttgtagtatttctcatgtgattatccctacagctcatcaaccagcaggtatttctcaaactactgtcatgtcctattctcgcttttggcactgctatgccctggtggtgcttcacacacagcactgtctcttcacagccattactgtgtatcccatctcatgggatggtgtaaacgctgtgcagtctgggtataccaagctgtcgtggagtccagttatagcttttttagggaaatgatggtttcagttattgattgtcatgtgtagtgaggaatgagactaaataatcccaagagaaatcgcatggcatatgacagtatttcgtgcctttgttgtccatttttcaaccctagtgaatcctttagggagtgttatctggtattagttgaaagcattgtgttggaggtgcccctgtaacagagggccccattcctgctgctgcttaatcagacagaaagatgtgagctggcctcgctgataaatgagtcagttacatagttataaaatctattttaaaaaatgtatatgtatatttttataatgctgtattagaacaaaaatagcaagttacaaaggaataaataagaggtgccatttatgtaaaaattaattttggaatctagttgcaaacaaagtcaattaccaagaaagcataaaattaagaaaattaaaatccactgagaatgtaatatgctgtctgcttttaaatagccagactcgttttgtaactaaggaacaattatttaaaattgtttgctaattaaataatagataatgggaaaaaaaaacccagtaggctggttgcagaggcttgtgtctgtaatcccaacactttggaaagccaaggtgggagaat

SEQ ID NO: 121853 - DNA, 1535 bp, Homo sapiens
aaactccctcctatgtggtcgtattctttgtctatttctgaatgtctctcatttaaataatgtagttcaatgggaaaattaagcaagtaagccaaactgtattttcctatcaacattctgagaatatatgtcctaaaagtgggtttggcttgttaaaaatttttctaagtgtccaaattgtattcatatcttttctgagtagttcaagggaacttgagagtaggttagacagtgctaagataatagatctaggctgtaattaaagctcttgatccgcaggaagctgtttctgtgtaaccaagtcataattagtgtttactggtttgggatcttaattccttgctaattagcagcttatttttttgtgcattcccatcctcagatatatcttcatagtatatattttctcttacaaaattaaactttctgattgagagtcactactactttttctttttacttctgctcagcaggctagtattcttctcaggttattttcctgtataaaatagtttttttcaacatttcacagttattactatgtctgactgtgttctctccagagcctgttctgcccttactcaaggactttttccaaaatactgtccttctagtatacttcatttaggtttttgtcttggcaaagtgacaaatgaccacatgccagaggcttctacaaagtcaagtcatatgttaaatctgatgtcaagctgtgaaactgcataactattagcaccaaagaggagaagaatgtcagaagtctcctgtacttccagcggatttaagataatgagctagaaaaagaattcagtatgtgtttaaattgttttcctgtggcaagaatgaaatctccttttaaaattgcttttgtgcctaattgttcacttcctttttcttttttctaagggattttgcttgcccaaagaatttatggaagattcagctggagagggagcaactgagttccatgactatgagggaggtggaattggagaaggcgagggcatgaaggatgtgagtgaccagatcggaaatgaagaacaggtacgttttcacataggtatacagttgacagaagatcactctctttcttttcaacatgtaagttacacataaaaatggtttttactaggttaataatttttaatctgtgatctacagagccctagatatattggtgcttcggcagtgggtgtaaataaaaagcctaaaatccacaggaaggaacctggcaactccatcattggttttggctataattatggaggaaatgatttttactttttttttttaaatgggcagatatttactgatgattttctagagtatttttgatagtatttttaagcataaaaggcctggctatcttaagtgataattgcattaaacaataatgccaaaatttgctgttaataggttttactgttgtatatctttaaggcatagagtgttttaaaaaatctgtatccttttttggttggaatcaagcaaccttctgaactattcagatgctgtgaactaagattgttacattg

SEQ ID NO: 121854 - DNA, 1046 bp, Homo sapiens
cagcttgacacagtggctcatcaataaatgagtatttttaatgatttccagaggcactaaagcaaatgattggtgtcttttgtttgtatgtttgttttgcaccatgttacctgctaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatggtatgtctgaaatcaggcagaaattagtttcatgcctgatttaatttttgtatttgatgatttatttctgtggctaaatagttaaggatggatgttagaaacagataactgcatggatagagataaaaggatttgttttctgttattcatcatgttgttattttctctgaatgaatgaggcagcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctggtaactaactgttctttacaaacttcttcctcttcagaatgcactgagcaaaggcagagtgggctttacttccctccacgtagataagtgccagagcaggcctcagtgccaaaatcactaagaacttggtctctttatttatacgtgcaaagtcattgacaagctttgaagagcttagggcttgctagctaattgttagatgcataggtgcagaaatgctaaccattcagaatatccattatattaggattctttcatatcttattcacatactcccaagtatctgatgttactgatagacgatgttatcaactgaggcttagcagccatcctgtgtaaccaccattcccactacaataagcgaacagagtaagcagttgtagtctttacagtaagtccagagaagcaacttactttgcaggacat

SEQ ID NO: 121855 - DNA, 1045 bp, Homo sapiens
ctgagcctttcttgaagtctgtaaaatggagctacaaataggtgcttctgaagttgtgcacatgaaaagagaatttacgatgtactagctacaagtggaaactcaatacatattatattaatctgaaatttccttcaagtgattataaatttctagtataatgcactgcacatagttggtgctcagtaagtgcatttgcttgattgattataaaacccctaaatacaaaagaatgactgctgctgttcgggttgttattgtcaagagatttgaaatcctgtgtgttatttttctatttccatgcaccttgaccagtttggttaaaacacttaatgagattttaccaaatgctagggactatgttaagtacccagggtataaagatgaatgatacttggcctttgttctccagaaggtccctggtgttgggtaacaaacacattaccagacccctgggattttcttattgtctcccctccccgccttgttttcccttacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtaaggttctcacttgaaacccaatgaaatgtagtcaccaacttttagggagagaaatgacatgactgattttgggggaaattccatagacagttgagatggtggacaacagaaggtacaggcaaggtttccagatgtctaagagttccactcacatgcaggaaaatcctatgaccagccatccatgattcccaaatatttcccgctttgtatgaggtttctcggaatctatatttttatttatttatttaattaattttatttttttgagactgagtctcgctctgttgcccaggctggttagtgcagcggtgtgatctcagctcactgcaacctccgcctcttgttgcccaggctggagtgcaatggcgtgattttggctcactgcaacctctgcc

SEQ ID NO: 121856 - DNA, 1023 bp, Homo sapiens
ctgttcataattcagaactggagtctccttgtggctatcatagcaagcattgctggatgtaggggcatgggggtccttcagttataatgatctcatatggagcagtaatatggttttctaaatatccacagtatgtctcttttaattttagtgatgctacatttgttctctatttgctgaactagggatgtgtttttgtgtgcaacagttaaatttagttcccttgcagggacactgcctgtcattcttggcagtgaggctaacctgtcttttgtctcacaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgggtgccagcatccaagtcaagggtggatctttctgttttccccagtggcgcaggagggctgagaatgtggcaactgtgtccttttttgataccttgtgtagtgttgaacagttgattgaataagcaagtgggcttaaaaacccacagagctcagaaacaggagcctactgagaacacacaatcataattttcacattgtcgtcctctcatgtaacttggcactgtgccatcttttatgagagccttgtctatactagttcctgttggttggtgttaccagtaaaggggcacagaggtggatttcccagtgtctaagctgtccccactgtcaaaaagttgtctcacttgaggaggattcatccccatcctcttgctttcttcacttcagagaggcacagcagtttcatttctcaggctgtctttgctcagggaaggtgagagcgaagatctcatagtgtaacacagcaatagctgggaagggaacccagaatttaatagaatgtttgggcccctggcagcctctgactacctccttcaccccatctaccccccaactgcagtgagtgtgctgtcag

SEQ ID NO: 121857 - DNA, 2636 bp, Homo sapiens
aagatgagtatagattgtacatgaatgagcatttgaggtgaactgcttaatatgccatcttttaaaaaaagctcagtttctgctgattttacaataagtttcacagaaggaatttgacattgtgattttagaagaacctaggagtacatcatcttcaagaacaaaagtgcaaaaaaacatctgttacaagcagaagtgaaaaataggggagtgttgacagcctgcatctctgggaaatgctaaactcagacaggatccctaaataatgcacctgtgaaactcactgtaatctcatggcatagagagtaatgaggaagggtcatcactgaaatatgaaggccacagctggcaccagtagcacatgcagcaagtgtggtatttttgtttccttttcatttcttccagattcactttgcagtgttctatggaatttgtaccattattacaagcaattctttgaccgggtccaggccaaaattgtggaacttcgttcccccctagaaaaagaacttaaagtaagatgaacagctgtcatgatcactcttgggaggacaaaatcagcaaattctctttcgttaaccctgttatccatttaacactgaggcagggacctaggggaatagaggtgagcattgccaccgctagggaggatggcaatatgtacatcggtggcattggcttcttttgtcacctgcagagtgtgtgagcgattggtggagtggccagtcagagcctcctcagaggactgccacagaaatctgtttgtgttcccctggtcttgcccaggcctgtctcccacctcagagctatgccatgttgtgttggtccacacactactgaattaccatgggggaaggagggaccgctctttttgatattctcagtggttgtggaaccaaccatggtacaagggacatgactaacttggtggttcctaagctggagtatatgtcaggtgacttaatgactgtagcagcactctttttttttttttttttttaaatcactttgagaccaaaacatttgttgtttttgtttttgttttttgagacccagtctcaactctgttgcctaggctggagtgcagtggcacgatctcagctcactgcagcctttgcctcccgggttcaagcaattctcctgcctcagcctcccgagtagctgggactacaggtgcaagccaccaagcccggctattttttctatttttagtagagacggggtttcaccatgttggccaggatggtctcaatctccttaccttgtgattccgcccaccttggcctcccaaagtgctgggattacaggtgtgagccaccgcgcctagcccatggtttcttttttagacttgttttacttgttcactgacacacagtcctgtgtttgggatagagtgagctctggtctttgctgaacagaaatctagaaagaaacagaatgacactagctttataaagccatttcttgaacatcatttatcttacaggaatttgttaagatttccaagtggaatgatgtcagcttctggtccattaagcaatctgtagaaaagacacacaggtaatccatcttttaaaactggagacaaccaaaatagaatagaattttgtgtggtagggagcaaaacgacatagttaccataacctaacttaatattaagtgtgttaaacttctcaaaaaataacaccttgattgttttgatgttgctttcaacaccacccccttcttctccaagcaaagtctacctgcagtaaggattagtgtgccttgagacaaagcaggctatgtctcaagtcttctgccacccactagctgtatactttgagcaaagcaatcccattctttctggctttagtttctcttctagaaaaggaggataacagtacctgccatactttttctcttaaaaataaaacaactattaatatttaaggagagcattgtatataaaaggtacagggtattagattatgtatggatgcatgataatgtattttttatatgtcttcacttgctaatccagtttttttcttcttatctctgtcattacctggggacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggtacttggttgtgggacagtgctggcttattcccaagccagtcaagtgggatctgtgttttatgtgcaaggcatgcctcagtactagacaagaaaatgcctttgaaatcttgttctttggacatatatagcatgtatttgcctgacttccctgcagaataaggcaaaaaatcttggggtttttttttttgcttttttttgagacagattctcgtgctattgcccaggcatgattatggctcactgcagtctcaacctcctggactcaaatgatccttccacgtcaacctcctgagtgctgggaccacaggcacatgccaccatgcctggctatttttttttttttttttttttttgtagagatgaggtctcactttg

SEQ ID NO: 121858 - DNA, 1019 bp, Homo sapiens
gctctatgtgcagctgctacttttatttatttatttatatttgttttttatttttttttgagacagagtcctgctctgttgcccaggctggagtacagtggtacgatctcagctccctgcaatctccgcctcccaggctcaagtgactctcctacttcagccttctcagtagctgggattaccggtgcccaacaccatgcctgtctaatttttgtatttttagtagacacgaggtttcaccatgttggcaaggctggttttgaactcctgacctcaaatgatctgcccgccttggcctcccagagtgctgggattacaggcgtgagccaccacaccggcctgttacttttaaatcagcttagaatttagccatggtccttgcttgagagcttcacattgtgatgtctacctcttggccatccgtagtatcccaaatagattgcgtgcatgttaggaatagggagtcatggtcgaaggaacatatatatttttctctttgaatttttaaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaagggtgaggatttttttttcctttcctttgacattgcacgactaaaatgagttaggctttgaattctctgcatgagacaggtgccttgttgcacgctaggttttaaacaagacacatttagttatgtttaatgcgattcacattagatatagagaagaacattcaaagtgaggtgcagatggttataagtttagtactgactagtgagctctggcagaggtaaattgccagatgaagatctcaggacctaccatgttgaggcagcacatctctctgtctagacattgtaaatgtcctgctaagctgctccttgatccaggccattattagtttctttcatccagtgagagcactgccagccatca

SEQ ID NO: 121859 - DNA, 1735 bp, Homo sapiens
aggctgtcagtcacttgctacaggactggccagaacacccagcgcttgaacaggtagggcagctgttgaggaaggagtgctcacagtactgagtctgcaatgaggatgcagcctcaccattatccctgggggcacccacttgcacatatatacatataaacaaaggcttaaagaactgcagttcaatgagatgttacttactaactgcaggatgaacacaccagttttgtatttctcttgtgtaaatgattggggattctgttaattttatttgttggtcaggagttgctgaccacataataaaatgctgccatgttgctctgttttttttttcagaggtgttttaaaagtagagaactggggggaatcttctggtcaggactctcttcagtaccctgtgacttaggatcactggtattcctactgagatacccaaatctttatttctgcagctcctggttgtaatggacagaattcgtagtttcccactttccagtcccatctcaaagttcctgaatggcttagagatccttctggcaaaggcacaggtgagctaatacctctcttcctcattttagttggtggtcagttggcaaaagatacgtcttgtggcacctttgttgttagacagaaaattatagtttgggctagaaaaaggtaaacatccttggtttttctggcatggggtgagatcattgcaagtgaggctgttgcccctgtggtgagggctagctgccttgccttttatccagtgggatgcagtatctaccggtaatgagggtgcactcctcccagccttccaggtgggccttcattccaactgagtgcccacatacacggttcccctcagtgccctcatggcctctaagttagctgttgcctccccattggacagaaaagggccgcatgtctttgttctaggtcagatagcaaagagcacgaattcaggctccagtctataaacactgtgcttttttgccagcctctaaacttggctctggtggagttctgtcatgtgaacagaaagaacttgaagctgatacactgtaaattcattcctacaattggtgcaagttgtttaagggcccagtagtcttcactcaagcaaagttcaagatgttcttgaggaaggaggtgattatggcattgaataatatctgtagtaaattttatctttgtttctttaggattgggaggaaaatgcaagtcgagctttgtctttgcggaaacatcttgatttgatcagtcagatgatcattcggtggcgtaaactggagctgaagtaagtgactctccttccctctcctaaacttaggttgtaagggcttttgtcttttggtagtttaaatttctttaggatttatatagtattacagctacagaatgtgcttttcagttattaatcacagagttaaaagtagggcattaaaatgacctgaatacagtccagacaacagcatatattcttgagggaggaaactgggtggctcctccatctccatttgggaggagagaaatgtgagcatgtagcttctgcatctttggtttcagatatttcaaataggttttcctaaatgcctccttggcttcttctcgtttcagctgctggtccatgagtttggataatactatgaagcgccacaccgagaaatccaccaagcactggttctccatctatcagatgcttgagaagcacatgcaggaacaaacagaagaacaggaaggtaatgcctag

SEQ ID NO: 121860 - DNA, 1044 bp, Homo sapiens
tgaattcccttgatgccatatacattccctctgatggctttctctcttcctctttatctctctctctgtatgtatgtattttagagactgggtcttgctctatcacccaggctggagtgcagtggcgcaatcatagctcactgcagcctcaaactcctgggctcaaacaatcctcccaagtagctgtgactgcatgtgcatgctaccacaccctgccgtttttatattttttacagagacagggtctcactatgtcacccaggctgtctcaaactcctgacctcaagtgatcctccctcctcggcctcccaaagcacagggattacaggtgtgagccactgtgcccagcctgtagtcttttaaaatatattttaatacatatattagtcctatttcattttttcagtcattcttatgcttttttctttcttccttttagtctgattagaagtagattctgatttttaaaagttcaattgctctaatgctatttataggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggtatggtagtttacttttgttatgcccctgggaaatgaaagcaaatgcaaatagatgctgttgctactctgtaacaatcacactcatgaatttcctgttttcgcataattccttattggagtttccttggcttaaagaactgaagctgattcaagaaaattgatttaggattctgtaataagatggattttcatcagtgtacaaatgggccaagaaaaagatggatttttattgtttggatcctttggggtgagggattaagaaaataaggac

SEQ ID NO: 121861 - DNA, 3155 bp, Homo sapiens
ggaaagtccaagacttttatataaaatggcgttgtgtgtgtatataacctatgtaccctttatatcatctctaaattacttacagtacctcatacaatataaacgctgtgtaaatagtgattatactgtattgcttaggtaataatgacaagataaaaaagtccttatgcgttcagcacagacgcaaccatccatttttccccctgaatattttcgacccacggttggttgaattgatgcggaacccgcacataacaagagggcaggctctatcccatgaatcctgtttagtaatttgctacatattatcatcttacttattcctgagactgttaaggctgggtagagagttaactttattaccactgtaaaatctcttgacagcaacagaaataaacaagtcctttgttttctggaaacattaagaatatatcataaatttattctgagacctgtataggctactaaagaaaaccacatttgtgctctatagtatgctcttgtgggtgttgttgtttcaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctaggtaaaatattctagcacttggctagctgacagatgctctgaaaatatcctcttgctggtagttaataagttttcccttagatttttcttttctgggtgatgtgaggggtagagtttatatacctttatataagtgtcaggcataggactaaatttcacatatatttttaattccatcagaatcatgtgggtattaatatcatttcacagatgagaatctcaaagcttaggttaaggagcttaactctgattagctcaagttaagcttgcagtcacatagcaggttgttgagaatctagaggctatactcttaaccattgtgctctcatacaacatttgtctttttgtccagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaaggtaaaccatgctttcagttgttttccttgcgggaactttttttcttgattattctgtgtatcctatacccataaacaaaccacagacttgatagggatggttaccgaagcagagggaagtgatttgccactttggaaagccaaaatttattgaaggttttttttttactagttttgactctactttaaaagtcaccgagaattttatcagtagagttgttcatttttagataaatgtactgtaagttttatgttacaccttccctaatgtagcagctttccagtagttcattgatagtccataccccaccctctccctctttatttttggaacagatgcagcaaaaatcaacaaccccagataaatgaggagataagtcacctcatctcattttgtctttatcacacacctgttacacctcaagagcttcgagatctgtggtccttgctgcatcatcagaaggtaaaaatcacaataagacataagcctcctttacattatgagttggttagattttctttgacagactggttgggaaacattttatttattctcaaaattccatattggaaacctcaggtttttttgaattgcctcttaaagggaagaattttaaatattcttttatagtaattatgagggtatattacaactcttatcacaggagtattcatttggtttccaattaaatgagatgaaaatatttgctgcttaaaatctcccaattgctcaaaaatatattgtgagagtgttttttatacttttttgtacttttcctctctaataaattgaatatgaatactggtacactcctgttaatagaatttcattagtacagctttaaataaaactgtaaacatgtcacattccttgaccaagttgactggggtggcagagaaacggaaaaatttggattaatacctttaaacttatgacagttttagatgggccttagaagaaagaagacctaataatttatggagtctttctcaggtattctcttacctaattattcctttatttctaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaaggtttgttggtctaaaattataaaaaatgtttgatagtggcaaaagagtttctgaatggatctatcaataaacatttattcctagcatagagtggtgactaaacaggtgattgcaacactttactttctgcagaatgttaaataagtgtactgtcagtaaaagtataccatgttaaataatttgtgaaattttgagataagtcaaaaaaggttttattgaaaaagtctattttttctaattaaaacatttttcccactataaaacatttaaacagtgcagatatatgtatatataatacagaattcattagaaatatccactctgttctatatccttctgtttacatatatttttatattaaatacatacgtaaacaagaattaagtacacatatatgtaacagaaatgtgtatgtcattccagcttatttttaaaagttattccattgtatcaatgtgcttgaatttattttaatcactttcttaccgataaagtgttgaagtttcttgcattttctccctcttcctataataagcatgccacattgactatcctagtatacatctttgtccacttgttggagcatttctatgcataagttgttagaattagaattgaatccttggtcagagtgtctacaca

SEQ ID NO: 121862 - DNA, 1107 bp, Homo sapiens
atgttctcattttatttatgttgactctcagatccagaaagctatcacactctgccccatgaaattgtggtcaatcttgctgctttttttgaactttgtgatgcactagtcctgctctgggtacagtcctcccagggaatggtgtctgatgccagtgccaatgaggtaaggaactgcatcttgttttatttttaaacaacaaaatttatctttcttggcataaagattcttagggctaagactaactttagtgttgttatatgcccaatattatttaagaaacttattcttaacagttttaaatatacctatacacatatttaaaatcttcattggggtataatttacatattataaactgcatatatttaaagtgtataagtcttgacatgtatacacctgtgaaaccattatcacagtcaagataatgaacatatccatcacccccaaaggtttcctcattccctttttgtattttcttctttcctgctcccacccacaacgaggtagccattgatctgctctcttactgtggatcagttgtattttctatacgtggaattatgcagtatatatacttttttgtttatattctttcactcagcattgtgatttggagatgcatccatgtggtttcatgtatcagtagttcattcctctttattgctgagtagtattccattgtgtggatctactacagtttttttattcgctcacctgttgttagattgtaacagttatattttaatccacttaagtcctcttagacattattgtcacatgtggattaaatggaatttttaatccagattattctagtaagtctagtaaagtagagcagccagtcttaaactttttgatctctgcctctatactcttaaaggttctcaaaaactccaacgatgttatatctgtcagtttttacatattaagaactgaatctgaaaaacataaaaaaaacccataaatttgcttaaaaatacagtagcaaagaatttcacgttaatatgaataacttattttcaataaaaaatagcaatttctaaagtaaaatttgagaaatgtggaactgttgtacattcctgcaagtctctgtatgtctggctt

SEQ ID NO: 121863 - DNA, 1050 bp, Homo sapiens
cctcaaatgttggagacataatagcacctccatacttatgtacacactcacatatgaatttacttaattttcaaagtgaatccacaagtatagtgtgtacctcagagggtgccttgcaagctaccagccccctactcctctgctccaccaactcctccatttctaccatggccactttgaagagttcacggtgcagtttgtcagatcgtgacagaccaaggcctgggagtctgcctagacccagctttctccatccatcgatctttcctttcaccttagtagttgtcactttcatctccatctctttagtccaagatttgcagaggcaggagaggaatggcaggatgaaggaccctgatgttccaagtgttccagcaaatagaggatatgattgaaaatgttattaaccgatagctatttgttacgttttttgaatctcattccaggacaatcatatatcttgaccgggaaaaacgggtttttactgaagcaaatttggtttctgttggtagcaaaaagctaagagagagtgttttgagaatgtcctttgaattccatcaaggtaagaacatttaccttttgtgttctctaattaagcatctgattgcataatgttgctaaagttgagaggcatattcagcagctgctgttgtttactggtttcttttaatctgctggcctgattttaaacatgtccccttactcaatagtaatgactaacatttactgagcacttactttgtgccaggtgcttagctaaatgctttttatgtgtccttgatctcatttactttttgtagccacctgtgatataggtccccatgttgttagtgaggaaacggagacacggagatgctcaaggtcacgtctctagcaagtaacagagccacttgaaaactaggtctgtcagctgaaaaagtacatattcataagcatttattataggagggagcatttctcccatgttttttttttgttaattgaaaagatagttgtgcttgttggaaaaaattcaaactattaaagtataaaaattgaaaaagttcatct

SEQ ID NO: 121864 - DNA, 1050 bp, Homo sapiens
ggattgtggggcagcagcagccacattctgattatagagaatttgtttttaagtttaaaaaactgcattgttttcttaatgaaaacagatagtgaggtgtatttattcattttctgccatgtacgtatttttttttttttttaagctaatggtgaccactgtgtaatttagcccatggattagtgtgatctcaggaagtgaattcattggttggaatgttgtattctagtagggattacctttatatcctgcattgggatgaactttcaggacatacagatactttgcatttggtaaagatagagtgtaaaagctattaaaccctgctattctagtattatgggatgaaactcatggtatttactggttcaacctcttccccatcatgattcaatgtgctcaaagtaaaacaatgaaaatattcaactgaaacttcccaggcaaggagtttctccaatatttctgatttttgttttgttctgtttttaaactagatgaatttgtgatccctctggatccccgatggaatatgcaggctctggacatgattagaaatttgatggactttgacccacaaacggaccagcctgaccagctctttgcccttttagaatcagctgcaaacaagtaagtgaaacctgctgctctgggcactgtttgcctcactggcttctcggattatacctttcctaagaatctgtcaaatagcttatgtgtgttgaattttgtgaacctgagaagttgtggggtgttggacatgattgcctttatcatacgataatcatattttctactgttttctgttttttgttttgcttttgagacagggtctagctctgtcactgaggctggagtgcagtggcataatcttggatcactgcaacctctgcctcctggccttaagccatcctcccacctcagcctcccaagtacctgggactacaggtacataccaccacacctggctaatttttgtacttttttgtagagacagggttttgccatgttgcccagactggtcttaaacttctaagctcaagtgatccacct

SEQ ID NO: 121865 - DNA, 1444 bp, Homo sapiens
gctaaggccccttatataaaatgggatagtattttcatataccctacacacatcctcctgtatgcattaaatcatctctggattacttataatacctaatacaatgtaaatgctatgtaaatagttgttgtagtacgttgttttaaaatttatattatttttgttgtatttttattttttgtttttttaaatttttgaatatttttgatctgtagttggttgaattccacagatgtggaaccctcagatatggagggccacctgtactttctttgtagttctttcgttttaagagaggacaaagcaacaataacaacattgcttgaattgtaaagtacagaacatggaatttgttggtggagattaagtaattgagtttacatgagcctttctacttcatgagaatttgtcaataagcccatggatgtttataatattttgtaacacatgtggtcatctgtctaaatatatgtagagaatttttataaatatttttatctgtattgtcctatatgatagccactagccagccagagagggctactaaaatgtaaatgtagattagatttaaaaaaataaaaaatccagtcctttagttgcactggccacatttcaggtcctcatatgtgactagtggttattctatgcagctgtagaacattttcatcactgcagaacgttcaattggatagcactgctttagagtctaacactggtttctccttcctccacagagtccatacaaattcatttggaagccagtgctgcatctctcaggaatttttactcacattccctctcaggtgcagtcagtaatgttttcaaaatattacaaccaaatacaacaggtatgcacttttgatttctagctctcagcactgttttggaaacttatcttttgactttatggggaaaagatctgacctgttagaggtctcaacataacggtattttttagaagactcatgatatgcagaagcaaattctccttctttttttttgaaatttcttttttttttttttaaagggacagggtcttactaagttgcccagggtcttcttgatattctggcctcaaacaatcctcttgctttggtctcccaaactgttgggactagaggcttgagccaccatgcttggcctgaaactatccatttatcctccagcttctgaaggaggctgatgatatgccatggagtaaaaagaatctaggagttggaacactaggccctggtaccaactctgccacaaactggcttggtagatttttggctcatcattcactgtctctgcctgtgtttagaaactaggggaattaagctcttatttctctgaggtgccttccacccttagctttgtgttgtctaccagtatcgttagtaggaagagtttcaaaccacgagatatttgacttaaaggaaagttacacagggtcatttaattt

SEQ ID NO: 121866 - DNA, 1703 bp, Homo sapiens
attttaaagactctattgtttatagatggcaatttttttttaataggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaaggtactatgaagtattgcagaatgtttctaagttgtaataccctacattcttgagtacgaggaaattatttttaaaggtggcaacccagtgacctaagagagttgaccactgcagtttgctctaatagagatctggtatccaggtacttttctggaaaatagcttgaatgtaaatattcctttttttttttttttaaacttacatgtcatcaggaaaagtagaatttgacttgtgtttttcattgaagagtgtattaaaagttgttgtgaggtggtcgcatggactattattactttgctggtttttggggaatatcacttttatgttggtaccactgtattgtgtttttgtctcctaccagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggtcagtggagccttcagcttgtgtctctggtttcttggctggtttttatttttgctggaaatggtcaggacacaatatatttaactggagcattctgtggccatttattgtgtagctgtcatagttttattgttcattgtgatattgctccctattgattatttattaggtatgttttaactttcttcctctgtgggagactctccttttctctcttacctttgatccaatatttgtgaaagaggttttctcagttatttggaatgtgaaataaaaggttattctagtactgagtttgttcattcaaatgaatttcaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttggtgagtagaacagcttaatttgtccactgatgtgatttatatacacttatgctatttaagtgcctcagcagctgtgttaatctgtgactacactgttaaaattacagttgggaggtctcctaggaagaaatttgtggtctagcattactgttaaggagcaagtctgcctgtagatgtgtcacaagataaacttttgtttccatgttatccttagcatttcaggatatagtcaccttcctaacaaattcaaaaggaaagcatactgtattattttactttttagttttgaacatctgctttttgtgctgtactactgctacagaaccattctatatgggaaaggtattagttttgataaatgcatttcctctaaaagtatataagattctaatctta

SEQ ID NO: 121867 - DNA, 1970 bp, Homo sapiens
ctcttacatttctgcctcagaatctgacagcctcagtagcagaggtagacgttcagtaggacttccttatatattttatttataaactgaatcatggagaagttcacccatttattaattcacttaacaaatacttactgaggctttactatttgccaggcattgctgggctctggaaacacagcataaacaagaggggcaaggtccttgccttgcattggtgacgaaggtgggaagcagagataccagtcatgatccttttgcagtaatttaggcaacacatcacagtggcttagatgagggtggtcagatgggttggtttgctgatggacatgtgggttgagaaaaagaagaatcaaggatgacacctatgtttttggcttgagtaactgggtaaatggggttgccattcattgagaaagggaagactggtaaaggagcaggtttaatgtggggagggtctaccgggaatcagctgtttactttcagacatacatcagaggtgtaagataactagatggagatgttgatgggcattcaatatatgaatccagttgtttcaggagactacacttgcttcctgttctgctgtctgtaggtgagttagaataatgaattagtacagcctactctggggaatatctgaaggttaaatttttaaagttctcagcactaaaggtacactggatatatcatacacagttccttaggaaagtaggtttagagaaaatcttttgctatattgatgcatgctagaagtaaaagatccttggtgtgaattctgtgacaatgagccacataggatttgccctcactgactgatgctgagctacacctttggttgcactgggatttaaaatcatttttttctttgaattgctatttttctagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggtgaggtgcttgacttttgggcctttgcagagttttagtcttcaagaaatttatgtcattccattggactgctcatcaaagatttcgtacatttagtgtatatagaaattatcaggaaagcttgttaaaaatgtggatttccagacaccccaagagattgggttcagcagggcagggcaaggcacaggaatcagtatctgaaagacgcttcttatgtcattctgatgcaagtaagcagaggctaaccctcgagtaattccactttacgcactgaggtttatgaagtttgcccatcatttctccagggtcatcaacagcctcttgaagttggaataaagaggaaactttgagttgtttaaagcagacaggtgttactttttctaaactttcaattacacaaaaaggaacaagataataaatgaagtattgcttgttggataactactctgtgttaggtaccatgcagattgtttatttaatctttttttttttttctttttttttgagacagagtctcactctgtcgcccaggctggactgcagtggcgtgatcttggctcactgcaagctccgcctcccaggttcatgccattcttctgcctcagcctctccgagtagctgggactacaggcacctgccaccacgcccggctaattttttttttatttttagtagagacagggtttcactgtggtctcaatctcctgacctcgtgatccgcccacctaggcctcccaaagtgctgggattacaagcgtgagccaccatgcccagctgtttatttaatctttacattagttctgcaaggcatatgttttcatttttcagataagactcagagagtttgagtaatttatcagttaataataa

SEQ ID NO: 121868 - DNA, 2166 bp, Homo sapiens
tctacataaatgtttggagggataacatgttttttggaggctgactggcttagatttaaaatcggtcaccaaccatgggcaaattctataactcttgtgagtgctgttgtctatataaaatggacatggtaactattttgcatgggtataaagatcagaaataatctaccaaagtacttaatacagtgtttggtacataggaggtggttaatgaatggtcatttttctttataatcttcgtattactgttctatcctctttttaggtagtatcttcaatgatgaaagcaaacaactctttttttgtctctagatttcaatactacagtgtccatggcttcaatttaatttatggtgcattgttactggaatctcagatagtttggaatatgactgctatgttctcaatctcaaatttactttcattccaaagaattaaataaatgcagtcaatcctttttataagagaaaattcaaaaggataagggaattgtggccagtgtttttagaatagtgactcttatcactgtgcttgttttctagaaagtttgcctaagaattaggtggagtgatttgtgttttcattgcattatcttcttcctttaggtcattgctgtattcaaggatgtgtttggttcaaattccaacccatacatgggaaccagactatttcgtatcactccctatgatgttcaggtaaggagactaggataatcctctatcctttgacattttttaatggtttcttctgctcccactaccaggcacgcttatggaaatctcactggcatgtcttttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggtaaccagtctgccttcatattttctggcaaagcataataaaccccgtggtctgactgagagtcttctgagttggtgatgagtacagataacagtattctctgaccctatgatgagttcatgtcctctggaaattacaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcaggtatgtatatttggatctctgtatcaggaacttaccattgcttatattgtgtccatttacacgtaatagatttacaaatgttttgtattaatttagtaattattaacaatcagaacttgtgggaaagtttgacctagaaagtaaaatgaagctgaggtaaagtattcagaatagttgatcctgaaaaatcaaataggaaaaaaattggttacgttgctttatggtttattttgtgtgtaatcacctataatgataaaacagcatgtaaaacttttattattactggctatttttttactcaataatttctcaggaaattgagcatttttaaactgaagaataggagtctgaattcataggatgtgtttattcatttgtgtggagatggaggaaatatatcatcctgtatgccatccaattaacatggaaatttctctcattttgtggtgccactttcagagtggtggtgagcatgctcttagggaggattcaacctaaaggcccacaggctgggtctgtcactatgcttgtcattctttatttccaaagcctgcttgtaactgattacaaagtgttgattccttatagccgaagaaatcagacatcccacttcttggccagcaaacattttatctgtggcggtgggccactcatttactttcttcattgttgatttgatctgtcatttctcactttaagcc

SEQ ID NO: 121869 - DNA, 1981 bp, Homo sapiens
attatttttggatttctaggtcttcgttgatccccttacagtaattgacatggagttcattgccagtactttgtttccagccattgagaaaaatattgttaagaaaatggttgctttcaataaccaagtaagtacctacacgtattggtttctttttttttctggctgtatttgaaccagtattttttcaacatagagttctaccaaattatcaggatctctaactaaaaaaaattactttgaattctacaggtttctagtggaagggacactatgtagtggaggcttccagtaattcatttctgtattgtgactaccagtgttaatgcttagaggataagccaggcatttggaagtcttgagaaagaggctctgaatcaagcctgttaatttttgtttcagattacatatgcttttgtagtacattcctagtacttaatgcagtgcctagtagtaagcagggcatgtttcccaatcaggatgttttctttctagattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtgagtttcacgcttggtatttgtatttctttccatctgaaagttgatttcctgtgggtgagaaaggacatacactaattgcaagcctttttttttttttttttttttgagactgggtttcactcttgttgcccaggctggagtgcaatggcataatcttggcttgctgcagcttcacctcccaggttcaagtgattctcctgccttagcctcccaagtagctgggattacaggcataagccaccagttccggctaattttttgtatttagtagaaacggggtttcaccatattggtcaggcagatctctactcctgaattcagatgatccacctgtctcagcctcccaaagtgctgggattacaggcgtgagccaccacgcccggctagcaagcctgttaaagctgcttcaaaatttaaaagttaaaagaacagactaaacgttctcctaccttggggtctcacaatatagagtagcttgctttagaggacataatttgcttatctatccaaatccccatgatcacataccttaaagcagtattgccctccagtagtaaagaactaagtcttcaccatctttacaggcaccaaggtgagaagcaggaggaggcagacaggtgatactccgtagaagaggaagtttttctgttttgttttgtttttaaataaatgtcaaattacaaagcattttgtctagaaagtataatcgtataaagagagaatattctgtgtttaagtgaaaataaaaatacctgtttgtaaaactagaattcccactgtaaggaattgtaataacgtgtgcattttagtttgtggtatttaaaatcctgtctcgctgaatgctcacagtagctataggcaggaggtgctgtcatggcatcttacaggtgaagatccaaggcttaaagttatggagtgtcacaggtagcagagccagctttccagtttaggccctctccagtttgtctgctgtttccttctagtaaacttcactgtttgaaaataaatgaatagatacatagatgcatgcactagaagcagtaacctccttgttgaaatgtgaacatgtggctggcccatagcacatgtgactttcacagccctttcattctgctacccattctgtttgttcttattttttttctttttttggattgcaaaaatttattaaaattggagacattgttttaatcttcttgtgccatgagactccatcaggcggtctacaaagaccattgggaggctgaggatcacttgagcccagaagtttgaggctgtagtaagcttcaaaggc

SEQ ID NO: 121870 - DNA, 1027 bp, Homo sapiens
tttatttaaaatacaagtaaaattataagatataacaaaatttgcatattttctaaaataattataatagaagttcaaaactgtgtccgaactcaaatcaaatgaatatttctttgagcagttttcaggtcagtatctaaaactataactcccaaggttttgttttgttctttggatagggatggactgctattgatgaatcctttcagaatttgatcaaagctgcaggctgcttttgttagaaacagcatttatgtacattcattcacagaactttgcttagaaggagcagagaccccttttaggccatttgtgtgcccctggttatgaacttttgttctgggatctcccgttaacagcaaatgctttttttgtttcttgtgtttagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggtatgttgtctggtagctggtggggacaaggggctcgtatagaggggcataggaaaaggagcaagcccaggcctctgacccagctattttactgaatcacttctcagaacatttctaaaactcagaatggctttccttttgtttgtactctttgaaaggtgattggcacacaggatacactgcaacttctcaaagctggtagaccaggtacttaacaaacatgaagtggtgattatgagtagagtaaagactgctgaaatgtctttgcttctgaagcactggcttttttttttttttttaaattaagttctgggatacatgtgttaggaataatgcttaaaattgtaaagaaattgaacacttaaacaaagggtttttagcaaagcaattttatttttgtgcagaggggtgtttttttgg

SEQ ID NO: 121871 - DNA, 1022 bp, Homo sapiens
tatactttttaaaatcacactctcattgagctatgtaaaagaagtttcttcctcctacatcagactgcccttctctgtgggaagacaggtgtttattttctctgaagtattatttaggtacctgatgcaaagtaaaggtaaagtaaaaggaagaatctttgcctgaggggaagagttcagatttgactgggactggctggaatcctgcttccaccacttagtctgtaaggcctctggaccacgtctattaagaaagtgatgatgatactggaaggtgtcatggaatataaggagtcaagacaaagtacatcttcaattaattatatctgatagtagaaataatttttaaaagtgtgtagtatttgctggacttaacagctaacaacattctttcaagacttgttttccagctttccttacagttttaaaaattcacattgaagttttgtgtttcttatagctgtctcctgccttaagaaaccggtttacagaaatatggtgccctcaaagcacaagccgtgaagatttaattcagatcatcagtcataatcttcgtccaggattgtgtctgggcagaatagatcctaaaggtgagagtttgcaggtggtgatggtagtattgggtcatagaagggtttgtgttgggagttgagggatctcttacaggacatcagccctgtgtgtatatggtgtgttataagaagaaaggagataggtaaatgaaacaaagtagacaaggagaatattactattctgttaccttctgttaaagtgtcccatcttcatattttcatcattaccacttgacacaatggctgtagaatttcagctgcatttctttagttgtcatcaatgaacatgttattctttcactttatttaaaaatttttttggctaggtgtggtggttcacacctgtaatcccagcactttgggaggccaaggtgggcggatcacttgaggtcaggagttcgagagcagcctggccaacatggcgaaaacccatctctactaaaaatacaa

SEQ ID NO: 121872 - DNA, 1338 bp, Homo sapiens
aagttctcttctcttactttgcattgatgttttgaggttcattcctatttcagcacgtattattagtttgttcctttttgtcccgaatagtattggatataccacattttgtttatccattcaccagtcaatgatatttgagttctttctagtagttggctattatgataatgcatgcaatttatttgttttcttgtaagttattcatttttaagaccaatgccttaatagtttataagttgaaaagtttttttttcttgatcagaaatagccattattacacagaaattgggatagtgagtcattttaaaatttgtgataggaaaccattaactaaagtaaaaattcagtagaaagaagataacttttttttttcttttaaagagcattgaagattgtaaaacagaaagattgtataagcccttttcactgttcttcaatttttcttttagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggaggtaaaactttactgatgcacattttctttctaggttttgacctcagcttactggtactcgtaaatatagtatgtaataatggatttggaattttatgttaggtaaaaagtgggtaaaaagtgtaaaaactcaaaaatattttaaaataattattgggttagaaaaaaattctgacacaaatatctccttatttgatatctcactttgtgtatgtgcctgaaatgtcattgttacagtcactttgcctagccctttacatatgttaccctgagaaagctcacaggagctctgcaagaaagttattattgtagttttatggatgagaaaagttggatctgaaatttaagtttaacctctgtttttacagtccactttcttaaacacacctctgctttcatgggtggttttaaagtgacaaaaaagtcacaaccaggaaccctcttctggtttgtagatggagcttatttgttctcgtaagggttatgtgtgtcactttctgactgctgataaagtaaagggcagagggtagttcctatgttcagagggttgtgttcagatatatttgggaaccaacaaccttgttggtttccagctcaagaaacctttcagtggagaagtcagcactatgtgttggatcccagtctgttaaagttaggaagagagtgatgtaacaggtcagggatgatgagaagaaacagaggggttgatcttaaataagacaattaagagtgttggtaattt

SEQ ID NO: 121873 - DNA, 1702 bp, Homo sapiens
cttgaactcctgggcccaagtgatcctcctgccttggcctcccaaagtgttgggattacaggcatgagccacactgtacctggcaagaatgattttttgcttcattgcattgagggcagtttttgtctatttagttcttttaaacagtgagattcattctatacgtgtgtagagaagagataaactagtgtctcttgaaagtctgtcaagtctataaggattagatttcttttccctctcttggtggtggttttttttttttttttttttttttttttaagaaggcattccgctcttgttacccaggctggactgcaatggcgtgatctcggctcaccacaacctccgcctcccaggttcaagtgattctcctgcctcagcctcccaaagtgctagggttacaggcgtgaggcactgcgcccagctggtgattgttgatagaactaggttggagtttgtgcagtacataccttctggataagaatatgggagagtgcagtcgtgtagaggggtgccatgagcctggggttgaggttccacattggccagcactgtttactgctgcagtgagactcccacagtggttcttctcttttgctgagggggggtgtttatggatgtgtatttgaaacacatgccttgttaatcagttgcacatctctaacaggtgtgggaaaactactatctgtcaggtatttgcagccttggcaaatcagaaattatactctgtcagctgccacttacacatggagacatcagacttcctgggtggcctgcggccagtgagacaaaagccaaacgacaaggtttgtccagcagcaagtgttcctgttattttaaaaaactgcagttagctgtgcatgagttagtggtggggtttctggagctgggttctggtttggttaaatgtgcatatctgcagattttctctggtctacaagggccttcacaagcattctggtgtgcaagttctatctcctgttctcagattcttactttcctcagaatgcctacttcacccctggaaacaccagccagctgcatgtatattgtctgtggagccacctgccctttaattttccccactttttcaaattataggaagaaattgacacatcaagactctttgagtggcatgatgggcctctggttcaggccatgaaggaggacggctttttcctcttggatgagatctcattggccgatgactctgtcttggaaagactcaacaggtacgtgcctgagaggtttgccttgtgtttgatatttttgttggtgtgatttttttttttctccctgagacagtgttctcactctgtcaccccaggctgcagtgccgtgtcatgatcatagttcactgtagcctcaaacttctgggctcaggtgattgatgtgatttttatagatatttaatcttgtgcacagtaatacttctcataggtgcaccttagtaaatgcttgaaattattgatgtattaccatgtcttttggctttagcattcagtgtttcctaaatttctaggttttttttgctatcaataatcagaacaatgggatcgtggaatggtagggctaaaacatgagccaaagtcaaaactattttttaaagtgaattatatccctactctcttaatattttgaaagaactgtagtcagaatcctagacccatggctataagccatcatcagacctcagaccaat

SEQ ID NO: 121874 - DNA, 1050 bp, Homo sapiens
gaacattcctgcttatgtctttcgacacacacatgttcattggtgtttggggatactagaagtcatattgctgaggcatagggcaggtatatggttaattgtaataggctgtcctagttcttcagatttctacctcaccagccgcgtatgagagtttctattgtttcatattctccatatcccttggtgttcccggtagacacttgatgattcctctcctccttttcctcctcctcctcccaggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtgagtaggccaaaatccctagaggaatatgatttgagttgtactcattagaatctaaatatttatttttccttggataggtaaattgtctactcagatatccacattggagtgtaactttggccatatcgtgtggactgagggcatgcggagactcgcgatgctagtgggaagggcattggaatttggtgaacctgtgctgctggttggagacactgggtaaagatctgtgacagtgactcatgagggttcatttcaattccataggattacttgagttatcactgaagaactcatgaaagtattaatccccccttctttcctccttcctcttttttcttttttttttttttttttaagaagagactaagagtgggtcgggggctgggggagggatagcattaggagaaatacctaatgtaaatcacgagttgaggggtgcagcaaaccaacatggcacatgtatacctatgtaataagcctgcacattctgcacatgtaccctaaaaaaaaaaaaaagaaactaagatctgttactgtttagtttcctctaccttcagactaggttctttgttaatggaaaataatggctttattattattatttttggagatggggtctcactctgttgtccaggctggagtgcagtggtgcgatacggctcactgcag

SEQ ID NO: 121875 - DNA, 2154 bp, Homo sapiens
aaaaggaaaaaaaaatgctcttttaatgatgctgttaaatgatgtcgtcattcttttaaaaaaaaaaaaccaaaataatacttggccaggtgcagtggctcatgcctgtaatcccagcactgtgggaggccaaggcggtcggatcacttgagcccagggttttgagaacagcctgggcaacacggcaagactctgtctctgcaaaaaatacaaaatttagctgggcttggtggtgcatgtctgtagtcccagctactcaagaggctgaggtgggaggatcacttgagcctgggaggtcgaggctgcagtgagctatgattgcaccaccatacttcagcctgggcaacagagtgaaaccctttgtcaaacaaaacaaaccaatactcagttctggtttctcagctttgtaattttttgttgttttaagttgcttaattggctaatcttttacagaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtagggttaagattccattccatggacataggtgtttattctttcacacacatttccttaagtaatattcttcatcctttccaattgaggcacatggacctttgctgtaacagccggcttttcttgatgcctgagctaagatagttaaggggtgatgcataaggtgctggctttctttaggttctgctaatcttgctggctgtatacaggactagggccaattttcaagaggggaattgaactgctgctttattttctaggaattcagagaatggggttagtgttagccaaaaggaagttgggaatagtcaacagaatgtggtgatttaaatgaaattagactgcaggggaaagattacacaagaaatatgaggtattttcagccttggcttcttttctgtggggaaaaaagggactattttaattgaaaattgttcctccttgatctgcagtgtcataatttgttttgaggcaagactagctacagaaagtaatttgctttgaaatttgatgataacctaggatttgttgatttgtacataatgcattttaaaactttgtactgatttatacactagttcttgctgtttgtttcttcctaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtatgtagcatttgtctccttccttcaatttgttaacacatcagatagtagatttttcgtagtaagaatgaaatgtttttacttctcctttaatattttatggtgaatgtcagagcctccatattggaaattaaaaggcaccttttactgcattcttcctgtgctttgtctaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcaggtacttagtttcaaatggaatgtattgattatacttggtgatcaaaatttcatggcttcttttgttagaaaaaagaatctgtctgttgatgtatttttccaagtagagatttttttttattttttattgtttttaatttttttattatttattttttgcaagacacagtctcactctactctcctggctggagtgtagtggcacaatcatagctcattgcagccttgacctcctgggctcaggtgatcctcccatctctgactactcactccttagtagctgggaccacagatgtgcaccgtcatgcccggctacattttttttttgtagagacaaggtttcgccatgttgccccggctggtctcgaactcctgggctcaagggatccacc

SEQ ID NO: 121876 - DNA, 1102 bp, Homo sapiens
gtggatggcactggccatagacctcactacagccttcggactctgtgccgggccctgcgatttgcagcctccaatccatgtggcaacattcagcgctcactctatgaggtctttctgaagtctctttgactggatatgagcttaatggatgggttcatgggaaggaaggaatagggatgcatatgccaggttgcctgtgctttccagttagtcagatcagcccataatacctcttaccagatttaccttgcccttttaaattaaatattttactttttattttaaaatttttatttttaattatacatagagacagggtgtcactgtgttcccactctggtctcgaactcctgggctcaagctgtcctcctgccttggcctcccaaagtgctgagattacaggcatgaaccaccgtgcctggcctacccttccctttatctaccaccttactatatttaaaagttgggaagcagcatcacccaagaggttaaattttgttctggaaataagtttggttgtattgcagaaggttatttagcattatgcatatttgtcttttctttctagggtttttgtttgggtttcttaacacagcttgacagggcatcacacccaatagttcagaagctcatctgtcaacacattgtccctggcaatgtcaagagtctgctgaagcaggtatgttcttttgttatttttgacttgttacacttgaaaggctgaattaccaaattttcagctgtttggttttttttttttcacataactttttaattataaaggtaatctgttgcaaaaagtttaaacattacagaaacatatgtttagatggtgaaagtttccaataagcgtgctctttggagatttaaatactgtggataatctttccagataaattgtataatgtatatattttattttcttacatatccaaattttgatatgtatatgttgatttattgaggtaaattgtaaaattgtaaaaaattgtaatatgcgtttaatgtaagtgggactgtcttataagaatattgtttttttgttttgttttgttttgtttttttttgcagatagagtcttgctctgttgcccaggctggaa

SEQ ID NO: 121877 - DNA, 1732 bp, Homo sapiens
caggctctgcctcctgggttcacgccattctcctgcctcagcctccctattagctgggactacaggcacccgccaacacacctggctaattcttgtatttttagtagagacggggtttcaccatgttagccaggatggtctccatctcctgacctcgtgatccaccggcctcggcctcccaaagtgctgggattacaggcgtgagccaccgcacccggcttttgtatctttttcttcttgtaaggactatacgtagaagacttattgcatagaagaagcaataatggtatatttttggtaatggttacattatcctttaattatgctaagtttctatatcaggttgaaagacattttatactacaagcagttaaaatgagctgacatagcttcttctgtttcatgtttttctattgtcaacatagttatattaacttcctaaaaagtgtttattatgtattgttttacaggttcacagaactttatgtagaagaattagaaagcaaagaagacttacaggttcttattgtagattatctgaaaggattgagtgtgaacaagaatacagtgcaaggaatcataaagtaggttcccttttgtatgtctttataagctctttctctgaacatgaaaatgtgctactcgtgcacacacacaaatatgtattcttttttacttctaacttgagaaaactgatggcaggattattatttagattctcttgtaaagttggaacctgatatgaactcctttaggtttttctaaggaaattacatagaaagctatgaatcattacctatgagaagatataaaccatcagataatgctctcctgattacctctatattcatagctgagggtttgaattcttggagatgtacatggcttgcgttttgaatctgtcttgaagaaggttgcttttctatttgcaatatttatactagctatgtgggatgtaaggagaaaagggttaatataattgattgtgtcaggtttggaattaatggaagcttagcctaataaataatagagtagttacgtggcttgtgctttaatttgagactgttattcctgttttttgtatgccatatggacaacatgcaatcttttgtgtcagacaacctcaattctagtattggttctatgagaaactaattgtgtcattctgggccagtaacttaattgtgtgttctccagaaagaaatacaacatgtaaaaggattgaaatagggtgatattaatgttttactgtgtgtttgtgtattttttctcttccttaatacaaatacttattgagtgccctggtgctgtggttatagctatgagtaaggcagacaaaaatcctggttcttctcattgagctttaattctagaggagtcaggtactgtaattttaggttgtgataagtgaaaacatataaagctgagtagggtgtaagaaaatgaagacttggagttctattttttttttttttttttttggatacaggagctttgctttgttgtgcaggctggtcttaaacccctggcctcaagtgatacgccagccttagcctcccaaagtgctggaattacagggttgagctacagcacctggtcctgaagtcctgtattaaatagattagtcaacaaggcatgtgtttagaatgcttcagaatggtttaccacaacacaccctaaattggaatactttttggtagccaagaatatttggacaaaagtgtaaatacgt

SEQ ID NO: 121878 - DNA, 1611 bp, Homo sapiens
tgtgaaaggcagtgtatgacaatcactaaacactctgggatttagacatttgtctaatcttggtatagcctgaccctatatttattttgagttttaatagtcacttgggtgcctttaaagacctgactacaatgtaagctatttacctgaccatccacataatgagaggatttagtttattgcatctctctgttaggctcaaagatattcccttgacctttttggacatttaaaaaattaacttggccttaactctgcctatctgctgtcagccagttaaagtataggcccatcaagtaggaaagatttgccccgcctctatttctaaccctgcttgcataactgttcttggcaagtgtgcctttatttgacacattgttaacattttattttatctttttctagggtacattagctcaggctgtaaagaaaggagagtggatcttgttggatgagattaacttggctgctccagaaatactagaatgtctgagtggtttgcttgaaggatcttctggatccctggtgttgctggatcgaggagacacaggtagcacttgaatcccttgggatttgacttggtgtcaagccctgtggccactttagagtgagattttttgttgttgttgttagaaggatgacatgggcctcccaatggaatttgttcattctttagatattaattttctgcaaagtgcattaaagtgttgggtggtatggggaatgcaaagaagaataatataatttgacaaggtgtttgagttgtggataatagacacacttataaaataacaggtgaatggttgataaaagataaataacagtgaataaacataccgcaaaagactgcagtataagattagattgaatacataggtctggaaagttatttcagtggggtttcagaaaagacaaggatggtgtgagcagccagcatcaggctggctgggcctggggttctgtggaattagataatcatacctttgttgagaatttgtaattttctcttaacagagccactggttcggcatcctgacttccgtttatttgcctgtatgaatccagcaactgatgtaggcaaaagaaatctcccaccaggaataagaaacaggtgagggtttggttcttggagactttccttttttgcaacaggttcttgctctgttgcccaggttggagtgcagtggcgtgatcttggctcactgcaagtccccggttcaagcagtcctcccacctcccacctcccacctcagaatcctgaatagccgggattatgggtgcatgccaccacacccagctatttttttattttttttctgagacagagtcttgctctgttgcccaggctggagtgcagtggtgtgattttggctcaccacaacctccacctcctgggttcaagcgattctcctgcctcagcctcctgagtagctgggactacaggtgcatgctaccatgactggctgatttctctatttttttttagtagacactgggtttcactatgttggccaggctggtcttgaactcctgaccttgtgatctgcctgcctcagcctcccaaagtgctgggattacaggtgtgagccagtgcgcccggcctcaagtttt

SEQ ID NO: 121879 - DNA, 1830 bp, Homo sapiens
tcttggcttactgcaacctctacttcctgggctcaagcctcccacctcagcctcccaagtagctgggactgcaggtgtgtgctactgcacctgactaatttttgtatttttttgtagaaacagggttttgccatgttgcccagggtgggcttgaactcctgggctcaagtgatctggccacctcagtgtcccaaagtgctggggttatagatgtgagcagccatgctaggctagtttttttcataacactgtttatctaataatagtttttaccttcattatgggcccttcaaatgcttgcgatgggggaaaatattacaatttaaaactgtaacgtagattttaaatatttcagtagtatttctgacgttaattaaatgaaatctgagacctactcctgttttctgagccatgctttctaacttctgttaacttcagaagtttgtgaatcacatttacctgtgtctgtttcagttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactggtaaggatgtgacccaggctgccatgggggagggcatggggctgggctttagttaacatattagttttggggaagagtaaagcgatacaaattggagctttctaggactttggcagaagtgactaattgtgaagtattgtgccccattattcacgtatttccacaaaaacagttgactggtaatgctgatgtgcaagtactatttagtggtcagtaaggcacatttcctcagaaaaagcttatttctaaggagctagattctatagccaagaggcttttgctggcttagtttacttctgtgtggttccttatctgtaaagcaggaataaaaataactagtccagagggttgttgtgagggataaatgaggcagttaatacatatatattcatacatgtgggctaattagtgtcatgtctggcattttgttagcattatacaagtttttagacttagtgttttgtgtaagatgcttaatttttgtgtgttttgttaattgtatttgtttgtttagaagttgtatatattacaattcaaaatgtgtgctgaattcttgtctttcttttttagggttactcataaaagagaaatgggaagcatttggtcttagactcaaccatgcccaacaacagatgaaaatgactgaaaataccttattgttcgcatttgtagaggtatttctgtttttgttatttagcttatgggaacgttgattttatgcaaaacaatgtttcaggcaggttactattttgtattgtcttaatgaaataatgattttgggggaagattttgaaaagtgtccttcatggtaattatggcaattataagatcttaatgagcaccatcattatttaaataaaaattttaaaagtacaaattgataaattataattgtatatattcatggggtacaaaagggtgttatgatttatgaatacggtatggaataactaaagctagtgaatattcatcatctcaaataccgttttttgtagtgagaacatttgaaatgtactgccttagtaattttgaaatgtacaagacattattatttatggcatggtcgccatgctatgcaatatatatctcaaagggaagaaagcttatttttttctgtctaattaaggctttgtactttcttttc

SEQ ID NO: 121880 - DNA, 1017 bp, Homo sapiens
gtgatctcagctcactgcaacctctgcctcccgggcccaagcgattcttctccctcagcctcctgagtacctgggattacaggggcccgccaccaggcccggctaatttttatatttttagtagagatggggttttgccattttggctagctaggttggtctcaaactcctgacctcaaggcattcgcctgcctcagcgtcccaaagtgctgggattacatgcatgagccacagcgcctggcctgaatgaggttttctttaaggaactcagtctactttgaaatattaagctgcctttttcataaattcaatagatcaataataacagagacattaataattgtattaattatctattaactctctgtggcagtcattatgtgccaggcactgttttgagtcctttttctgtgttaacttagctggtcttcttaaaaccatgtgagacaacagactgttatcctctatattttaaacatgagagaactgaggcaaagagagataagtcacttattcaagaaaatggcagatccaggatttgaacctaagcagtcttgagtgtctgtgttcttaaccattactctgcttcttcagttaactttggatcccatttatactgttattttcaggactagcaattttggccaggagcagtggctcatgcatgtaatctcagcactttgggaggcaaaggtgggagtattgcttgaggccaggacttcgagaccagcttgggcaacatagtgagactttatctttagaataaaaagttaaataaataaaaagattagcaatcttatttaaatgacacatatattttgttcaatttctcaccattttcactgttgtcgttctagtttatctactgtctagtccactgcgttggtctcttatctttgcttctactcctaatctttttatagtcttttttgtttaggagttacaatgatcctttaaagtacaatcagataaagtataattttttgtgtgtgtgtgtgtatggcatagtctcactct

SEQ ID NO: 121881 - DNA, 1034 bp, Homo sapiens
cactctaagttctgtctctgttgtcatgtggcccttcttccttgtgtgtgtatttcttttcttctcttcttttttttttttttttgagatggagtcttgctctgtcccccaggctggagtgcagtggtgcgatctcagctcactgcaacctccacctccagggttcaagtgattctcctgcctcagcctcccgagtagctggaactgcaggcatccaccaccacgcctgggtaatttttgtatttttagtagagatggggtttcaccatattggccaggctggtcttgagctcctgaccttgtgatctgccagcttcggcctcccaaaatgctggggttacaggcttgtgccaccatgctctgccttgtgtgtgtatttctatgtcaccaaatcttcctcttataaggacaccagtcattggatttaagacccaccctaatgcaatatgaccttatcttaatttgattaaatttcttcaaagaccctattttgaaataaggtcacattcataggatctgggtagacatgagtttggggaaagattattaacctattacaactaggtactgttgttacccacatcttacaggtgaggaaactgaggctaagacacattaagtaatttgtccaagatgagctaactagtacaggtagtcttgtcttattgatctttttaatctccagagcctagcatcgtatcagatgtgtgagtattcagtgtttgcagagcaactaaattctgtaatttttgtatgttgtaagattatctggtatagcttgaagacagttactgtgagctgttttctcatccttgttgttgaatctggaatatatggtttcccagagcaaaactaggagaagcttgcagcgtggtttttaaactctttttttctccttcccagggagaagttcactttcgctgctacacggccgtcctctgttctcatcgagcagcttgcagtgtgtgtcagcaaaggggagcctgtgttgctggtgggagagaccgggactggcaaaacctctaccatccaat

SEQ ID NO: 121882 - DNA, 1057 bp, Homo sapiens
ccccaaacctgaacaaaatctgtgttctttggagaagagaggaatggctgttgggtagacatccaggagcatctgccacagctctttttgctttggctgtagtcagatgtaccatgatttcctaacattatgttagaaatttaaagcagaggagagcatagctagagaagatttctctgatttttttttcttaccttttaggtgaggacttactgttcactttctctattggatatatcagtgtgttcactccatatataggtagggcttatttgaaaagtaccattttagggaaacatgataaatgttgtgaaaaacatagaagtttggaaaatgaaaaaagaaatttctttatgaaaagccaactcaactatctgggaagtagagaataattctttgtagagtgctaatttgagggccaaaataagcctctggatgaggaaatattccaaaagcatgtggatttttactcaggtaaaatcttacctcctacaggctgaattcttttgtcaactttataaaccagaaattgtgatcaatgagctagatttgcaagtgggtcgagtgcggcttctacggaaacaaagtgaggctgttcacctacagaggtaagtagggctctaaactaagctgccaactgtggggtttccagaaacttgacagaaggtctagctcagcctcttgtctttgtgcaaaacacatgtctgaactgtgatatctgtagtatgctatatgggaaggagcagtgttttcccaaagtatgttctgtgaaattagatatcaataggtgaaagaggtgatgaaagtcattaaagatttggcactaccaaagatgaattattgattttattcactgcagtgtatttagtgaagtatgcctcagttggaagtcaggcttatgtctaacattagtctgtaaattcctagaaggctggggttatataagattctgagatcgaggtaacattaaatacttattacatgtctgactttgtactaagtgctttacatattttctcatgtagtggttgtaataatcctgtgaattaatatatta

SEQ ID NO: 121883 - DNA, 1021 bp, Homo sapiens
tgacaaaatttcttttcatttttatttttatgttttatttatttacgttttttgagacagggtcttgttctgtcacctaggcatgatcactgctcactgcagccttaacctcccagtctcagatgatcctccctgctcagcctgctgagtacctgggactacaggcacacggcaccgtgcccatgtttgtattttttgtagagatgatgtttcaccatgttgcccaagttgatctcaaatcctgaattcaagcaattcctctgccttggtttctcagagtgttgggattacaggtgtgagctaccgtcccccagtgaacaaatttcatagagaaatacaatttttggctgaccagtttcagcagtagtttgtgtgctttcaaaaattaccatgctggctgttaaattttcttttttttccccctctgtcaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaaggtactggactaaacagttttttcttttctttctttcttttttttttgtgagacagattcctgctctgttacccaggctggagtgcagtggtgcagttttggctcactccaacctccgcctcctaggttcaaagttcttaccagctagaagtaaatagtcaggttttgaaattataggttgcttcatggtgtcagatccctttttcagatttataattaatgactgggaaggctcgattagggtaatgtttttaactttaaaaaataacttttaaagaccaacttgggagtggctcctaacataattctttcactgaatgcccttttctgacacttggagtcttaaataagtcttcttggatttcgctatctatgacttctgtgccactctgtgttc

SEQ ID NO: 121884 - DNA, 1045 bp, Homo sapiens
tcttctggaaatttttaatggttttcaagtactgtagcttctggtaacaagcagtgaacttaatgttaatgctatgagccttggattatgctttctctttcctgaagttatttatgccttaaggaagaggaacctgtcattgaaataaaaacatttaccttgtagaattatttgcagtgatttgaaaatatttggttaaagcactatcactactacttaggagaagagccaaacatgggttaactgtcagcctttcatttgtcatctgccctgtaagcccaacagtgtagtatctggaaacagaagggattatgaatatttttcctatgtgagacagtgtacagcaagtaatatccagaggcacaattcaggattaaaatttggaattttgtgtgactgtgttttttattttgaaacgtagactcttgagctgtggaggaaattggtatcgaccgctaaacagtcatgctactttgctagacaaatattggaccaaaattcacctggataacctggataagagagaactgaatgaggtacgtgggtcttggaaagtatcaatgctggccaggtgcagtggctcccgcgtgaaataggaaatagtataataaaccaccagaaccctcatcaacctaaattttgcagtctgtgtgctagtattttactgtatttgcttcatctgttattttttctgggctaatatatttgaaagcaaactcccagcatacatctcttaaaatttaatggcattttcatatataaccacaataacattattatacacaataaaatgaacagtaattcctcagtatcattgaattcttagattatattcaaattttcccagttgtctacagaggatcattttactaagttgatttgaagtaatgtctttcacacttaatggacattttgatctaggcattaatgagaattgaggtaaatcactttataggttttctacattgattcagtttctagtattgtggttatcctagatcagtaagaagtatattacacttgactccgttcatgccccacttcc

SEQ ID NO: 121885 - DNA, 1094 bp, Homo sapiens
ctgcctgaagtgtatgtaccatttctgtttcaccaaacctggttaatttctgctcattcttctttaaggtttagcaaatgtcactacctctgggaagacttcactgccctgcttctaaatcattctatcctgattcagaaccccctgtatctttatatatgactttgtatactcctggggtacactgattatgctgtgtgggaatttgcatgcctgccctctcccatcagcctctaggctctaaagccttggtcctgtctgtattcttgtgtcttgcttggttgtgatccacaggaggcactcgtgaatgtcgagtgtgtaaattgtgctggagtgtaggtgattcagacgttcccacctgcatactgaccccagtttggactatgagagctgacgtttcctttaagggtgtgtctgtcattttgagagagggttgttttgttttgattatttctgtcttaatagctttactttatcagtgcggttgttgttatctgatttaggtttctgtgctgatccctctcttggagaatggagagctcttgattcctggccgaggtgactgtctgaaagtggcacctggatttcagttttttgcaaccaggaggtatgtactagtaacctttctgttttcactctggagccacttactcgtaagtctgcatgctgagccagaggtcctgtaatagagttctctgggtctacttcaagcaaggttagttggaagtgataacaggtctaaccttctcattcctgattatttttaatgaagataatttataaaataagaggtcccccccccgacttaaaaataagtaaccagtttaaaacacttcaccttatttcatgttttaaaaaataatcagaggtgaggttattgttagatagcccagggtttgagtcctgacactgctacttagtacctatgtataccttggctggttatgatggggttaataataccttcttcaaatggtggctgtaaagaataagtgaaatgacttgtactaaagacctgtcacaataaatgcccagttaatggctagccatgatggtgataatgataggtagatttcaggcaattgaaaaattaa

SEQ ID NO: 121886 - DNA, 1667 bp, Homo sapiens
caggcatatgccaccatgtccagctaatgtttttgtaatttcagtagagatggtgtttcaccacgttggccaggctggtctcgaactcctgacttcaggtgatccacctgccttggcttcacaaagtgctggtattacaggcttgagccaccacacctggccctttgctttatttttaaaaatttatttatttttctagagtcggggtctctgtgtcacccaggctggagtgcagtggtgtgatcatggcttactatccttgaactcctgggatgaaatgatactgccacctcagcacttccagtagctgagactatgggcatgggccacaatgcccatgagatctttagatgacatacctgttgttattatagttttggtactactaatttacttacagaggtttgtgtaaggttagtagaaggcttactgtggaaattaacttcggttccttgggggaagaactcttcttgacatggcttttgtcttgcctctttagggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaaggtaataaggaaatgttaagttttggtggcttgtcatgcttgtaaatatttgcattaaaatattgcttttgctaagggaatataacaatagttattggtcttgcttataactgttggggccaacctatgtaaacctcaagtgcctacttacttacacctacctatagaagattaacagttaatcaaaggatgtagcattgccactacaggtatggtttttcagtaattactttatcttctttctgcagatgcttttggggatgtatcgctgcacagatgttcctggagagtttgtgtggcagcctggcaccctgacacaggcagccacaatgggccactggatccttctggaggatattgactatgcccccttagacgtggtatgtcatctcaggaaattcattgtcccttaatatattttcctgtcttggaaaagcattttgttaatagtgattctggtgatgatttaaacaaaaatgtatttgattagacgtactatgttgcaggtacttcatggttacttacctgatctgatttgcggtcctgaattacttgactggtttcttgtttgatagagattttctataaaattttggttgtgctgtttcctatagtagttgaatatgtgaccagtttcatagtagtattttcctcccttaattgaatatgagatcaacattttccaagaacaggtctggtttggaacatctcagccatgttacatgtacattgagaactttgagatcctgcttcttagtggtggcagctacagaggagtgggctgaggacaggtgaaggaggagatgatgtaataagagtgtgcttgcctttgtttagttaagaaaaatatgctggatttgtattttggtttgtaaaaagaccacttctgtgtgtaagaaattagccattgagacaatccatgttgc

SEQ ID NO: 121887 - DNA, 1192 bp, Homo sapiens
ccatttcaggttgaggtaagcaggaaccttcgtggaggtcttgctatagcatttcttttttttttttcttttctgggggtgacaggccagaggtgactgcaggtcttgcgatagcatttctgagtggtaaggtaattgacgagactctcctttctctcaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctggtatgttggtatcagtagggggtgtgtccccttccccctactaaacactgagtgtgctctgtctttggctgggttctatgtaccaggtgtgagctaaatttagtttgttaaattgctgcttcatttttggaagttaaaaagaaattcatcttgggcttttcccctgatattcccactgttcttgtttttattttttgttaattttttaaattgtagagacggggtctcactatgttgtctgtgctgatctggaactcctggactcaagggatcatgccacctcagtctcccaaagtgttgggattacaggcgtgagccactgcacccagcctgtccctgtttaatatgaaattagaaactaatggttcctgtgtgatgcctttaacttgcgcggagctgttccgtatatcttcttgtttgcttgctgcaaaaactgtgtgaagttctgtagcacatgttacgatcctatgttgatgtaattcaaaggcagaattacttgctggagacccttggactgctctgtggcaaagacaggcctaggtctagagatgactcccagcagcctcttctttcagaactatctcattgtagagagtccagtatctagtgaacttcctctctcccatatgcaacaagcttctttccacgaatggcttgagaccatacttgaacaggcttgcagatcataagtctggcactagtgggagccagtctctttttccatagcagtcttcagtcagttgtcactttgtctgatggtcaggctgtagtgcaagtgcagtggcagaacctcggctcactgcaacctcccccctcccaggttcaagtgattcttctgc

SEQ ID NO: 121888 - DNA, 1027 bp, Homo sapiens
caagaagagtatctatttggttttgaatcccagttattaaactacagtatctggctcatagaactgaataaatgtttgttggaaatgagtgccttttccgttgtaaacacttacattaagtaccccccgattttgtaggtaattactttagatttttgtatcctcttagtcagaattatctcatgccattgtcctggttcctgaaattgaacaggatacaattttacgactaagtagattcagcattcattcccctatgttctcagacccttgggagttctgttttgtggtttggtcagagtagagaattgcgttctatgatattcccaccaatcaatgaaaatatagatactcctttttgaaaatagcttaagttgaaaatgcatttaatactctgataaacctattacaaagcagaaaaattaagtccaaccattgttaagttggggatgtctgtattctttgtgtttgaaggtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtgcgtagctgttagacttttttgcacttctagtgtggggatggtacagggcatgtgtggagttgtgtgtgtcaggagggaaaggaaaccatttaaaatttgttatttttgttcttgtggcttttggggttttacttcctttctttaatcatgtgtcattgcagaggaaaatgagatgatatgaatggagtttcacctttttcatgttccatcaagtaaatccattgtgcctgatttgtattttctgttcttaaatgtgttgtaataattgagatttccttttctagtgttcagttggctagtggattttatttattctttattatca

SEQ ID NO: 121889 - DNA, 1050 bp, Homo sapiens
gaaaaggccgggcgcggtggctcacgcctgtaatctcagcactttgggaggctgaggcgggcggatcacgaggtcaggagatcgagaccatcctggctaacatggtgaaaccccgtctctactaaaaatataaaaaattagccgggtatggtggcgggcgcctgtagtcccagctacttgggcggctcgggcaggagaatggcatgaacccgggaggtggagcttgcagtgagctgagattgcaccactgcacttgctcctgggcgacagagcgagactgtgtctcaaaaaaaaaaaaaaagtgaaagatgttttgttttgcctttctcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtgagtagcaattttattattcgcatttctccttgaggtgatagaacctgctgtctcctgggatgtaagggagtctgagctgagaaggtaaaacggaaatacagaaaggagagagataaatagtattgttttataaaaagagtcacagcagaatccatttatccagctcagttcagtgagcatttactaggtttctcttaaatcttggccatcagaacagacctggaaagatggccaggatatgtccccagtgctctcaaggattgtatcatgtggcaagacatgcatatacagcggagtaaatgaggtttaactgaggctcttacagcatccacctctaatgggaaagattccttgcttgttagagcagctgaaggagtggattagaagagctatagtatcccttccaaattctataaatctatctgaattagtatactaagagctgtgttagagctggattttaatgtgacttttaaagagatagtaaaa

SEQ ID NO: 121890 - DNA, 1009 bp, Homo sapiens
gctgagccaccttaaaaatattttttcctggccgggtgcagtggctgagctcagacaatctacctgcctcggcctcccaaagtgctgggattataggtgtgagtaaccacacccggccaataaaaatgttttttcttggctgggcgcggtggctcacgcctgtaatcccagcactttagggggccaaggtgggcgaatcacgaggtcaggagtttgagaccagcctggccaacatagtgaaaccccgtctctactaaaaatacaaaaattagccgggtgtggtggcgcatgcctgtaatcccagctactcgggaggctgaggcaggagaattgcttgaacccggaaggcggaggttgcatgaaccgagatcagggcactgcactccagccagggcaatagagcgagactccatctcagaaaaaaaaaaaaagttttttcttgtatttgttaagtaatcagtattcttcagctttcctcatacttgcttgtatcccagctacctaaataaaacccatttaagcttcacagaatgttaagagaagtgagaaaatacaaaggtgtagccaggaggaatgcagtcctttcccttttccagtgggtcccagtctcccaagaagaaaggcaggatttcctaagaatgttatgggagtaatcacaggtttaagaagtaaatcctggctggttgcggtggctcacacctataatcccagcactttgggaggctgaggtgggcagatcacgaggtcaagatattgagaccatcctggccaatatggtgaaaccccatctctactaaaaatacaaaaattagctgggcgtggtggcacactcctgtagtcccagctacttgggaggctgtggcaggagaattggttgaactgaacccgagagggacgcggaggtcacagtgagccgacatcgtaccactgcactccagcctggcgacagagtgagaccctatcttaaaaaaaaaaaataaaaagaagtaaatcctttaacattcattgt

SEQ ID NO: 121891 - DNA, 1166 bp, Homo sapiens
tcaccatgttgcccaggctggtctcgaactgctaacctcaagtgatctgccctcctcggcctcccaaaatgctgggataaagacatgcgccaccgcgcccggccgagaatcagcttttctctcacatctgatctttccgtgtgttaaggcagaagcaaggcacggtgggctgagactcacacgccccctctttcctccccggcctaacgcactcttctttctgtcccaccacgtgctgtgttcgcgagtccccatcactcctgcatccaaaccgactagatttttgtttccatttccctcccggaaaaggcgggacagcgaagactggcgtttccgccgctgaggggctgaggccgggagggcgcagcgtagccgtcccgagctgatgacgtcaaacgccgtgtgctcacccacgtgtggtgcccctctcccggtgtaggcgctggagctgaggacgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtaagacgtgaagggagagggaaagcgccggaacgactgggtcgccccactagtaagcttcctgcgctcccccgccgatactcgccgctttaagtggggagtggtgcagcctcaggtcaagctggccccctcctgtgggctggcgcaggtcgtggaggtttccgagcgtgtttgaggcgattggaaggagtcttttgtttttatctgggggagccttccagtacccttcccatcgcctctcacccctatgcaagcgctttggctgcttgtggcagaggtggccttcccaaaggaatgtggtttgtttttctgaaattgaggttgcgtttctgccgttttgacaagtgtacgtatcacctaagtgtgcgtagtgcagccactcctgttagtttggggaaccatcgacaaatactgattgcattcctgctgtgcgtaaggaacggtgtggcgctgtgagaaagtggatagataaattcgttacgatctctgccat

SEQ ID NO: 121892 - DNA, 1049 bp, Homo sapiens
tccggagtagctgggattataggcacatgccaccacgcccagccaatttttgtatttttagtagagatggggtttcaccatgttggccaggcttgtctcaaactcctgaactcaggtgatccaccagcctcggcctcccaaagtgctgggattacaggcatgagccaccacgcccggccttttttttttttcttttctttttgagatggagtcttgccctgtcgcccaggctggagtgcaatggcgcgatctcggctcgctgcaacctccgcttcccaggttcaagcgattctcctgcctcagcctcccgagtgtgggattacaggtgcgcaccaccacgcccagctaatttttttgtatttttagtagagacggggtttcaccatgttggtcaggctggtcttgaactcctgacctcgtgatccacctgctttggcctcccaaagtgctgggattacagacatgagccaccacccccagctgctgttagacatctttatctggatgtcctacagataactcaacatgacttcactggttgtccattgcagttaaagcatgactgtcctccaaagctagaaacatgagaatcatctttaacaaattgggtatttctttaattcaacagatattcttttattacttgccattctgctaggcctgctgagagctggggatacagtgagagctggggaacagaacagggatggtcctaatctttatggagaaccattgggtggtccattgggtgagatggacatttctccaggaatcccacaaaaatggaatcatgaacttcaagaagaggtcatgtagggaaaggacacaatggggtaagagtatataacagagggcctgacttagtgggaagagagggtggacaggggagactcaaaatggcttaagcaaaatatcaaagaagagctaagtgaaagtagaatattgaggaaagaatattccctgcagaagccctgtgttgtttttttttttttcgatttataaatagtttatcctgttcacattatgcagaatttcagtgtcgttaatcc

SEQ ID NO: 121893 - DNA, 1059 bp, Homo sapiens
atcgtgtcaagaagtgttcgccaatgtgagcctaatttaattgaaccttgggattttggaaaccttgagatagtgaataatggagctagaatggtaggtgtcagtctatgtcaggataaggaagtttttttttttttttaatggagtctagctgtgtggcacaacctcggctcactgcaacctccccttcctgggttcaagcaattctcctgcctcagcctccagcagttgggactacagacatgcaccaccatgcccagctaatttttttgtatttttaatagaggtagggtttcaccatgttggccacgatggtctcgatctcttgacctcgtaatccacctgccttggcctcccaaagtgctgggattataggcatgagccactgcacccagtcaggataaggaatttgtactttatagaaattgggaagtaacggaaagtttttgagcaggattgcggtagaactaacccagtagttgtgcgtagcatgtatttggagtggggaaataattaggtagctatagtggggtcctgaaacaaatcgaaatggcaagaatgggaataaatgggagaaatatttcagaggtagcatcagtaaatcagtagtctgttagggaatgttagtgctactccaagaaattagagaaatgaggaggtgagcagatatggatggaaagatgatctcttgttttggacttggtgagtttgtacctacaggaatgtgtttattaatgttagcatttgtttgtttgtctgttttgagacaaggtctcattctgtcactcaggctggagtgcagtgacttgatctttgctcacagcaatctctgcttcctggttgtgcttaagcaatcctcccacctcagcctcctaagtatggttgggactataggagtgtgtcaccacgcctggctaatttttgtattttttgtagagatgggatttcgccatgttgcctgggctggtctcgaactcctggcctgaagtgatccacccacctcggcctccccacaaagtgctgggcccacaaagtgctgggattacaggtgtgaaccac

SEQ ID NO: 121894 - DNA, 1054 bp, Homo sapiens
cacaaatctgcttttaataatgttagagagaaaggccaggcatgggggcttacacctgtaattccagcactttgagaggctgaggtgggtggattgcttaaggccaggagttcaagaccagcctggccaacgtggcagacaggcaaaacccggtttccactaaaattacaaaaattagccaggcatggtagtgcactcctgtaatcgcagctatggtacactcctgtaatcccagctactcgggaggctgaggcacaagaatcacttgaacccaggaggcagaggttgcagtgagcagagatcaagccactgcactccagcctgggcgacagagtgagactttgtctccaaaaacaaagaatgatagagtgaactttttcaatgtgtccaaattcgaaaattgctttttgttttgaagctaggtttattctctgaattgtgaggtttattttaacagtggaaattttaaaatatttaataccgtaggtggtgactctcaaaaggaaataggatcatggcagcagatgatgacaatggtgatggaacaagtttatttgatgtcttttctggtaagagctacatttaattgtctttctaatttcctttttttttttttatgagacagggtctcccccagttgcccagggtggagtgcagtggcgccattaatagctcactatgacttcagacttgggagctcaagggatcctctcgcctcagcctcctgagtagctaggactacaggcacatgccaccacggccatctaatcattttattttttgtagagagaaggtttcactgtgtggtctaggctggtctctaattcctggactcaagcgaccctccctttttgcctcccaaagtgttgggattacaggtgtgagccactatgccttgcctaactttactttttaaattacaaaatcatttacctattctcattggaaacacagtcattatcagccttttccctctatacataaatgaattaataaaataaaatgcctgggacatgggaatgcttaataagtgtgaacttactgtatgctttca

SEQ ID NO: 121895 - DNA, 1048 bp, Homo sapiens
agactctctctttgtaaacacacacacacacacacacacacacacgtctagatgcacacccattttttttcctgacccatttgagagtaagttgtatacattatggccccttacccctaagtatttcagtatgtatttcataaggaaaagttggttctcttatataaccacagtgtaatttcagtttcattagatttaacactgataaaatacttttgtatttgatttgctatttttattccagcgaatgatgttctttattattgtagttggatttaggtcattttaatatttgacttcaatttttctcatcagttatttttttctgattttctttcaaatattatttgagtatatatttatttacttattttaaatttttaaattttttttctccctttagcactagtgctaactgctagtaatgtttgagtgtatttttgaaatgcatttcatttatgtatgagctttttcactatacctgtttgtattatttttagtatttgtttgaggaagtgtatacatctttaacattttgtagtctgtttactagtattgtacctttttacaatatcttgcatgtatggttgcatctatctgcttctttgcctttcatgttagaaccccacaataaaatgctatagtgtttactgggccgggcgtggtgtctcacacctgtaatcccagcactttgggagaccgaggcgggtggattgcctgagcacaggagttcgagaccaacctgtgcaacacggtgaaaccccgtctctaccaaaatacaaaaaattagccaggtgtggcggtgtgtgcctgtagtctcagctgcttgggaggctgaggcaggagaattgcttggacctgggaggcggaaggcagaggttgcagtgagccgagatcgcaccactgcactccatcctgggcgacagagcgagactctgtctcacaaaaaccaaaaaaaaaacccaaaaaaaacaaaaaaacaaaaacaaaacaaaacaaaaaaaatgctatagtgtttactgtaacagttctatggatcttaaattaa

SEQ ID NO: 121896 - DNA, 1050 bp, Homo sapiens
aggctgaggcagaagaatcgcttgaacccaggaggcggaggttgcagtgagccaagatagcgccactgcgctccagcctgggtgacagagggagactcctaaaaaaaaaaggtgtgacaaatattttcactttgtgaggccaaggcgggtggatttcttgaggtcaggagttcgagaccagcctggccaacatggtgaaacaccatctcaccatctctactaaaaatacaaaaattagtggggcgtggtggcgtgcacctgtaatcccagctactcgggaggctgacgcatgagaatggcttgaacctgggagggtgaggctacagtgagccaagatttgcaccactgccactgcactctagcatgggtgacagaacgagactcaaaaaaacaaaagaaaaaagtgtaacaagtatttttatggaaggttttttttgtttgtttgtttttagacagcgcttccaaatcctgtgtaccatcaagaaattgtttggacttatatgaagagatcctgactgaagaaggaactgcaaaggaggcaacatataatgatgtatgggttgccacaattattaaggacagttatttactgttttgtagcttctgaagagcagtcagctgcttagttttgaacagatattttgtttaggaacttagctcttagactaacaaatatttaagtcagtttttgtcttcagacctgttttttaaaggaatgttttctgaatacttgtctaaatttagttataattttgcttgacccaatttaagcatctgaatataaaacctcaacaggcaaacagtgttacaacattttttctttcatgatatgtacaaagttaaattatatgttgcataaaatgtcctcagacttctatttctttctactatatttgaattttaaggtttggatgttgaatgtgaaactaaacaaaatagattatttgtaggcttaactttaaaactggttatctttctggtagaagtagacctcatctgccttcttagtgaattgatttgcaaaatttaaaatatttagaaatgccagtt

SEQ ID NO: 121897 - DNA, 2687 bp, Homo sapiens
ttaatcatgaattactcatgtgaatgaagtttggaatattgctaaatataatttaacttttttttttatttcataatagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaaggtaatagtttgtattatcttctataactttgcattttatgagaatgtaaaatacataagatgaattggtgctttttcttttttgataacataaaaagtagcatattactcagcccctgttatctagaagtgcacatggagggtttttttgttttttggttttttttagatgaagtctcactctgtcccccaggctggagtgcagtgtgcacaatcttggctcactgcaacctctgcctcctgagttcaagcaattctcctgcctcagcctcccaagtagctgggactacaggcgcgtgccaccactcccagctaatttttgtattttttttagtagagtcagggtttcaccatattgggcag

SEQ ID NO: 121898 - DNA, 1862 bp, Homo sapiens
ccaaggttgcaccactgcactccagcctgggcgacagagcgagactccatctcaaaaaacaaaaaaaacaaacagtgaattgcctcagtatttaattttttgttatatgtaatatttaatatggacatgtcaaataactaaactttaatatacttttatcttctataaatgtgtttaatatatttttctcttctacagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtc

SEQ ID NO: 121899 - DNA, 1940 bp, Homo sapiens
gcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaaggtaagaatcttgtgagacattgaaatcaccaggaaattttgcactcagaaatctaatctgtctggctgggcgcagtggctcatgcctgtaatcccaatactttgggacgctgaggcaggtggatcacttgagcccaggagtttgggaccagcttgagcaacatggcgaaattctgtctctacaaaaaaatacaaaaattagggccgggcgcagtggctcacgcctgtaatcccagcactttgggaggctgaagcgggcggatcatgaggtcaggagattgagaccatcctggctaacatggtgaaacccaatctctaccaaaaatacaaaacttagccagacgtggtggcatgcacctgcagttccagctagttgggaggctgaggcaggagaatggcatgaacccggggggcagagcttgcagtgagccgagatggcgccactgcattctagcctgggcaacagagcgagactgtcttaaaaaaaaaaaa

SEQ ID NO: 121900 - DNA, 1028 bp, Homo sapiens
tctatcttgcacaggtttattttttaaattaagacataattcccatatcataaaatccaccctactaagatgaacaattcagtggttgttgatatatccacaatgttgtacaaccatcaccactatgtaattctaaaacattttcaccaccctaaaaggaaatgctgtacctattagcagttactcctcattgcccactcccctcagccccaggcaaccagtaatctaccttctatctctgtagatgtacttgtttggggcatttgtataaatagaatcttgcaagatgtggccttctgtgtctagctcctttcactttagcataatgctttgaaggtttacccttgccattgatgtactcaccaggtatattgtcatgtattagtactttgttgcttttaattcctgagtaatattccataatgttgatccattttgttgactaataccacattttgttgttcattggttgagggccatgtgggttgtttccactttggggctattataaataatgctgctgtgagcatttgagtacaagttgtttttaagacatgttttcagttatttccataatattcctaggagtggaactgctaaatcatataactttgtatttaaccttttgaggagctactagactgtttccaaagtggctataccatttcaaattcccaccagcagtgtatcaaggatccagtttctctgcatcctcgccaacacttgttattgcccatcttttttgttagtgccctctagtgggtgtgagtagttatggtttatctcattatggtttataggtttgtttttagatgttggaaattatagaaaattacagtcattttccaaagtagtaagcctcttagtaagacagctttgtaactggaccatttctacttaattgtagattttagtaaagaagcaccacagagagtttctttgcacagtcaaaagtatggatttttggacttgctttattaacatgttttacactgagagagataaaagtgtatgagagtaagagagtg

SEQ ID NO: 121901 - DNA, 1049 bp, Homo sapiens
gtctcctatcctgaacttgtctggatttctcagttgacaactactcatataatcttgcaatggcttttccattgttgacttgcttacattgttacttagttaacttttcatcatttgtacctcttctacaaagctaaatcttagatctcttgagcacaggcctgagtcctacacatatccttccctcacaccactagcacagaagaagaaacagactggacttggtttggaatcctagctctccactgactagcactgaccatggataaactccttcacctccctgcttcatagtttccttatctacagaataagggcagtcatgcctgccttgcagggtgttacaagagcacagtgctgggcactaggagatacttggtaaatggtcattctggctcaccaaacaaagcctcacacacagaagctgagcaaaatcttgcagacttaaatatgacaaagcaggactgaaaccagaatgggagaagagctagttatgagctcttgaactttcatggtgaggacaccatttcctctgcccttgggcttaagtgacagtttacaaaccagattttttatctatgactctttcatgaccatatgacgatcatttcaagctcaggaagtttcctaagcctcagtgatctaaggagtgccattgatttgtgatgtggagactttgctcattcacctccttggtccaattcatacatttaagcatcagctcgtccctgagcggagatgctttctccagctccttgcagccatgtggcagagggtgactcccagtactgcttcctgatctacagatccccatggatgtccctggcttctttagaaattttctttacaagaggccacagtggaagatagtggtaagacttacttagacctacagcatcaaaaaaaaaaaaaatggtgataaggatgggagtatgagaaaaactgtgtgaacactctggggactgttgtggggtggggggaggggggagggatagcattaggagatatacctaatgctaaatgactagttaatgggtgcagcacaccag

SEQ ID NO: 121902 - DNA, 1017 bp, Homo sapiens
atgttcttctgcactggccaatatggtagccagtagccacgtgtgtgactaaggaactgacttttttattttatttatttattttttggacggagtttcactcttgtcacccaggctggagtgcaatggcgtgatctcggctcaccgcaacctctgcctcctgggttcaagtgattctcctgcctcagcctcccgagtagctgggactacagatgcctgccaccacacccggctaatttttgtatttttagtagagacagcgtttcaccacattggccaggctggtctcgaactcctgacctcaggtgatctgcctgcctctgcctcccagagtgctgtaattacaggcatgagccaccacgcctggctattttacttaattttaattagacaacatgtgacaaccctattggacagtgcaggactggagtacaagttccaagtgtcatgcctgccttttcacagagctgagcacatagtaggtactcaataaatatgatggaatgaataaatacaaagaagcactataaaacagaagcaaggatgatgtcctattcaaatccatatactcctttcaggagaattttggcacctgcttaaagaaggaggcagaggatggggatttcctataaacatttaggatattcccagattttaaactgaagctctcagcacctgcaggtggggtcaaatcaaggcaaagggaaccaatgaaactgggtgatgggcaaggccagggtctgtcctgtggtccctgccttcttggtctctgtttctgggtcttccaatgcctatgcttttttgaaacatgttaagggtaatcatcaaaatgaaaaacattctgcaggaatggggaaaagaaaacatttgttagaatggctgaagagatatgggggagattgtgcgtaatttggaatgaggggctcagaacccaagacccggccctgcttgccatggctctgtaaccttgattaagttacttatactctccaaaacaccgttgcctagaaaatgaga

SEQ ID NO: 121903 - DNA, 1006 bp, Homo sapiens
cggttctgtcctaaaacctgtctaaggagctattaaggaggaaaggctttgagctattttctcctgccattttagggtgtatagaatggcagggtgtgtacaatatttataacttttttgatggctcagttattatgtcaagcccaagaaaatacaagatggggcaggctgctgtccattcaaacaaaactgtgggtctgtgtgactgactacccttgctcacctgataggcctaagtagaaaaagcttatttttcagtgagggaaactcatgcctggaaaaatgctgtataaatgtgatgaaattcagactgctgtggtcaacatttatttaatttcaagcttctgcaacagtacagatggatttgtgttgaataggaatgatggtctttgaaaacttacataagaaattattgacttgatttttttaaaatactgccttctatttcatcctatcaatgctccctgtgtttcctgcaaattgttcatgatctcagcaaactggttggactaggccagcattccaaactgaagtagatcgaagtaggtgtcattcatagacttataggagacttggagaagttcaagagagctctctttgttttgctagtggtatccagagtaaatgaaaatactatcaaccttgtctttcttcctggtcaactttatgctgagggaatactaagaaccataacacgtgttgggctgttgtgctataaggggagaagcatcaaggattggaggttaaaaaataaggcatgttagagtccaggccccatccaatttggaattttttttttataataatggcataggtacctcttcagcctctgcttgaacacatgcaacaatggggagctcaccaccactgaagagagctccttcctccattttatacaaccgtgactactagcaagttcttccttatttgtggcagaaatctatcttccttaaaatttcactcatgatcccgtttacaccctctggcatgaaagagaacaaatcta

SEQ ID NO: 121904 - DNA, 1047 bp, Homo sapiens
ttttaaggggtatgcctcccaagtgatatcgcgagcatcaactcttacttagcataggtgagtgcaagatcctgcaaggggatgctaaatttctaaaggacaaagcacttgttctcaaagctgtttgtaatctagtgccacgtattgttttaaatgccatgaacaaattcaggtacaggtgatcactcggggtcaaagccattaaggtgaatgtttgatggacactattattataccaaaacaacacatgcggaaacaaagtaacatcacacacactcttttcttgtcacaagcgataagtcagaactgtgcattaaaggatcagactgtcttcacagtaacccgggcaggggtcaatctgagcctggagtgtcagccaggtgttaggtatcttctgatccaaatattcatgaaatacaatacccttcgctgacagccatgatgtctctttgtcacacatccccactggcgtagtcggtatgatttgaccttataaagctttgagatataacttccagtgagaggaaaataaaggattagaggaacaagcttaccaacaccatgaggaagcaaagggacaaatctggggtcgggggatggtggtggggtgggagggtgagggtaattctacaggacaacttcttgcaggcctgatttcttcaataagtcagtgacataaaaatggactgcgctaagttaaacaagatttaagagctttaaaaaccagatgtagttcatggtcctggagtggttactggtttacacaaaccagttataaaggactctggagtgggggaaattggagaaactcaaatatgacccaagtagttgatgaaaggtgatgatcagaaaaagtggttggaggaacgatatgcccagtatgatctcactgtggttaaaaatacaaatgtgagtgcaagtggtgtgtacatacgaagagccatgagaacgtgtgcaaagtaaaaatatcaacagggtgacctgtgaatggtagaaatgtaatggagttctttttctttgtgtgcattttctaatttcttacagtgt

SEQ ID NO: 121905 - DNA, 1011 bp, Homo sapiens
aggaggtgtaccatattcatctttgtatacctagtaccaggcttacaagggagaatgcagttagggatccacaaatattaactgattctccctctgtgccttcccttagataatttctgttttgtccttcagaattcagtttaggcattgccattgctgggaagagtctcatctgtccttgatggcatttgtctcgttagccactatattatgagctccagaggcttgtgtttgtgacccagcacttagcaaagtggctggcatgtggtagacacatactaaatgtttcttagatgcttaaatgactgaatctttccatgtttccaagtttccacacaattttgctcttttttgagtgtgttttcgttcatccatgtcaacgtatccagagctctcattggcagccagcagtcattctaaaacagagctttcactctttcagacgtggatgggacactggggaagacatgagatactgaggcttcattttggggtctttatttcctgttttgagtattacacagagatacagaggaatatctttgatcatagtggagcaggggagcagatatgaacagagtcctcatggtttttaggggagagaagcctgtaagactatgggaatgaatggaaattttaaaagtccatggaagctggcacctttaaaaatgtgccaacttttagtgcctcatgattaaaaagcaaaataagtggcagacaaaaccctgtgtacttggaaagaaatattaattttagaaagtatgcaaaaggaatttttcacagtgggatacctcttgcatcaccatccttttagtgtttttacatgggatgagagtcctgtgggcctgagaagtttttggtattggtaatatgatatttgaagtaaccaaaagaatttggtgaacccactgacttggttttgacttttgagaaatacagcttaactaccccaaattcaatgcaacttatctcggacttacggcaaagattattttatcttagttgtggaag

SEQ ID NO: 121906 - DNA, 1315 bp, Homo sapiens
tgttacaaatctaaagagctagtgagtgttagagccaaaaatttaacttacatccttcagcttcttcccaggcaagcagtaactcaatggatacacattaagacatactcataattattgctcagagtgccaaggtttcaagagttggctgccaaatgatgaggcagtagtcattcagaaagtgtgcttgttagagggaatttttaaaataattaaaattgaaactctgaagttataacaaatgagcagcagattttcaaaattaacttttttgcacattttagaaatgtttacctcaaccctcaattcccaagaaaccattatatttcttcagccttttgcccagaagttcttaggatctttcctaggaactgccacaatggcaaattaacataaagttttgtattgcattgacaccaaagacctttcctttgccctggttcctggttgaaacaagcgtgaaataccatgtctgatgacatgccatggcagcatgaaggcttaggcccaagggataccaaggcaggaggattgcttgaggccaggagttcaagaccagcctgggcaatatagtgagaccctgtctctacgaaaaacacaaaaattagctgcacatggttatgcacacctgtagttctagcaactcaggtggctgaggcaagaggattccttgagcccaggaattcaaggctgcagtgagctatgatcacaccactgcacaccagtctgtgcaacagagtgagaacctgtctctaaatatataaataaaaaaaaaatagaaagacctagacctgaaactaatctcggttattataccctcacttcatagaatatgccacagaaaagctacgactgaatttctaggtgtcacaagtcagcaatagaatggaatatgaatcaggcctcttatcatctagacaggtgctctgtttgcttcaggttttatttgaaatctttaaggagagatttaccaagagactttcaggggagcccctagattagccctttagacaccagatgatttgagacctttgagaatcaattgtctaggattgtgtttgccagccctgagatccataacttggaaaataaagtggagtgccaacccaagttctggttttggggtttgctggagagaactcaggccccagcataccccagggtttgatggtgtgactctacaggaggcactgacaaggcctttctttaccacaattatccactaacttaactcaccctcagaatataaatactcctaggaacgtcaggatgggttattataagacagccacggctttcaaaaactgcggacact

SEQ ID NO: 121907 - DNA, 1043 bp, Homo sapiens
aaaatggaaatgatattgttcacttcacagaattgcctgaggtttaaggaagatgaaggagtcctttgtggatggcagtgtgctgtccgtaggtgggtgcttgtccagaacccctgctccttgaccaacaacctctaaactcagttttgtcaccagtacaatggacataatttccttccttgcaggtggctttgaactggatgattaaataaaatgttatatataaaagcccccagcagagtaactgccacaatgatcgtgttgtcagcctcattccaccctctggagctgaggaagacaggagaggagtgtcctttctcacccacctctgccagtcaagttctccgaaggttctcttttacctgcccccagacctgacctcatgctcacattcctctcctgcttccctgtcaccttagcatggagtcttcttctctgctttttcttcttccttcctcctctgcttccatcttttcctaaaactcttttcttctttatctcctactaatttccctaatcgccttcttgtctgcattctgtaaaggattgttctaatgaatacaaagtttagaataatattctccataacttccttgttcaaaacaagatgttatgtgtagcattttggggagggagtggtgagtccttttccattttcctctgaatttgcttaaagtctttttttctacgttaacattttcccattcttgcatcccttgggcttgtagtcattaacttgccagacacacagcaactgattgtctttatgacgttgctaaagttaggagagtgtcattcacagggaacttaacccatatattaactcagacatagcaaattgctaaatacgtgcctttaaataaagagcttcagaatgccaatttgattctcttgttcacatcctctctcattgaaagggggttgctgaaacagaaaaagcaacgggaaggggaggataaatttcaactgttttactgagtcagaaattggaacactgccatccggatacaggcatctcatccatccttccatccatccactca

SEQ ID NO: 121908 - DNA, 1537 bp, Homo sapiens
taattattctattaagtacttctgtttttgcattaccataatgtctgctgtagcggaaacttttctgtagaccttgacttgtcagaagtcaaccccttaatgtgagcacttcacttacattatcattatggtgtttccaactgacaactgctgccacactgccatcgtccctgagttcccagcgcttcagtaaaagagacttttgttctggcttgttgaggggaaaaatgcaaacaacaacactagctctaccaccagagatcctataaagacatgttcaaatgaacaataaagtcatttgttcacatatgacataaggctataagaatttaaacaataagacctcttgtgaaatgtggcaaaatatgcaccacaaacattgtgaagttctctgtcttgtggaaggcagtttttacatgggcttcaaaaaaccattaacttataaactacccttttaaaaaagaaaagaaaatcacttgtctcactataacattaaagcaatttctgttctaaggaaagcttaaatgcattcatttatacaaagtgcatgcactataatttataaaaagcacagtattctatcaggaaatgcggcacctcttccctccttcacctgaaatgggaaattcctccgtttttgtcaagtcccttttttctttgagtaatattgatttcttcaaaatgaaagaaaaaaatcctttaaatcacttagattcaagacgaagttttaaggcttgataataattctctaaatacttctgacatgggtggagcatggagagggaataatcctgctctgaagggaaattttaattgaatttgctttaatgtgaaccctatccttttttgctttgaacctttaaggaaaacttgttatattttcagacctcagcaaggcagaaaaatgcagagatttccttgtccgctcatgtcagggtgtctggcagcaccttaaaattgttccgattttgatgtttgaaatgtgacctcccaggaaaagtgggaggagaggagagcatgtgttaactggccaaaggtgtttcattgagctgacttagtattaacctctaaaggttttcaagtatttgcagatggatatgtacagcatccttgcagaattctcttaattgaagaaatgtttcatctcgatctctgttgacagaaaagattgcctactgataattgctttccttaagtgtctgataatatgccaggaatgagagcattctgtgttaggtcatctttaattatgcatgtaccacctgtcagctctaaatcagtaccagattagattctcgcagagtcagtttggggaggttcagagggaaagctgaggtgatctcttttagaaacaacaaaaatagacagtagtaaacatgccttctaacctgaagctttttaaaggagcctcatcttcattgttctcgagcaagaatacgccattggtacatctgaaaaacgtttgaaacctcgcccaagcggggataacttactgcgaagatggatgactgtgagcgaggatggtagtacctcctcc

SEQ ID NO: 121909 - DNA, 1052 bp, Homo sapiens
gacataccaacttagagtctttgaaaatgcccattggtaagtcaacattgttttccctgaaagtcctgagacagaaaaaaaaaaaaaatgaaagtacaaacactaactggaaaaaatgtcacacattttagccactttgcatcccttgttaggacaaaccctggtctgggtttttttacattttgaagttgtgtggtaggtggggcagtgtgggtggcccagaaaaagtagcggttagaataagattttccatttattgccctttgtgcatggctaaaaataagagtcatacaaatcagaatatgtagtgcaagcaaaatcactctgttaattctgatgactggtttgcccacatctttgcatctgtctggtaagtggtatattgggaaataatttgtctctgtttaaatagcaaaaggcaaccaagtttttgcgttgtgtgtctacacatgatagtttatcagcacttttctcttccgaaggaagaaagatccaactcatacataaacaaattgtgttgatggaaggaagaaagaagcgtgaaacccttgaatcttttttaaaaaggaattgccttatttgaaatgcagttttacaacatccatcttcttggcttattgttagaaagttatttcttgtaaactcatagcacagcaaggaaaggatatcttaatggtgttgccctagagattggaaaactttttgtgtgtttggttggaggagggagaagggacaaggatgagcacacgcctgccctgtagtatcttctgtagacacagatgttggagggacagttaaccaagtaaaaactcccctgcatctggctgctgagtcgaatgcaaccacagtaagtgataacgtgtccgtttgtggctagaagaaacaccaaagagaggcggcgccagcattcacagggaaatttgtgccttcgcaatcccattgatggtgctgtcccattccactgactgagtggttgtggcatttccaaagaatgagaatgtctgcaagtgttctgagcctttcagtctgatgagctttgtaaaatggatgag

SEQ ID NO: 121910 - DNA, 1042 bp, Homo sapiens
atgtaaatcatttctgagcaagaaagtcacatcttcccagcctcccaaagccattttaagtgcagggttattgttttttaaaggaagaggaagatgaattatttgtgtctcagaaagctgttatcctggcgtctccttttctgccaaggcggtataataaacagctctaccccacttcccaccctggtgcctgaggcttgccctagagggaaatgcctttgaaggaaaaaccaccagcaaggccagttgtaacagaggccgggggagaggctcgcagccttgcttcacctcaaaaagggggtccacgtcttctcatgcctgcagccatcaaccccggagcggagcgggaaatccttacctggagggtggcatttacaatctcagacgcatttcacagtctctctttggagcaacttcagtgtgtatgggctggaaaagagggtaagtgtgttacttttttttatgcaacaacgtataactgtgtcaacacataagacagtctgtcaaagctttctgctggtgttgctgctgtgaattaattttgagcgtcacttgtgagcagtaaacacttttgcagtgtgaacaactcttttgtacagtaggagttgtcaacagcttgccatcccccctttaaagggaggaaggaaacagaggctgcctcctccctgtcaagttaagttggctggagtaggaggagcagaaatttgtggcactcccattttgcagttttatcttttcttttgaccactcggctgttagattttcagtgagactggaggataaatgtagtgtgtagaattaagaatctgattaagccactgggcatctggccacttcttgctgttttagaattggttctagaatgtatggtctacatcacttttgcccttaaatttgttagagataccaccataaagagcaagatgcaaaaacacaacacatctgccaaacactgactagagagagatgcttctcagtgttttacattttattgctgttatgttgaatatttaattgaactttatttacacagttaaaacat

SEQ ID NO: 121911 - DNA, 1021 bp, Homo sapiens
ttttatccacatatattttgcagatactgaaagcaagcttatgttgaatttagagaagctttaagtttttaggaggaaactgcagcttatcagcagatgtcaagagcatacatactttgaaagctcgttgaaaaaaattatgattccttttgtgcttgacacttaccaaaaaccaatgttccattcagataatcttttattgtcagttttttatgctccttagggtaaaagtcacaaatatatacacaatttgataaaattcaaaaggaacaaaataagcactattcctcctttggcctgtatccgcctctttcccatccccagttttgtacagtacaatgtcactagcttattgaattagatttactttaatcatccatttccttttctcctggttaccacaatagctatgggctctcagttagccagctacatctgatctagagaaaataggttatgtccctattttgaaaagagaattatctgcatggctcaatgctttgtgtatttaatagttagaattctggaagagatgtggacttccttcctgagcaataaaatatatgtatagtgaccatttcttaattctctagagaatgcagacaaagggatttgtgtagtctatgaggtctgcgtatataaaagttttcctttgcctttagttgccttattttacttttaggatgttttgtttcttttcttatacttccatatattttcactcttttccctttctttctgaaacacatattcagttgtcttaaaatcaaatcagctgtgcagtggatactgtatttggctttttccacatgtgttaattgttctgttggcttgttttgtttactgtttttgcagacctgatttgccatggtccgtgcctttcattctactagaccacgtagttgatttcccagtagggaaacgattctgctgtcttacccagtaattagttatctcatttcaaaagagacaagtttatctgagaggactttgtcacacgttaaatgtctgctttagaaga

SEQ ID NO: 121912 - DNA, 1130 bp, Homo sapiens
gtaagaaagtaaatgaatagaaatattgatcacaatagaacttcaactatacgatgccaaaacttgtaaaaaatcctcaggttttaaaaatagcatgaaactggaaaatgtttttttctgcccaccaattcccacaaaggcaaaaacaaacaaaatatccagcaacaactgactatcaaagggggctaaatatctgttagacttaactcactaggctggttctgaaagtcccaattggtgaaggtataaaagcccattcatttctttagtgcaaaaactgacaaacagggcaaaagtaaccagaagggaacaaagagagcagtggagacctttaaagacggcagcagtgtacaccagggtgcaaagcagcaggcactgttttaaaaggagcaccgttaatccagagactaaagctctgcagaccaagagcaaagcaccatttatagctcagttcccacaagggcatgaccatgctctattacaagcacatcagctgagggacagagagtctattattaaacaattgtagtggctacccgcaggaagtggggtgaatgtctgggttagtgtcctgacaccagtgacttcattgatccaacctgtgcaagtatcagggagggggtcagaataggaggagttattgcagaacgttattcatgagggagtttttcatcattaaggcatcatccaagactccatttttactgttgtttatgcttagacttttcttcacagtaaaaaattggggagactctccatcttcttgtaaagataaagaactctgaaaaatacataaatcactttagtggtttttctaattgtaaaaaataacagatgtttattgggaaaaagttcagaaaatcttttttttttttttaatcaccagtaacctgagagaaagcaactgttaacatcttgttatatacctgcagctccaaactgtgtgccaagatgctctggggcaccacagcaaattctgggtgcagctctagggttggcacagatactttccatcattaagggaaacatcgtacaacactctgccaactattagctggagatagttcacagtttcagcattagatcacactacattccttttgatgacatcatatctttacaaaaccgag

SEQ ID NO: 121913 - DNA, 1007 bp, Homo sapiens
tcatgttggccaggctggtctcaaacttctgacctcaagtgatcctcctgtctcggcctcccaaagtgctgggattacaggcgtgagccactgcacccagcctgggctttgtattttttgaggaaattttcttcttttttctcctctcccatcaccaagacttattctgtcttctatttctgggaagattttttttttttttaatttacccactgaggatttcatctttcaagggtattggctttgaccttcctgtgtggacattaggctgtccctttgtctcttaatatccccatcagggattgacttatgcaggacttacctacttacttctctaggttctaatttccttgtcattttcaacttttaacaattgctgttactttcttgctgcttagccatatctttaaaaatatttttagtactcagcatttttaggcattccacatgaatttgccatgcttgacaatcagaagtcctctttatttgaaagttgaaacatttcctggaagaggagcaatagtaaattagttagatccttgccattcatggatttcactacagtcaaaaaggtaactttacatcacaatagaatcatattttacctacaaaaagtagtatttggtttgtataaatattaatgttcaagattttgtctttttttctttggtcttctaaaatggagttacaaaaaggtctttaagaatcagtcactcatttactgacttttcaacaaatacttgttgagcccctacattttaggtgctggagacaagatgtatcagtgattaaagcagacaaaaattcttgctcctactgagcttacattctggttggaggagatggacagttaacaagataaataggtaaagtgtatagtatgttgaaaaggtgataagtgctgagggaaccctggggcaggtaaaggagaattgggagctgttctcattattctttttaaaataattttatcccaatagtaagcaatattatttattttttaaaga

SEQ ID NO: 121914 - DNA, 1047 bp, Homo sapiens
agatacattattaggaacatattatatcttcccagggaattaaatatttctattaatatgtgatggccctttttatctctttgcctaaaattaactgtgtatgggtttaatttagctacaccagatttctgggttattatttgcctacgcagttcttcccccagcctcctttattcaaagacacaaaaggctttagatttgtgctttgtaaatcacataattggaatttgtctttttactagctttattaaggtataattttcatatgatcaaactcacatattttaagtgtacagtttgatgaattttggcaggtgtgtatagtcatgtaaccactaccacaataaagctatagatatttccgtcacaccagaaagttcctcatgcttttttgctatcagtttccttccctcacgtctggcattaggaaactactgatctattttttatcactatgttattttgtcttttccagaaagtcatacaaatgaaatcatacagtaagtagacttttgtgtttggcttctttcacttagtataatgcctttgagattcatttatgctgttacacatatcagagtttcattcctttatattttttcagtataatttcactgtatggatataccacaggtttttcgtttgtttgttttttagctattcacaagttgatggatatttgggtcatttccagttttttcaactattgtggataaagttgctatgaacattcacatgcaagtctgtgtggacatatgttgtctattttttaattcaatcagtcattgtcttttaagtaaaatattcagttgatgtatgttgtttagcagattacactaattattgattgcactaatgcatttatattcattttgaccatattattttttgctatttgtcctgcttttcctgagccttattttttctttattgccttcatttggattttgcttttgtttttttttttaaatatagttccatggtttttcttctactaatttaacagttgtacacaccattctcttttttccacgcttaccctagaga

SEQ ID NO: 121915 - DNA, 1058 bp, Homo sapiens
agtcctaatcagaattctaccacttactaactggaaggtcctggggatgttaacctcctaaatctcagtttcctcgtttgtaaaagaggtaattataaatagttcattgagttgttgtgggaactcacgtcataacatttgaaaagcttagtatgggatctgctgtacggtaggtgctcaatagatgatagtttttttatgggtcaggtgctgtgctacccactggaaatacaaagaaaaaataagataccatccctgccctcaagtagtctgcagtgtagttgggaagacagacatacatgtgaataaaatagtgtgcattgaatgtaatgagagcagcaaggtggtccataaagcgagcagactgcagttgtttgaggaggcttcagaatgaagtgttgcacagatttttgaagatgaataatagtgttaaggcaggcaaagattcttcctttcagaaggagaaaagagtacataatgtgctaatacctggacccatgaaataatattttaatattaacatattaaattaacatattaacatggagttggaatcagtttacagtgctgtggtctaaagtctccagccagagaagccagaaggacggcagaaaggaggacaatctaagtggcttggaggctactctgggtggatatgggtcaatcctgaaaggtttttaagctgggaagtaatatggtgatatttgtgttctataaagattactctgtggctacgtgaagcatgaactggaggaggcaggagcaggagggctggtaagacataatgagggcattgcatctggtttgggcaattggactctgtcaccaaaactgatttggaagtgatgatgttgagcagttctgacgcttgtagaaaaagtggaaggaggtaagggtaggtggggatacacacacattttttggatgggcccctcttttctgcccctacatccctctcctccggtgtgtcgtttccctgatctacttcaacctgcagatctatctagcaggcacctcacttggggatttgttcccataccagcaagaagcttataaat

SEQ ID NO: 121916 - DNA, 1820 bp, Homo sapiens
tggctttgatctcacagactagatccacaccttagggatctccagaggaacaggaaaacagactaataggataaatgagaaaaatccaaggtgatttataaactgccctgtaatcaaggaacctcagagaaaggtggttgtgcttgttttttccttggacttctttaaatggctactcataactgccttcccctctgctcgctctccttgctctctgtctgcttcttggtgtaatgtcagaaacgctaatcatgtcagactgtgacactgacagccctgacattcacaacaaagagacaaggaggagagagaggaaaagagatgggggaggggggaggtgaggaaaagcagcaggagaagcatttttttattgcacataaaatccatagctgcagaatcacccacatctggacatgtcatatccaaggaaaatcaaggaaggcacaaggtgaattccaatagagattgaaactgagctggggattttcccctcttcttttagatttcattgtgtagtttatattagaattactgtgactatgatttcttctcatcaagaaaaagggcatttacatttatttttcctttttctttactacagtttttctcttcgaaacaaagcaaagttaaacacagatcttagcaggaagtgtgtgctgtcagaggttttccaatttattaccagattcccatagtttaatctgaacaatagccagttcaggaaagaagtcatgggtgagggatgttttctgaccatggcaaggctgaatgtcatgacaaagctgttcagtgtcatcctcaggcccttggcttctgcggcacctgcttaaagctgctggatgcagaaaatgctgatgttacctgttccctaacagtttggagtgggcttccaaatacctttgagacttctgtttctctcaggcactttctccatttggaataatgctggtgagtggtctgcaatctctgtcttggatcagtcatgacctgaaaatcggctgccacatctcacatgtgttttgaatccagatgctatgatctaaattgagctctgagctcaggctgaatcatcctagcttttctataaacatgagaagccagctgccagctcggcttttgaggtattttgaactataactctaagtcttaccgaagatagttatcatttcattttttcttcatgtcagaaaaaaaaaatcaaaaatggaaaatggtatccagtatttattctgtatcagttaccctgtcataaaagagggtacattttttgtccatattcaaacagaaggtattctgtacctagtgacttcttttcagattgattataaaaatattgagaactttggaaaaggctgataactcatttcacagtgttctcatctttagtacccaagtaaaattttacatacttgggctacttgatagaaatgctccacttaatttcaaaaaaaaaaaattaagtggattatgtggcgtagttgaagttccagcaactttgacattgtgacttgtttaatattcttgaggaaattctacttctattggcagaagagagtaaatttataccctatggaggatttgagagaatttaccccaaaatatcttcctgtaaattcaaattttctttgaagtgtttttaatcctaaaattttacatggattgttccctgtgatatgtgataggtccatgtttgttttcatgtaaaataatttaaaattacttgccacttaaattaattaggtcctatagtaggtaatgacagctggtataacagataagccctcaaaattgaatggtttgacacaactagtttcctttct

SEQ ID NO: 121917 - DNA, 1371 bp, Homo sapiens
ctggtactttcacacacattgtgattgttggttttggaatcttgttcatcctcattttttgaggatttaaagaggagtgcctagtattttcttaattaaaacaggctttgcttctctgcgtcccctgccccaaaccaatggactgccctgggccgtccttcatcaggagttttaattgcatgttgattgaactggtaggttcttgtcctacatcatcatgttggactaagcccacaacagccatgcagcctcagtaaagaggccctttggatactcaaagtgtgctgctgcctttttctttgtgactggtgatggctgggttcctacaacaacggccaggggattctgacctttatgaatcaggcagaggaatgcttctgtcttctttctccaagtcctcaactctgccctttttctgtcaattagtaggccttaatagatacaattaagagaattctacttagttaattggtgattggaaacatgattatttaggtacttaatctgtggtttgtccatctctagaatattaacaattgatttttgcctgattttacaaaggtatcatctcagtgggattgctatgtatgaaaggaaatttataatggaatgattgcttccaatccagtttattaatttaagtacgtaatactttagattggctttattttcccttcatttttgtgatacagaggccttataacgtatagctgtttgctggtattcttcccagcttcctattgtcctttgtcttcgtaaaataagcctagcagtattttctatattttcagagaatcttgtgcttttgaatatatgtacatcattggctttgtttttaaaaaaacttcatactgtgtgataaaattaatgtaataaaaaggtagagatgcctatttacaatttgcagaataatttgcagaaactcctcagttactgttcagaagacacatatttctagtccagtagacatctagtaaatgatgtttacttttaaatgcagagatttgatttgactaatcatagtttatatgttcttctggtttatttggttttcttttctattttttttaatggaatagttttgtaatttcttaccactctcaaactttaataaagtggcatcttgaggctagtttcagttaaatataaatataagcaattaattaagataaccaaccctaaccagagagataaagtatcatcgcgtgtcatagtgatcaaggagcacctgttaatgagaactgtaggaaaactgcaaccaatcatgaaaaaaaaagtgttgggtgaaattaacaatgtctgtgtttcttgttatttcttaaatccaacccataaacaatttgctgtgacagctctaggctgggattacgg

SEQ ID NO: 121918 - DNA, 1357 bp, Homo sapiens
accacccaccccaaaaagtcctaagcctggcctacttctgaccacccaccccaaaaagtcctaaggtattatattggttaaatattttcaagtacatacgagctttaaagcaggacagggaaattcttaggtgccagaagacattgatgccactggccttagagtgtttcagacccagctgtaggctctaggctctaggggctatggtgtctatactcacacaggaattgcttgtgaaaggggggcaagaagattttccccagtctgtttggggctttaagtctgtgtgttggggcacagaccagggggatggaaacccagggttacactgtttgaatagctctggggttcatagttacactactacctgcatggtataacttcaactgttttggcagaaactggtttgagagcattgaacgccctcaggccatagtggaggcaaacactagatccctgtggagaggcttaacaacctgggacatggtactccctcaaaaagaataagctgcactaaggagatgctgataataagtacagaatatggccagatacagtggctcatgcctgtaatcccagcaatttgggaggccaacacaggaggatcacttgagcccaggagtttgaaaccagcctatgcaacatagcaaaaccctgtctctacaaaaaattatctgggcatgggtggtgcacacctgtagtcccagctacttgggaagctgaggtgggagaatcacttgagcctgggaggttgaggcttcagtgagccaagatggcaccactccactccagcctgggcgacagagtgagaccctgtctcagaaaaaaaaaaaaaaaaaaaaaaaaaaggaacagaatctaagccccagaaaagcagaggttaacagtgaaccttcaggccaactagagttttcttctgcagattaatgaaagtttcttctcaagaggaacaaggcatataacccattctggcttgctaagcagtttcagttgtaagcactagccccaattaaggtaacatcctacttatagcttgtccccaagatcttcttgagaatattttagttccttaattagaaactttttattggagagatagctggcccccttaacgcttctttaacagtgctcccattgcagtggatcactctgaagtaacccatcaggctgtctgttatttcagtttctcaccaaatcataggaaatatgtttgcctgaattgtacagcaaccccctccccccgccccgccaagggagagggaagttgaaattatttggaggggtctgggattctttcagcataaaatcaaagaaacccaggtaaataagacatggttagtaaacatttgttctagat

SEQ ID NO: 121919 - DNA, 1073 bp, Homo sapiens
ctgaggcagcagaggagggagaacaggaaaattggaaccgtactcttagttaatggtttccagagattatttagcaggacttgaacagagggaggaaaatattgtgaaggattgctgcgaggtgtaccataattgcggtaggtaaaacaaagtcattactatggttttcttgctcaagaaggattgagcaatgacttcaaaatgccaagtaaggtattatttttccctaccacagtatttattttcctttagcttctggggcattaaaaaaaaagaccaactctcacatcatggcaaacagtattaatgttagtgaatcaattttgtttactgtttataccacaagcctttaaaacattccattaaaaaattgtctcccgctcattcatgaaattctttttttccttcaaatttgcttacatgcattagctttgtttggatagggactttttccctttttggctggagtaaaagaatgcataaaagaatagtgagtagattatctaaatgtacattcttacaacaaatgtaatgaaaatatgccgcgtggatgagagggaatatttgaaaacagaaagaaaaacagaaatggggagcatttcaaaatagtcaccctgattatctttgttatgatgcatttcttcaattctgcatttatttagaaccctattgtgcagctatttcttttagccaccctagatagaatgtaggtcaacatcaacattgttcctcatattttgttggtattttaaaagttgaaacattttgcagttttttccagagctagatattcttaggttatttagacggttttagtgaccatagaacttcacgtataaactccttctgttaatagctaccactgaattttgatagtagacactcagatcacaccttgacctggagtaaacaaggcactgatgatattgatgataacatagtccaacactgaagctgttccacttcttccaggcaactctgatggtcttactctgtgtaagttacagcttttacttcgctcaaggagagaactggtaaatttttatggttgttaattgtttacattttgggga

SEQ ID NO: 121920 - DNA, 1053 bp, Homo sapiens
tgtcttggatttatgtgagcctttggagcagcaatctcacatactatgcatggcaaatcctagtcaatgcatactttttgagagtgcaagatgttaattgtagtaagagaagagaaattcaataacaaatgtttttgaataaaggaagctgaaatttaatactaatggtgttttctctaaatgaagttaatatattattgttgtattaacttttcaggagtttgaggctgcaatgagctgtgattgcaccattgccctccagcctggatgacagagtgagaccctgcctcttaaaaaaaaaaaattctaaggacttgggctctgtgtttgattgacagtaatagaccaatagaagacattgcatttatatagacttataaaatagcattcacatttccaatcagatttacagaattctcccttatttttaaatgttctcagtggtaacagtgacgttgggactagagtcagtattgtgagtcgtttatgcacatctcttcacaactccatgttcagtgagtcatactggcagcttgaaatcagccatggtgggagagtttacaccatggaaatcaaacactacaaattggtgctcctcaccctcagagtctgtttttaaacatttagcagcataccactgcccaaaatggagttgagcagtcagggagtctcctcttgaggcaagtcatgcagtgcttccactcaaccaaacagccaacatgaacattttgaaatgtaggctgtgtggctcctgaagaaaagtccttcatagctccacatttttctgagccaaagccttgctgtgatcataaagctattcatgctgtggccaccaccgtccgtcctcctggctctcacctccagatgcctggtttcacccctttttctgtagaacatcctagacccactcctattttagggccttttctgtagggcagtggttctcaaactttacagcacatcagaatcacctggagagtctgcaaaaacagaccactgggtgcctctctagcatttctgagctagtgacaagtttcagggtaatgctggtgg

SEQ ID NO: 121921 - DNA, 1048 bp, Homo sapiens
atctccaaggctctcttaaatattgactaattaaataaaaactaaggaagtctagctaaatagcctcactttgaggaccagcccagtggacttagaatacacagtgatttgctgtatctctgaaacaagcaactagaaatcttttattattggctataatagcaagtggcatctcttattatgtttggcagctgacatttcaaattgcattttggttggttgttatacatgaaatagtaggatatgagtagactaaaaatgagaatttgcagcccagggatgacatgaaatatctaacatctaggggttgccatgacaactcatcagaaagttgctttgtaatcttttggattaggctctggcccagggtcactggattggagttggagaacgctttggtaacaggatgtgaatgttgtacctttactcaatggcatttgaatttgcagtttggtcatgttgctaaggtcaagtagaaatgacattgagggaatttttaaattcccgcagaacctagacaaggtcacatttgtcagcaaaaatactcagatggaatagtctgagacttagcaactgaaagacaggatttcctgtccttgatagataaaaagtatgcacatatccatttatatatgcctatctctaaacagttgtatgtaatgaaaatttgggaaattaaacccttttcataattgtcttctgttataaaattggaactgaacacccctaagaaaacagtttggccacaaacaaaccacagctgctttctagtgctctgtgtcctccctttcagctggaaatggcctgcagggtgtggaatttggaccagggaagggaattcggcagagagaggaaggaagcaattgggaaacagggtaccacattcctcatcccccacattggccttgaccacaaggacagcatcttccacatgataatgcacctctcaggcatgcttctcaccagggatgatcaatggaagcaacctggaaactaaagagctctgttcctaagtctgatcccagttctgccactcacactgtgatct

SEQ ID NO: 121922 - DNA, 1043 bp, Homo sapiens
atgaatgaatgaatgaacagtgaggcttcatttgacaaactacatgtgtgtttgaaaattatttcttaaatggtaaatccatttttatgagtgattttaagtatacatggaaagttgactcctttcggagggtgaagtgatttctaaaacaactgttttgtaattatttagcagttctggctttggtaggtcaacttttcttaaactggaaaaaaaaatagtattcttagtgtagattgcaaaaggaaagaggatatgttagatgatttgcccaaaatttaaacaggattcgctttttaaattcaagcctttttgctttcattcagatctggtcaccagacttactttttccttaaggcatatatgaatcatcttgttctttcattcagaaatcaaaagttcaggcctagatcagtatttaccaaaactggtggaacactacctttccactgagagtgcattacctttttttgagtctttgaaaagaatgtcagctgaacatggtctggaagtggccaaaactctgtgggtggggagaaaggaagaaataacctatctcccatttaaaaacctaccacctattaaataaacggcagtcttgttctgtggagtattcatttgggttatctattctgatgaacaaatacaaattcttggtagggttttcttgcttctggataaaatgcttagtgttgctttttgttgttcaatcttaggttttgtttcattttgtttttcagggtctcactctgtcaaccaggctagagtgcagtagcgcaatcatggttcgtggcagcctcagcagctccctgggctcaggtgattcccccacgtcagcctctcgagtagttgagactataggcacgcaccaccacaccctgctaatttttgtgtttgtagtagagatgggagtctcaccatgttgctcaggctggtctcgaactcctggactcgagtgatttgcccactttggcctcccaaagtgctggcattacaggcatgagccactgcgcctggcctgtttttatgatatgtattgaaat

SEQ ID NO: 121923 - DNA, 1036 bp, Homo sapiens
ggcaggtttcaagtcctggatactggagatgcccaagcagaggctgtgggacctcccttagacttgactggggccacaatacccactgcctggtccctggaccagcagcatcggcatcacctggagcttgttagaaatgaagtctcagggccacccacacctactgagtctgaatctgcactttctcaaggtgcccctggggtctcacataaacatcaaaatttgagaggcactgggctaaatgtctctaagatccctcatggttcttaagatttaatgattttatagaataaactgtatgttcaactgaaaattatcagttcatatggtgacattatcaatttaaaacaccttgggatgttacatgtccacagaaccatgtaagtatttgttgctaaattagttttaaatggatttgtccagtttcccccgatgtcaaagttaggttgcttatgtatttgggcacctataagaattaaaatattacataacgttgtattttcttctttctaacatacaggattagattcttgctttaaaattctccattaatgtcttcaaatttttcttttatattcattgaaaattcaaaagcagattagggttctgaatacctgttaagaatactcaaaagggatatttaaataaatatatctcattaatacattgattttatatttagcatattttttcttcttatacatagtccatattttgaccttatgggaacctttgaagtctgagtattttataatgattctccacaatacctctttatcttttagattctagatctgagatcaggcaagtaaaatagttttacctttttcccctcaaaaggccatgactaacaagctcatttactttttccttaaatattttgctaattatccttttaactgatgaagttcaagtggaatccatgattcatttaatcttttcccctttatgtaattagtcacttgttcttttgatgttcctagcaaaactaatatttaaagggctagtcataaaattccaaaataaaaagttctta

SEQ ID NO: 121924 - DNA, 1503 bp, Homo sapiens
gacttaatttgtttccctctctctagtaccccctctttgtacttgtttctcctccttttttgttttccaagtctcaattttttttttggagaacaaaacagtacttaaaaccggtaagtataaagattttttttctaacaatactttatgccaaagtaagagaattctatgcattttaaatgaaactatcaattgaaaccatgttagagaaccagaatgaccctaaagttgaagtctgaaagtgtcacttggaagactgtgtcccttcatcctcctgtagttagacatttcctcaaacacagttaatcaagagtattttcttttaaatggttttggaactatcattgtagtatcattttctttttagattataaatttaacctctcatattttaagttcaagacattttcacggactatcaaggaatcctagctcattggcctggccctatttctgtgggaaaatgtattctcagttccagacaaccagtgttcctgcagatttttaggtcccgtataaaacgagagaacatagatgaatgagaggcattgtcagacaaagcctggcacatgagatctcaattagcatacaggttttaaatttcccacattaaacagtacattttaaatttccacttatgttaagcgtgttgatattgtgggtttgaaagtaagtcccctctgaaaaacaggaactgtgcttgtctgttaccagttcttgtggtcgatatggtaactattttgatttttcagaagggaggaaaagcagttaaatctagttaaaattaaaaccagttaaaattaactggctcgtgagatttcagtgcagctgttccacacatagcaacactaagagtgagttgtttattaccatgattaattattattagttgttacttctttttgagcagtggcatagattatttatatttttggtctaaccttggaaaatagaaactgcaagcgtagagaggttcccgtttgctaatttgcatgtaccctgtttttgtttttgccaggtaggtgtgtgcatctcaagtacacgagagtaatttagcatgtcagcactttcctaccagcagtgcttgctgactcatgcagctgttgtagcactcagctggccgcactgtaaactgcccatagtaccagcaccgcccttggagagctccgggctgctgggctggttagctactgggaggctattttcagatctgtggtcactgctgagctgggtcctcttctcctgccagcagccagacacagccttctggttgcaggggagaaaattggacaaatttctacctttgtagggactgcataaagattcatagcatttctggatatgcctcaggaaaactttttttttgcttcactttatttttctgggaatatttaaggggagaggcaaaaggggctgataataaatgaaaagggaatgtgctgttatttcctactaagatcagaaagagttttcataaacctttaacttagttaggctttcttg

SEQ ID NO: 121925 - DNA, 1107 bp, Homo sapiens
ggtaatgcctgaggacctccatgggagtttgacatttgagaacactcaccaaaataatagttttgatttactgaatccgcaccatgtgccagacccagtgctgactaccttgcctgaatgtacttcattgattcctcaaagcaaccctttgaagtaggtgtcgtgcctgcccattctgcagagttggaagaactaatctcatgttggaatgaacttaatctgaatatagtgcatgttttcttgaatgtctgaaggttatttccccattccattacacagtccagtcctgaatcaatgactgggcatggtgtaggactgtgacatacagagaacatggtccctgccctcacatagaacagagaacaatataaaatgtaacatatttgtcaaaatctgcaattcagatagcagacgctgtaaatctgcctccctgtttttctcctttccctgtctggatgttgaagaagtttcagcgacatatgaccctgtcagaggtactcacagttcagaagtcaatgctggttgcaaaaattggaatttctttggaaaagaagacaagcttttggcagagctggggccacatatgggaacgcagcaccaaggccttgggaatgacggaaaatcgcttctgtattgttaatagcaatatatgacctctgctgtcctcctatctttaaattttatgtaaatatttacaaactgttcatgtccaaactgaaacctgctatgaactaaacattttgtaaactcagtaagattgcccaaaatacaactcaactttcacctttttttttttgtttgtgatgacatttaatttaaaaaaaaaagacagtagttgcttttttttttctttttttttgtcagttcagggtcttttaattttttccctttacttttttttttgttaatttcaaatgtcagtctatctaaaactgaaacttaattttactatcagcatgctactcagcttccgtaaggctggaaatgtcctgcgaatcttaccactatgtcttttccaagggccatttcatttctaaagaatgtataaattgaacctcatcctgctagtgacactacttcaaaattcaggcaggaattttgccattt

SEQ ID NO: 121926 - DNA, 1009 bp, Homo sapiens
tcaggaaaatgcactttgcagtgatggtaggaaatgtttccacctgatagagggtaataataactgcttaaaagtagattcagattacagatgagacaattaactctagccatgtgctcttcaatttgttgcaattcattttgtgatcaaagtgagtcacagagggccagatggtcaggttcatgttcagatctctcctaggccagcccttcacttctgggcccactgtctgcacagccgacaggacttagttattcattagcgcttgtgagctgtttctcagaattcctaatcgaggctcctgtgatgccaacaaaagggctcaagccaatctgtattgttgagagcagtttaattttacttggattaactttcagtgtctctggtgtggatccagtcttaacaaaaaggaaagagaccctagtggctctctatctctgctgtgcctggcccctctactctagtttttgaacctcagatttcaggggtgtgacatctagcttattgtaaatgcaggcttgattgttaatgaatgagagaatacttagataaataaatatcttcctgtgtgtccagggggtgagagccagtactagcttcatgggcataagacctgtgcagttacataggcccccttcctcttccctgctcagaaggacctcatatttggtataaggttctgctgttttcttcggaaattcttaataatttttgaacaaagggcccctcgttttcatttttcactgagccctgcaaattatgtacttacctggttctggtgaggagcagggcatagtgtggagtggcaggccgcccctactcaactcattgtagactcttgctagggaacagttggtaggactactggctttgtgttgccacatcatttgatttttccaggggaagctgaatattggatatttatgtggaatttcctgatttttaaatattggctcaaatctttaaaaaatttttggatgaaagcatatgtaagagctagtgtcggcct

SEQ ID NO: 121927 - DNA, 1030 bp, Homo sapiens
ggtcagctttgtgggggccagtggagcatcttttcttgcccttccgggaaaacgctagctaaccctgggatccccggtcccgacgtctgctctccttccccaggtgcagcacctagggctctggccccctccccacgtgccacaccagccctcaccactactctcaccctgctatgcccccaaccctcgtctttcgtggccgggaaggccaggccgagcggggcggtcagccgggccgggaggagggggctctccgggccgcgcggccgcacaaagcggggagatctgctgctgcggcggcatgaggcgcgccccctcccgcgagccagcggagcgcgcgcgcccgcccccgtcccccgccccccgccccagcccccggagcgccattcgcggagcggcttacgctagtcgccgggcgtaccgcgccccagcggccggggaggtgcgctgcccggctcccgtaaagttattgtgaatggggagcgggtgacgtcagcgccgaatgtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgaggtgagtcccgggccccgggccccgggccccgccgctgggcggggtggcggggcaagtttgcggggggagcgggcgcgcggggcgggcggggaggcgt

SEQ ID NO: 121928 - DNA, 2888 bp, Homo sapiens
aacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattac

SEQ ID NO: 121929 - DNA, 3792 bp, Homo sapiens
tgaaaatgatccactggaagagaatgtgtctctgctttctccctttccctgttaaggaacattgatattagcggagttgatatagccttctataaaataaacttagcatgataaagaaaagagatggggagtttgattagatagggtcaattaagactgaatttaaaatataaaggtctcatcactgtttttgtttttaattaagagcttagaagctctaatatattgtgttctattcagtttatagccaacttaaattataggtatgagaatataattgcattctaatatctgataattgaatatcctttttttaacctttagaattcagaaatagactcttcaattaccaatagctgtaacttttaatttacatattatttactttagggaaaaaaagcatttcattcatgctttcttgctgttcgtttataattatttgtgacagaaaatcaataaaatacatgcttgaattccagataccaatggatcagataactccatcccaatggcttatcttacactggatcaccaactacaggtaaaggagtactttcttattgaaagttgacttttttcttcttagagagtttaagttgacaattgtgttgctacctgtcattgtatagtcactccttaatttatccttttagttggcctccttaaactttttagaatcaaatcaaaataattcttttggttaagttaatcaaactttaaattggcagaatcatattcttatcttttcagtcatcttaaaatcctccagtatctttctttagtactgctaagcattacattttcactctttaattttagtgcattaaaacaaaactcataagcttatttctatttaatacatttgtgatacattctcatgttcatagtgactgaaaatgtaaataatatacttcagtgccccctcatgagtatgagggctataaacatcatttagtttgagcctgtttgcagcctgaaatgtcataccagagactacaactccaacaatcatgattctctgtaacagactgttaaaacagcaagaatagatttaaatgctgagttaattctgacaaaaggacactgagattttctagggcatggtttaacacttatttttaaaagatcattgctttagtgctataaaaatatatcacagtctctgtcttgactctcatcttagctagatattgaaatttgatttaattatgttttaacattcctgattattttcagcctctagcaccgtgcccaaactccaaagaatctatggcagtgtttgaacagcattgtaaaatggcacaagaatatatgaaagttcaaacagaaattgcattgttattacagagaaagtaagttattttttatgaataaaaataaaaatacattagtattttgagtttaaaatatgataaggtgcaatgaaaacgtagtttttagaattagtcattaagtatactttcaacttgtttaagctttaagcacccttttactaaaaattttttatgcaaaactcaatccttttgactatcatattagtgctatggaaaataaactggtgctttatacttgttgttttatgttctcagagctgtttagacttattattataaagatttattgttttcttgtaaatagataaaataatttgatttattaacattcagttgtgccttatcttagaaacatttttgtagatacattttttccaggtgtatgtttagaattggattacttattaaaagactgtatttcataactgagtgtttttctgaggagttatagaaactgccttcctccctttttaaagaaacacagcctaatttccttactactgcattcacagttcttaaatatgtatgtatcttcagttttcttaagcatgacctccatgaaattttatacttaggtaactgaattgttggtggtaactaaaatgaagtgataaggaaaaaattttggcaactttatatatgtatgataataggattcccttcattaattttaatctaaataaatgaaagttgtttttttctgaatttgcgaaaagctttctgtatgtacttcaaaaaaaagagagaaaaaattgttttatcataatttattgatacagtgatttaaatggaaccaacctggtatttgaaaggtaagcctaaataggaaattaaatactacagtttggaaatcgtagaagtaattatcaaactgctggcacttttatgttgaaaaagcttgatttcttatttcacttatttaacctatacttttgccatactttaatcatttgaaagaagtattctatgctggaaaaaacaaatggtggattagggtgttggctgtgaaaactatgacagttttaatcaattttaaatactttcagaagtagtattagttagttattttgcttgaggactttttattaattattcatttatatccagtaacctcactttaggaaatgcctaaagatgcatctttttcgggaatacttaatagttcccaaataagagggacttaaataagtttatcagactataaaagaatgagggtctttcctgaaagtgcttgcaaatgtaagtgttttaaaagaagtggtactttgtcatttttctcactgctttaaaatgggaaaaagctttaaattggatagcatttattttaattagattgcaaatttgctattagcttaccactctctgctatagttaagtaggattgtgacttcagaatgtgaatcagtataaaagtagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattac

SEQ ID NO: 121930 - DNA, 1064 bp, Homo sapiens
aattaaaagtaatgatataagtataggtgtaaaagattgcattcttacaacatacaactcactttcaaacatggttttttcattaattcaggaagctttttaaacactcaatagatgtgacttcctagaagctttgaaaagatactgagaaagaaaaaagcagtccctgacatccaggaactggtttgacactgtggcctcactgttgttagtagctagccttattctcaacggctggctgtcacagctagagcatgttactgtcttattggacataatctctcagaacaccaatatcagacaagataatgctgagaccgtgataaaaggagacaaaacaagactacttcggaatgttttctaagcacagacaaaaacaaggtcactgtgccacccacaaaatacctaacattgtcctctcccagctattaagagtgactgctgcttctttaccaattacagcttggtcctcactctggactgccctccctgtggaattgcccttgctttctgacagcggccaatctggaacgaacccctccttcctttgagtttccccaaaatcactcaaccaaagcctaaatcctataatactttctttttctaaaaccctcttactgagacaccccatgctgccccatggtaagcattctccttcactgcaataaatattaaacccaactctttccactattggtgtgttcctggcagtctttggctagagggctttgacaataccaataaagcctattccgcaaggacctcatttggagagatcagacttatgcccaaatcaattagaaaactaaagtaataacagcttccatttgttgtgcactgactttgtgccagataggctcttagtatacattatcagaatgttaatcctgttatcaggatcttagtcctgtgaagttggtactttttcacctaatttgcagccaggtaaagtgaggatgagagaaactgacctaagtctcttacttccttatactgccagtaattcctataaccaggttttgaatccagacctgattgcaaagcacacaaactctatactttaa

SEQ ID NO: 121931 - DNA, 4760 bp, Homo sapiens
gcttttaatttcagtcaaggacgtttagctctattgtatattggttttttactaacagtatgataagtagtaaattggagtaagtagaatgtagagaggcccaaacattttaactgaaaaatagatgagtagttaggcttctaatacttgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtcggtaactaatgtttgtaaacctttctttaactggaagcatgtaagttattaaatatttcctccagactactgcagcaccaatatgaagaggcaaagagagaaagaattgagtttttctagatctggcaagttctcacctagcacagatagtgtcattagcagatgtaagcctttgatagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaaaaggtaaaatgagtgaatgtctaaattagtattcagttgcaaaaaacttcagaatcaattcaaatttactgagaacacacccagtaattttcatttgaagtaataggaggttgatttttcttacattcatatttctaaattatgacttaaaatttaatattggagcaacaagtatttgttgattgcaatcctgttttgctttgtctgaactatctgccagatggtttctgccatggttgtgctaattaaaatgcattgcctaatactgcttgctttgattcatgcagtagcttaaagatttctcattttatggcatttgttaactgtcagctcttctttaccttacttccttaaaaggttttacttcccttttctcctatccttccacctaaatttaagttcagtttttgttgttattgcaatggtgatgtaatggtttatagacacatgtgtcgggtggttcctcagattaacaaatgttgctgtgttgctaatctgaaaagagaattccagacacttttacaagcctgtctcatcaccgctaattttagaatgaatgtgttgaatgaaatgtgcctaaaattgcttattagtcacggttgtggggatcctttttgtccttgggaaacaggggtagttgaaagtattcagaaaagtaatctagtggatctaattcaataaatgcacagttttgttgttttagtttgtaatgaaaagttgaaatttttggaataaaatgaaatttgaagtaaatgtgaattcagataatgcaaagaattataaaacgtagcttaaaatggaaaaaaactgatgatgtcttacatttgcaagaggagttacaaatttgagtttttatattcactacacatattattctattaaacattcttattccattgtaaggtccttttagtttatctgcagcataataatggggtcatgtgggttaaggtgctaaattatattgctgattggttttaaaaggatgtctctacgaaagattctggaagtctaaaattttaagaatgaattctgtctactaatcgggaaactacaattagagtgagtacatgttctaagtgttgcccactagttgagaaattacgtaatacagatttcagagtcaaaagaattttgagtattgtatcagctgttactcagtattttggtgtttccttttagacagctgatctctcacgttagaagatactgcataaacagctttattcccaaataaaagtgctgagtgaagccattgctcaattcattgttttgctgaggacttatatgtgtagaattctctcataaattgatttttaattaaattaattataaacatagaagtttctaaagcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtaagacaacattcaaattttctatctttgaagaatactaggcagaaaacaagaattaactgtattctactctgcaaaattagttttatgagttgacctaaagttgtgatagagaaattcattgcacctgaacttaaatacttaggggggaaaaaaacataggtgccattgttaatttaacttgaaagataatttattaaagtaggtttattaaactccatggaaaagtaaattgttcattagcgctgtatatatgttatatggttttatgtatgttttaataagtattcaattttataatttaacaatttatcattaaagtgtcctttaaagtgaatcattaatatgtctcctttttactaataagggtagtaaacatttccccaataagttgctactcctctagcgccacgtagggcattacatggagaactctaacgtcttttaacttggcatatccactggattaatatttttttcaaatatccttaagataacatttactaagcaaatgtgtaaactctcgaaaggcttctattccagtggttaagatttcattgtttatatttctggatcctcctctaaactctccttgtctctttatcactgctgctttgcagatgatgcagacagtgttataatttaagccattactgattagtgcagagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagtcattaataaaaaagtcttttatacccatc

SEQ ID NO: 121932 - DNA, 1608 bp, Homo sapiens
ggagatcagtttacctccatgcggaaaggtactgtgtataagggacgtactttaaagaggtggaagcatttaaacttacataccgctgaactgtgcttcccttaaatgtttgagggaatcaggaaaatttagacagatggcagtgtaatcttatgactaagcattaagaataaatttatatatggcagcgtagcccacgctatacaagataatgggggagggaaaaataaggaaagaataatagtttataactgtcaggtactactggcatctagtgggcagagaccagggatgctgctaaacatcctgatgtgtaccaggcagtcttctccaacaaagaatgatccagcccaaaatggcagcagtgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaacattaacttactcaggtgcactttctttaatagaagaatacaagctgtagaattgacactagtggacataaaagccaatcatgaatgtgctcataggtaatgtttttaaattaaatataaaaataccgcccatcctttgggaatatctcaaatttcctacatgacattttaattgtaaagaagggtgatacttaatttccaaaatttcttaatactttctagaaattgttttgttctaagtggatttcccacaagctttatggtattagcaaatacttcttgatatattcaaactgtttaattagcattaaaacccaattgcaaggattctttttaaatatagctttttaaagatcttatttacatggataagagtttcgttaatacttccctttggccaagtgcaatgtactgagtctaatgtacttcttggaatgaactacctctcttaataagagcaatccttcaagcatcacaaaaaaggttttgtatatatatctttaaagtcactaaaatgtctaacctagtcataggtaaagaaatgcaaagaccctaatcttgtaatcttgttttttgctcgctcttcaaaatgtgtatactatgccatcagtcaaatgtggaagaaaaagcaacttagcaaaacagcactatttatcaatttagtagtctctcagatcatacagaaattaacctttaataccttaggactccctgtgggtcagactgtacaattttttatacctcttctaccatattactggctctgaagaactgacaaac

SEQ ID NO: 121933 - DNA, 1087 bp, Homo sapiens
cacacattaaaattttgcctaagtgtagaacaaatgctattgtacatcccttgagttttacacaatttaaattttttcatgaattgtcttacttggaaagagtcatactttccagccttttgacagactttgtgtttactgtgaatgtaccctaaactttggaaaatataataaatatttggtactagaaatatgtataagtatgactacaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttt

SEQ ID NO: 121934 - DNA, 2245 bp, Homo sapiens
ttccccttctttcttgagctgactccattcagacgtattatgccagtacttcagaattgttcttgtcaaggtcactagttatctctacatcactacatttaaggaatcattttcatttctcatcttgactctcagtagcacttgacctaattcattactttctccttcttacagacagcactttcttcagttggcctccgagataccatactagcctagattccatcttacatctctggccgtctgttctcagttttctttgctggttattcctcatctccccaacctagaaatgttggagtgcccagggcctgctcatttggcttcttcacttatctgtctgcactcatttccttggtaacctcattcattattatggccttatataccatctgttggctcataatgttttccatcttatacctgaactctatactcatatatccaactatttcctttacatctactagaaactcaaacttaatattttccaaactgagttcctgatacttccttcaaactcactcttcctttagtctttccgcatctcaattaatagccctcagttcttctactagctcaggttaaaaaccttaagttattcttgactattagaagactatttaggcatcttggttccttttttgtgctatccttaagtttctcttaaaatgggtttgtttggatatcttcattagcttgaaaagtcttattttatttctgttcctgcctggctagtttataaaagaatgtaagttacataataccaagtgaagcatttgtattatttccagccattagtcataaatgtttctgcttttcctaggctcattcatggacattgcttctacaaatacgagtaacaaaagtgacactaatatggagcaagttcctgccacaaatgatactattaagcgcttagaatcaaaattgttgaaaaatcaggcaaagcaacaggtttgttatgttattacaagtaaaactggtaaccttaccagtagtcacaatattatactaactgaaattaattatttaccatcttctattttataaatcctgaattttcttcctgaaacatgcaaaagagcttacaaatagagacacgtaatgagattctcctaccatttattaccaaatggtttttccttctaatgattgctacctttgccaattctaaatccctatctataataatccctaaatgtaatggttgatggttaaaaatgtaaaatgggtatattttggctgcgctgcccagttagaggagttgttctaagtctatcatttcatgctgttcagatttattatatttttgccattgttgatttttaaaaatatttcaaggagtgagtttattcattttgcctgaggcatttaggttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaatctaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggtaaaaaggaactacaagtctgaagagtgaaaatgtatataagcctttttggccatggtagtttcagttgtcaaaggttttttgtgtgtgtcttatatttttttttaaataggaagtaggtttacaatatatttttctaagttactagcaatagtttatgcatttatctcaaattccaaataaggaaggtatgacttgtaaaattatttggatgagaaagtatgccttcctcatttacagattttatcaaatgtaattctttctgctcaaacatgagttgaaagtctaagtgagaaattgaaattctgccaaaaccagaatattttggggattttcagtgatactactagatttttgtgctgaactcaaataatagcaaatattttgtttcaaatttaacagaaaaatgtattccagatccatgtatgatttgaccttctatctgcttcttcattccagtgacaaaataatagctaagctggttgtggttaattttttt

SEQ ID NO: 121935 - DNA, 2814 bp, Homo sapiens
cacccggccaatacctgctatatcttattgtcagtggaaaacctacagattctgtggtcaggaagagttcctcaaaatggtatctaaagaaggtacctgatgatctagggaggtgttttatacactatcaagttgtgcttgtgcttgtattttatcttttgcaagtttattcacatttacattagaaattaaaatgtgtttttaatcttaacagtgtgaaagtaagcctacaaagataatttaagttcagatttcagtgagccctgaatttcctgttcaaggctggtgaacttttgaagtcgagtaaaggagtactaacataaaactcattcaggaaaattatcttgaatcatcagaaattatcttgatatcttgaatataccagtataaaacaaggaaactagttacagagttcttataattttcttgggtaaaaagtgtaagagtttgaacaagaacattgagatgcgggaaaaaagctttgttgaagtacatatagaggtatactggatttagcattcttttcactggaatgattatgagagtctttttggtattatggaactgtgaatagtagtttatctgacttattttagtcacattggactaaaagagaagaaatttccaaatagtctctccagatgtaaaaagtttataaaacttgtaattaaaatgaattcctatgtactgctattggatattactacaatgtgatggtgcaaattatattacccatttctatttctctttgtcatgaaaagcaaaaccttgtaagtaagagtatgctacttggtgactgtagttgggtaatagtacacctaggaaagtccgaatcttaagttcagaaaattttccagaaatctctcattaggtcattttagctataatagatttgtattcctcccacacattcatagtctaagcacaaaaatggttttgggattgaacatttttagaagtatcttcaaaataaagacattaaattacagaccatttttttccttctatattggattattttctttatatagtgttactattttttaagtaatacatatttatgattaaactcccatttcaggataccgtaatgttgacctaacagaagttttttaaaccccacgttttattttggccagatagaagtatgatcaggaaagattttggagctagagatgaagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataa

SEQ ID NO: 121936 - DNA, 2327 bp, Homo sapiens
cctatgtagctattttgatctgctatcttagatgtatttctgaaagaacagttatagtttgttcatttgacttgtttctagtcttttagcaaaactgtatcggaagagttcttttaggtgattttgtccaataacctcatcttcttatgaggcttttgatgtcctgtggcagcacctacttactggcactggagaaagtccccagaatatcctgtgattgtattttacatacatcttcactgttagtggactcctagaagacagtcttagtcttaggtcatagataccttttccttccctagtactattcacatagtaggggccaaaagaatgatttttaatatatctataaaatcaggggagtgaattaaattctctctcaaaggccctaagatgatggagcttcttggttaatgcttctgatatatgtttcctttaggtgtgtcttgtgatggaatatgctgaagggggctctttatataatggtgagtgtcattagacctgtctttatctagtggattaaaataatttgaaaaattttaatataaaccctaagttgtttaacattcttcacaatttgccgtcagagtcccaaaagggcataatttttaaaaatctgctaagaataaaaatggaaagataagattctataacattagtatgtgaaatttagaggtctatcaattttttaagtagatggtactttgcatttcattaaaagcatttaagtaaaagtttactttttaaatagattttaaaatatcttcagatttttttctttttgccctctcataactttgagcctcctcattttagaattctttaaccatatttcgatttcactctgctttattttttcttttttttcaaaaaaaaatgtgaaaactcacttcacacaaccttttatttgtagtaatgaaaaaaaactttgtgtagttacattggagaacagagttcttttaccctaaaaataccaaccatatgcagaaatgtattgtctcttgtagcaccagttatataaaacaaattgttacattttattttttaattagtattattttatgtaaacttttacttatatttactgcccatgtgttcatcattgtgatggatatctaataccccattgtcttatttgattgaactacttctggtttttagccattacagaaaatacaggtgcaaacatcttgatatacattgttttgtttctttctgtactgttctctgcctctctcttgtagtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctcattttgtgcctgcagtatataat

SEQ ID NO: 121937 - DNA, 1239 bp, Homo sapiens
ctatattttgtctgtccttcatagccggtcttttaacatctatatttatatcgtttctcctccattccctatccctgttgaattattcaaaggctatttttaatttcttaaatatgatagctgaaaatatttattatatgttcctgctttttgtttttccatatcatcttctgtcttctcattcatcttgtctgttttagtttttttttctccatttaacaaatcactttactttgttcctccatgtgtcttttttggttttacttgagaatgaaagggtgtacagatcataaactttcaaagatagagacaagcatgcatttaattatcttctcactttaacaaaaattcatacttgttcagtggcaaatccagatactgttgatttccatgttttttttttttttaatttaaagtcttaaagattgactttagttttttatattgggctgatctatttgattccgattcttgtggtgttttttgtttgttttttgtttgtttgtttaactcaggttgttggaagaggagcctttggagttgtttgcaaagctaagtggagagcaaaagatgttgctattaaacaaatagaaagtgaatctgagaggaaagcgtttattgtagaggtaagttgagatttcatttcttttgtgtagttctgcacttaagatactctgtgaatttaatattatgaaaaagattggtttctcagatgtcatttctttgtatacatgaacatcagcaattcggtttaatcaaaggtactgccataggaacattttctcgttcatactcttaattctgattaaaaattaggggaaaagcgacttaactacataaatgaattcacccctgaattaaaacagtttcatccatggaattcagatctatttcaaggcgtaatattttaattttaaaatagaaaagaaatggtatgctttcccattatctaaaattaagaaattttatacacttactttaaatggaatgtttttagaaactcagattattttaaagaaaaattatttcaaatttgatttttctcatttagcatgaaaatttgcacctattcttttagaaatagattagattgaatgatgaaagaaaatccaataatcatgaaattagcatattatcaaatttatcctttactaactttgttattttgtattttggatcacattatttagttaaatcaatgtttttatcactattaaacctcattggccaatggataag

SEQ ID NO: 121938 - DNA, 1605 bp, Homo sapiens
aatatcaggcagtcatttgggttttttgtttgttttattccctttcatgtttaatacttagttcatttttgcattaaagattgaatttggacctttctgatattgaaagcattacataatttccatcatcttcttcatttgcatacattaaaccagtgttacacaatccagggtgaaccatgaacacttattagctatttgtcaacttagattacacttccagttcaattgtaagataaacagaggaagatgaccagaaacaaaaactattttatgttgcttccaatattttatattgtatgagaatattaccttctaaattaagaaaatcatgtatttctcaatgtaattgaattgtattatatcaatataattagaaactgtaaaaaaaataataattcaactacaggccaaatatgcagccatttagtagatacatatttctaagacattagctgatcttgcatttctaatattgtaactcagtagtattagtttggcacatcttagattcaattcaattcagtcaaattaggtaaggtctcagcctcagaaatctgcctaggtactttttaaacatcatttagtgtttaccatctagaactggctgtagagaatgttggaataaaagaggggatgggttgcaagaagtgttacacagggtagtatagtggaaagtgttctggactgaaaaagaaaatttagatgctgtactgattctgccataatatatttttgtaactttgaggaagtcaccacatttttctgggcctgtggttactcatgtaaactgactgaacaagatcatttaaggtcttttccagttctaaaatgaaaacacattcatgttttccagtatttaactgttttctatagtaagcttagcagttctttaaagactgatcatggtctcctatagaattcagttggtgaccaactaatcctgggttgacagggcaaatgatatcccattgtacagatattgacaagcagtcatagagtttgacttgccagaagccgcatgcctaagtaaatggtaaagctgggaattgaatatgagacttctcacttgtgagtcagttgccctttccactggatttacagtgtcactcagtactttctgaagtactctataaccaaacctaatatgggaaaggggaaacaaaatactgatttcctttttagtgtagttggtcctgagcatttaatgaacattctcatctgtgcgtaatactctgaggtactataaaagataaatagggcttggtgcggtggctcacacctgtaatccgagcactttggagggccagtgcgggcagatcacttgaagccaggagttcaagaccaccctggccaacacggagaaaccccgtcactactgaaagtacaaaaattagctgggtgtggtggcacaggcctgtaatcccagctacttgagtggctgaggcatgagaatcgtttgaacccaggaggcagaggttgcagtgagctgagatcatgccaccgcaccctagcctggacaacagagggagactctgtctcaaaaaaaaaaaaaaaaaaaagatgatagaagaatcctaggattacctccttaaaatgtctgac

SEQ ID NO: 121939 - DNA, 1030 bp, Homo sapiens
gtctaataaagtgtttcccttagcaccgaatggttctcaatttctccgataccgcacagcaatactcgtaatgtttaaatgctcggctttcagttgggctaatgtaggtgaatttcaccataagtaacatagactggtctacgatcaaaagatgtttcaagtagcatattctgaagagataacgaatgatttcggtgacaatcagaatataatattagactagaaatcgctatcagaaaacccatatcctttctttattctgcagtaatttattttagaacaagatatttcaaagtgactttaaagcgtcgtttttcaaattaacaggtaaattgggttctaatgactataaaatttagaaaagtaaaaactgcatatatattttttaaagacactttagaacttgttaaaaactttggttgaaaatactatctcttaccatttatttgccattttttaaatttattaagcactttgcgttatatagtccatgaaaaacctagtgaaatattatagattgtcaacgagttatgtctactttaaaattctaaaattatttttaagtgtcagcaagttcaaagtagtgagataacgttcaacaaataaattttttttcctgtgcatgttttggaagagtaatggattactgaattatatatgttttatcacataaagtaactttagagattattgagaatatcctcattttacaagataatatggtggaaagagcaaggtctttggagttagaggaaagttcagtgtatcagatatgccatttattagctgtgtgatttggggcaagtttcctaacccctttgaattttagtttactctaagaaagggctaataaattctgtttcattttatctgcataacagatcttagtagacattatatgcaaaacacctaccacagggcctgacacatattaggaaacctagttccagagaggaaatgtgacctgctttaaggtcatatggctaaaagaagacctgtattttgaaaagagggggaaatgtttttagtt

SEQ ID NO: 121940 - DNA, 1032 bp, Homo sapiens
gttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggtgagcgaggcccggcatggagacgccggtcccggcctgccccgcccccgcctctgcctggtgccggctctgaaggtgcctcccggggcccctctaattcgcgggaccctgcggggtccacccgggagaccccacagccctcagtaacgtgggagtgggggttactctctgagctcaactgctcgggagtagctgccttttttcctctcttgggtactcttgattttggatttgatattccggtgataaacaggagaatgaactggtgagatagtgtggtccaccagttctcgtatctgtaagtagtagtttcagcgaagatcgtagccgttctggagtttcagtccgctggacgtaatgttcttttttttttttttttttttttgagacggagtctcgctctgtcgcccaggccggactgcggactgcagtggcgcaatctcggctcactgcaagctccgcttcccg

SEQ ID NO: 121941 - DNA, 1035 bp, Homo sapiens
ttaggcttttgattcctccttgccagaaccactagtgaccatatgaactaaagagccaatatagtatactagtcctgagtgaggggctggagactggttaagctgaagagaatgataataggcttatgaataaaaggagactttaaaagagtggtatatacagtagttctcctttatccatggtttcactttctgcagtttcagtgaccatattcagtctgcaaatattcagtgaaaatgccagcaataaacaattcatacatttaaagttgtgcactgttctaaatagcatgatgaaatcttgtgctgtcacattctgtcctgtccctttgtccggggtatccatgctgtagaaactacccacccattagtcacttagcagccatcttggttatcaggttgaaaaaacagtatatagagtttggtactaggcatggtttcaggcatccactagaggtcttggaacgttttccccttggataagggcagtctactgacaaaagatattggcgtagttatcggtgagcttcttaatgtcctagaaaattgtgttaccaacttggtcaggttatcattgaaaagaaaacagctagctttgtaaccacaggaagacatttcattttaattatctctaaaggttccttgtatgtaaagtcaccaaagcctacttgtctgaaagcttagagctggatttccaattctaggcctctatggaagctatcagatgatcacattcctttgggggcatatcagagttccttaagacaaatgattaattgtaatcttccttgtctagagtatgttttttgaatatagactttcctgggaaaataagaggttttcctgttagcttatttgatgagataattatactttagtgttgcatcactatggttttcttaatagtattctcttttcttatctgatgccaactattcttaaaacttgagtagagtagaaagattctttgattttaggaagaagaaattaaagttgaaatttatgcagagtaaaacgttttaaagaatgcaaggt

SEQ ID NO: 121942 - DNA, 1039 bp, Homo sapiens
ctaggaaatgaagatattttattcattctataaatgtatgttagatgaatgaggtcacaattagccaagttatatattatatatatattttaatatatagataaatatgaaatatatattatatattatgtaatatatattacgtataaggtgcaatacacaaaccatcacaatagtacacattcagacttatgataaagtaacatgtgaagagaaatgtgtggatggaaattgctaaacaatgttcgggttgctctactacttctcttttctttgtttctcttttctttagtgtgctttctcttctctctctttttggtgttctaataaaggagaaaggaagaggtataaaatgttgggaaaatatcagaagttggagtaggaatgaagcaccacaaggaagctaacctaagtaaattgtccctttgtcatccaatgctcataaaaaaactacaaattatttttagatttctaagttccttgttttggaattcaagttagtgcccacagtttaaagataccaataactcataccgtcttggaggcaattgctttaagttgatttactttgatcaatggaggaggcattaagttggtttacctttgtcccagatgggagaagtaggatctataatggaacaaaaacattttctaagatgaaaacttgtgggatgatgagtttcccatttcttttgttgcctgcccagaattcaggtgagaactcagggttttgtaattcaagcattgattaggaagtgtgtaaactagggttcatttgttaaaagcaaaattaaatatcttaggcaacttatgcaagaagggaatgtattgaaaggatttgtgaaagcttggagttgctaatagagtctagtagacctatggtggaaaaaagaaaaatccaggcaactccaaaaggtctagttggcaaaaccactccacaatacaggcaagacaccatcaatggaaagaacaaattcctactttatttaataaatgtttattgggtactcataagatctgggcagggggatactacaag

SEQ ID NO: 121943 - DNA, 1023 bp, Homo sapiens
ggataatttttttttgtatttttagtagagacgggtttacaccatgtttgccaggctgatcttgaactcctggcctcaggtgatccacccacttcggcctcccaaagtgctgggattacagatgtgagccacagcacccagcctgtcattgtttgttcaatatactcttgccctaacaccacacaaatctcaatcagttgagttgccttgtaaacttgaaatgatgaaacttgtaatggtattctaaaaatcagataaataactttaaatacgcatagagattcaagatgggtagacctgatgctgctgaactaccaaccaaaaatgcacatatgtatttatggtattgccataaataatatatcagttattatacatatttaaaatgttcatttctttttataacagggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgtaggtgttacattcatttaaacaaaaaggattgaatacattaatggccagtattactggaacatgtaggtaaaggctcattaagaacacttttaaataattataaaaatacagttttccacaattactaccacactaattaccataaattagtggttctactaattttattattttggctttcattttgaataatcactttctctttttataatataaattctatggacacaaaatagaagcttactaatgatatttcctccttaataaagataatgtttccacacttgcacagctggagtgggagcatcacatgagtaaaagaatcatttgtgaagaggagggaaggaagtttggttgtgctttgttttgtctttgaagcttatctttttcttttagtgttctaagaaaattctttaaattatctactgttgattggtttaagttttagtttcatgggacaat

SEQ ID NO: 121944 - DNA, 1046 bp, Homo sapiens
atacaatttctacagtttcacaaggaggttagctaatcaatgaaatggatcagtgatttctcctccttcaatgagcagcccattaatactagcacaaaatacatgctagacagttcaccactgagtcacatctttaattatctatcatactttcttattataatattttatccaatttatccctaaatatctagtaaatctgtactagtaagagggagcctcagcatagaatatttttcagcttaccacagaaattgaaaagatatataaaatcaacttttattgctgtatagatattatttttcatgtgaatttataattgtcagttatcaattattaaataaagggtataatatttgattatgaatatatgtaatctttcaggaaatcttattgaatctaccttccaaatatttgtaaaacatgtgtatatggaatatgaccactttcttcacttccacagctatgtagcccccagcatttcctatctggattactgcaaaacttcctagtaggtcttcgttgttctatacttgactctacatccagttctcaatcacagcagttacatcctttttaaagcatagaccattttgttcctctgctcagaaagctgctgtgagtccacatctcactctgagcaagagtagaagtctgccaggctttatgtgatctgctgcctatcccacctcctcagcgtctgtggtctcagctcttaccacttaccccctcattcatgtattccaggcatgctagtctctttactaatccttaaaacacaccagaagtgttcctgtctttgggcctttgttctagctgttcctgctcccttaaaattatcttctcctggatatctgtttggctaccaaactcatctctatcaaatcattgttcaaaccctgcatgctcaatgacagtgtgcaaacaaccttacttaatataacaacttgtaacttcttaacatttttgaccccctaaccctactctttctagagtattttgcaacttccacaccataaagtttccttagttgttaaatttattgt

SEQ ID NO: 121945 - DNA, 1005 bp, Homo sapiens
gtaaagacgtgttcattagttagagtaggcaaatgaataacatgtaaagccatattttctaataactgtcatttaattggatattttgtttcatctttcttctcttagatgcataataaacatatatacgataactcaatatagaaattagatttagtatccttctaggtaactgaaattaccctgccatccttataaaacagtattttttattgttcttacactgtaaataaatgtactggcaataaagaattaacagcacatccaggaggactttatttaataatgacaatgtaaaatacttcttgtgccattctatttatctaatttataactctatttgattactccagcatgcctttatctgtaagaattgcaccctagggactagtcaacttattaattcatcacttgtcattttttatggttgcaatctccattatagtatgagcatagagtgatactctcttctgaaagctgccagccaactggttccagtctaggtgaccttttgtttgtaactatggtcctaatggtttttctattggcttctatttctaatagattacattacaatctacttttttgtcttatggtatcatgatgaggataggacagcaagagtgaattccacacctgcaattacagagttttaaaaagaggaaagacttgcttcaagttaacctgtaggctttttaaaaaatgccttttgatttatctgtcacctgatccatcagcaatgaataattttcatggaaggtgcactttaattacattcccatttgacttgcattatcaagccctatctaggtaattaatctcaccaagtatccaatttcggcctttattgctggcagacagaccttcagaattatgtgtgcttgagtgggtcttgggcctttttcaccaggcaggccctgaaagagatctgaggccttccaaatcttgaaagtatgcctatgaattttttctcttagatattgtgaataaattaaattatatttg

SEQ ID NO: 121946 - DNA, 1042 bp, Homo sapiens
agagtgtcagtagcctcctaatttatttgtgtgcatttgatcttgctccccttcattattttttctactcactctccagcgtcattttttaaattgcaaattcaatcatgttatgattttctttaaaatatatcatttcctcccatagtttctaagatctttcttaatatttaatcaaaatcctttttttacttacctttgcttatctttttatgcatcacctaatgacactgaataaatatcctaaatgttttattcccccctgtgattataatatattgtaattttctgcctggattgttatctctttacagaaggttcttctaagcttatcacccttcactattctccccatttccttctgaacaagcccacagtcgtgctggtcagagaggctttcaatatgtacccactttactgtaatgtgccccattagattataggttactacaaaataatagcatttctttatatccttcacatagcaccctgcctaactcacctaatgagtaaatagaagagcaatgattacacatataaatgaagtcatttagataacttctgtaaagcaggaagcaccgattatatgtccttatccaaaatgtagtgaagtaccaacaagtgattttgatgatggtaatattgataataatagggattctcttccagggtgagaaaatgccttttgacttttgaaaagatgtcaacttaaatgtccaagaataggggattaagactattatgaatatccttatggtgaaatgtcattgaaactcttaaattatgtcattaaattatatttgctttcatggaaaaatgttaatgatattagactaaggaagaaagaagtgcacaaagtaatgtgatacatgtttttaggaaaagactggaggaatatacaagataatgttcatgtgggtcatcttttgttggtggactatttggattactctatgttctttatattttcctcctggatcatgaattgctatatgtacatgtgtatgtctctgtgtctatctatctattctatctatctatc

SEQ ID NO: 121947 - DNA, 1066 bp, Homo sapiens
gtagctcagatgccggagtcacagtttcaaaatgctggtttcacaacttattaggtgcataaagtaggacaatctctccaaaccttaatttccttaagtataaaatggggctaatagaaaccctcatagggttcttgtcagaattgaatgaagtaatgtatgtacaaatcctaaaaatagcatgtgggacatagcaaataatcaatgaatgcttatcattaataataaaacaaggaatttgctaagtaaagaaacctcatggtgatgaacaaatgaacatgtatctcacaggccacaaatagttaaatatcctttaagcaagtaatttcacacctgttaatttatctaagaaggcatttcaattaaaaaatattttacataaccctttttttccaccagcagtgtatgcaattttaattattgataataacctaaatgtccaaagttaaggtgtatcaccttgattgaacttactctatagaatatcaatgatattataaaggaattttgaatttctattaataattttgaatgaaaaacaaaaatttgtataaaatgacatttagaattatgcaaaatatacataggaaaaagagtagatggtagtctaacaatgaatgtatccatgtagtgggattgtgggtgatcttttgttctgtctataattcaaaacatcttgaacattaacttttatttttgtacactataattttaagttctaagtaaccaggtagcttatataaagacaacttgaattgtatctccaaaatatgggtttttaaattaagtttgtttatgtataaacacagggctcaggtactatagcagtagtaagtggcaaatatagtttaaattatataaaaggtagaagatattaatagaaggcattcaataaatacagctcatagattttgttcgtttttagttgttaatagataccaaatcctattttaagtacttgcatgtattaagtaatttaaccttaaagggaggtgttactaatttagtctaatagaatgagactattattacccagtttaaaagagaaaaaatactcttaccgtga

SEQ ID NO: 121948 - DNA, 1045 bp, Homo sapiens
ggttctaacaacaaaaaagtaaaacacactttacttaaaggcacagctcatttcactgtccgggctccgtgcttggtagctgagagaaggcttgcttcgcctctggtttctaaaagatcgcgcggagtacagctatagaaaagagtgtaagttgggagcgttattctcggatttattctgctacgcgaaagctgcggttgctaaaagcagagcgtccaaagcagcacacacctcggctaccatcctcgttctcctctgaacatccagcgcgagctcagaacctggagggaatcctggaccagcaacctgactccgctcggcaccgattggctcctgcctcggaccccgcccccgtggccggggcggccatttcgccgggacccgccccttggccctgggaatcgcctcctggcaggccggctgtgcctgccactcagcccgagtggcggaggctctcagctcggagccccgccccctccccccctaattgatattattggagtgtggagcaagcggccggtctgcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaaggtaaggtgatgggaaagcaaagtttgttctgacttatttatttagatgtctacctgcacaagccagctcgtccgcggcgctgccggccgcgcctccggcgccgggcgaccctcccccgccggctccccgccccctcaccgctgaggccgctcctggcggaccagcgagcgcgaaccagggctgttccgagccgcctacagccctgtgcccgg

SEQ ID NO: 121949 - DNA, 1050 bp, Homo sapiens
ggggtggaaccctatgtgacactggcttggtcctattttatcacattttattgctctccattgatggagtggtctccatcaatatgctgttctttgtgaaagaatgagcatttgtctggggcactactcaaccccacatccattccatccattaattaagtctctgtctgcagagctgcatgtgtagcagtgcaggcagcagtggcagctgctgtggagctgtcaggcgagagcccatggttggcttcaagtaaacaaagtgcagagcagcaccaagcccgtcatctgccttggaaccattgaaactggcacccaagatcagctgcaagtgccattaaagggaaattgcaagaattgagatcttatattgataaaaacttcctaattgcattgtggtaatggtatcaaacaagaaaagacagaaccaaatgacagaagatctgtccctatttctaggaaataatataatttgattcatcgtatggcttcatggtaaactactccctgttacaacaaaaccctctagtctaaattcttctgataccaacatctttaatagtaacatgccttcaagcaagatctccccaagtttcagttggggagatggaagaaggaatgaagctgcagtgctgctccttgtcatttctagcactaaaccttaaaaaaaaaaaaagattccagagtcttttaagttcacaaaagtagaaaaccactaatgtaagacatattgtaaggctggaactacaatttgactagtgtcaacagtgaaaccatgcaggaagccagcatcttcggaagatgtgattgatgataagccagaaccagataatctcattgaagaagacctcaattttgtgctgaggaatcacttatctcaaaaaaaaaaaaaaatctatagcgacatgtacatatgggccttctcacccctctgttgaaatttactcagtatcttcaagttaaaatgcagatagaggtccattgaaacaggtagtaatttcaacaacagcaaaacaatattcacgctgccaagagagttgataaatagaacaa

SEQ ID NO: 121950 - DNA, 1014 bp, Homo sapiens
caaatactctttcagtgtatcctctcctcaggtgatgcctttgttcttattggaatctgtgtaagagaatccaatgacctgacctgtcttctgcccagagaccatggagatttagcccagtctctgcttgccttccttttccatggtgtgccactggacacacttctgaataaaaatctttttgcctttctcaacatcactcatatttaattctgtcttttattccttgcactgcaaaggttcccacttggaagccagacatcctgttctatcctttgtgtaattggtagcacttaacaattcattgtagctaaagttgtttttagtaattttgtcttataaccctcacatcatagataaaattgctttatacaccactttttaatattagagaatttcaactatgactctttattatttattgagttatttgccttcatgtgttttatgttattaattagtagcccttcgtctcaacttaaataaatccctttagcagtttctctagggctgacctagtagtgatgaaatctcttagcttttgtttgtctggaaaagtatttatttatctctcatttctgaaagatagttttgctaggtaaagtattcttggtgggcagatttttaaaatttttcttcatcattttaaatatatccttccactctcttgtagcctgcagggtttctgtttagaaatatgatgacagtcatattgaaactcctttgtatgttatatgtttcttttcacttactgccttcagaattccttattttacttgaattttgatagtttgaatattgtgcatgttggtgaatttctctttggattaaatttaattagagatctctgatcttctcatatctgaatgtatgcatcttttctcagatttgggaaatttacagccattaattccttaaatatagtttctagaacttttaaaaattcttctgtgcttcctttctgcaaaggttagttctcttgatgatgtcccatgattcctatatgcctgcttt

SEQ ID NO: 121951 - DNA, 1093 bp, Homo sapiens
tagattggtttcttggccatttgctggcccagagatttttgaaaaagttaccaactgctcagcttcatcatttgtaaaatgaggttaaaaaaaattctgcggcctggcgcggtgcctcacgcctgtaatcccagcactttgggaggccgaagtgggtggatcatgaggtcaagagatcgagaccatcctggccaaccaacatggtgaaaccctgtctctactaaaaatacaaaaattagctgggcgtcgtagcgtgcgcctgtagtcccagctactctggaggctgaggcaggagaatcgcttgaacccgggaggtggaggttgtagtgagccaagatggcgccactgcacttcagcatggcaacagagtgagactccatctcaaaaacaaaacaaaacaaaacaaaaaacagaaactaaacctcactgaatttctgttaaccagagggtacaagtgtttacaataaaactgacctgggcaaggattgattttgaaactgattttgaaagttccagatgtgtcttctagtattgagttatatttatctccggtggcttcatacaaaataaaattagaagaaaacaatatattttttaaaaaaagcaccagaagtctgtgtgatttaatttagttaattgaaagggaagtctttttggcttttgtgagttacatgataaaagcaaataatttttgaagtactaattcataccaccctgcttctgaatctcttggggtctcttagctagctggatatgtccaataattttttattagacatcactaagcttcaagtcagcatttcaaaggattaaaagcacaaaactcaaaaaatagaagctacaggttcaaaagaacctattgtgtatgagtaatgtaaacagtcttttgaggagaaaacagattttcagtagccaatactttgagtaggtccctgccttggaaagatatatctgcaataaacttgtaatattttctctatggtgacttataatacttttcttttattgaagctaaattagttcctccacccctttcctgcaagatcagacattttaggcatctcaagggtcattgtggttttacagcgttgaa

SEQ ID NO: 121952 - DNA, 2238 bp, Homo sapiens
acatagtgagaccttgtctctacaataaataaataaatgatttttaaacagaattttagttcacatacatagaatgttcccttcctacattcagcatacatgtaatctgttcaagtaatgaaaaacatattttaatttcttaaataaaatttcctaaaggttcgtctgactaaacgtaattggcatgtacatggtgatatatccaaatgaatattgccgtttattctagccatagacccttattgtacacatttatatatgatgatataattaatgtcttcactttcttaatttcaccaatatgtgatgaaatcagtattaattattcaatgtaatgaaatttatggattttagttttcgtgttgaatatattggaaaatactgttgataacacttactaattatcttttttcaataaattgcagcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagcccaaaaagtctcatcataattcctttattcaggcctaccttctcccctaccgctgaaaactgtatacatatcagctggatctgatttctatcagatctgatttctatcactggagaatagttgtgagtgttctattactttatgaaaatagagtcattcagcatttgtatgtgtgtatgtcttttgctcagcacaatattttgaactgcacttaactatatcaatagcttagtcatttttattgatgagaagtctcctattgtttgattttggcaaatttgcttttatattcacctgttgataggtgtttgggctttttcaaattttaggcatgtagcatgtaatttagtcctgcttttctgtttcttaaagttattctgtcagtcttaatgtctgtttatttcatttatgtttaatgtaataatgatatgattttaaatctgccatttttctgtttattttccatttgtcccacacgtctgtttctttttttccttctttttcttccttctcttacattacatatgcgtattattctgttttatattttcttctggcttatgttattcatttgttttatttataactgtacctttttacaatacgcccctttaacttaactgattcttattgttgttcccaccgcttctcacctttctcttctccttccttctggcactccaattacatatatttagatagagtcatattgtcccacaggtgaattacagaaaaaatataacttggtgcctgaaaattcttcagtttgttaatatagtctttgtaaaaccttccagtttcagtttcatttatctttttagtgcccctaccagtagagct

SEQ ID NO: 121953 - DNA, 1051 bp, Homo sapiens
ctaatggagagcatatggtataatagatttgtcaaaacctgtcgaactgtacaacacaaagtgtcaaccctgatgtaaactatggactttagtgaataaaaatctttcaatattgggtcatcaattgtagcaaatgaaagatgttaattataggagaaaccgtgtggagggttggggcaggtaggaggaagagtatatgagaactccatattttctttgctatttttatgtaaacctaaaacttactctaaaatgtaaagtctgttcacttttacaaaagcttattaatgcctgataaagaggtcataaatattgacaaagtgatcaaatagccatatgtattctgaaggaacttaacaaaaccacctcgtataaatatgttcttctattgttaactctttggtacttactgtgcctttttaagaatatctgcattcatgttcttgtcttttccctttctttttggtcttttctattaggtgtactagccctctcttggtacccacctgatgtaaatgatgaaaatggagaacctactgataacttggtacccactattttggataaagctcataaatataacctaaaggtattttattttattttcaagctatacataagttaattcttttggacaagaggagagtaataacaatttttgaaatagtaattttaattaaaaatgataatgacttagaatcttttaaatactatatttcataaagaaaatttctataataggaatttcaatcttatctaaattatattttagagattctttactatgtttctaatgttttatttttttatagtagaaagggattgaaaggttcttttgtgaagataatatagtagtgaagatttatatgtctaaatatcttagatgtcaaaaatctaaaaacaagtattaaccatgtaactttgcatatttataaagtagttaaaaaataaacttgctcaaatatttttcaaaatccaattttcatttaaaccttatttaatgtgcatacacatacacacctgagtaaatatagaatacagcagaaagatc

SEQ ID NO: 121954 - DNA, 1075 bp, Homo sapiens
catgaatataagtatgtccgtgattcttttttaaatgattttcacctacatttgaaacatgttatattagtcatggcctctcctttttctttttccttgttaaatgaatattgtgaattcatggcagaaactttgggaatcttacctaaatccagtataagtgacagacttaagagtttaactgttgtttgtttttgcatgcaaatcattagtccatttatttatgcatgcattcattcatttagcacctgctacgtgtcagatacagtcccagatgctgacaatattaagaagaaggatgaagtattatctctttccctaaaatgccttgtaatctactggaggtcagacacaaagacaagtaaatttcaggaagagaaaagtatgaggtattatggcaccacataggagtaggaagacctacctcaattttgttgtggcaggggataggggagtgtgcaggggtgaaggtagagaatagagttggagaaggagaaagttatcagattttcattcaaaaaagttcattttattaaaatttatttattaaagttattaaaatgcagggtagggaagagacaggaaaggtcaaaattaaaaacatgaaatgagggaatgtttatattcttattctttaaagataagaaagacatttcattttatgtatagaattctgttattttaaaatttattttaacattgatctaattgatttttccaaatggaatagagagatggagactagatcacatcattaattaaaattgcaaagtaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaa

SEQ ID NO: 121955 - DNA, 1039 bp, Homo sapiens
actcggaattcagatcatcaatattacctccaacaaactgggtgacctggaacaacttactgaacctttcttaaggttctgtctatctttgattacctcactaagaaaacagaaataccttagggagttgtgaagattaaccaagataataatataaaatgtttagcatgttatttagcagtaaattttattggtaaaaattctctggtagtttctgtgttcaataaatattcatctttaattaaggtgattaaatcagttactttattaaatatattaagtatacttctaattttacattatagataatttatcccctaactgattttattgtttgttttaggttacttttcacatagaaccatatagcaatcgagatgatcaaaacatgtacaaaaatgtcaagtatattatagacaagtgagtttcttcaatatttataaatattgttatattatccagtgataattattgttttaagaatagtacattaaattatatttgagatttgaatgatttatgattattccatttttaataaaattaaattgttattgtaatgaatgtcaccatcatttcgaagaacattgctgaagtttcttataattcactttctttttggaagattgctgtttttactgttttacaggtttataggctatttatgatttctgtagttttgatattttaaaatgacattattttctaaaccttcagaatatagctttatctttttaaaaagaaggttcagattattaaaagtgaactacttcttttaacacagtagacccagagctgatattttcatttatatctagcctgatcaaaaagaatttattaatacagttttcattttttgaaagaattttactgataatagtctgtgacagatgccatagtcttacaaagaaacttgtcagcaacagtagaacatttatcactgatagataaaaaagcagtttaggtattatgtagagtattatttataatgtagagacataggctttttatggcattagtcatcatttgtaaacctcaa

SEQ ID NO: 121956 - DNA, 1097 bp, Homo sapiens
cttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaattta

SEQ ID NO: 121957 - DNA, 1051 bp, Homo sapiens
ctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagagaatgatcaggccttaggaaattaatacagtagtagtaatcattttctaggggaaaataaaagaataaatcactatactgatattttgatacaagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatga

SEQ ID NO: 121958 - DNA, 1041 bp, Homo sapiens
taattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatgtatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtattttagatattaaagtctatcatttctctttatgaaatgtcttatttgatttccgattaacaaatgaaaaggagtatccagtcatcattctttatgttttctcttttgagatatgcagcacttacaaagtggatatctttaactgcacatactttttaaatctataaacttgtgttaggttaatatacacacatacatgcacacaaagtttttattttttttcatttgagagctgtttttctatttttttttctt

SEQ ID NO: 121959 - DNA, 3171 bp, Homo sapiens
gggagagtgcagggggtcgggcgtcaaagcttggcgcggagagaacatcttttggtttgggaggcaccccaaaccagctgctgtgattccccgtcctccaggcagagggtccagggagggtgttgctctgtggtccccaaggggatgtttgatttcaactccacctgctggcaacctgaacccctctccgtcttggggacagctgcctgcagctcgcagtcccgcctcaccttccagcccccaggctcccacactagcagcagtagatggccccgaccctctggtcaccccaaacagggtcatctctactgttactgtccctgcgttcccaccttatgccagtgcacaaacgcccctatctgccacccttcacccgatctcgcgctgacaaagccttctccacaaagtcctccctgacccaccttctctcctttcccaaagcctggctctcgagcccgactgtcccgtcctattccttcccagggtgaatggtccttagtgaattctgacctcattccctctacacaatggtgcctgtccagattttctgacagtcacctcaggaaattgacacagacacgctgtgatcctggtttctgtacagttactttgtgtgttactcagcacctgggctgttaagggtattatcaagcgtgaaaaaataaagacaaaaaccaaaccctttggaaacaaactttttgttattgttgttttaaagcgcagaactatttgcattgcttaggtttgttctgttcattgagaggcgtcttagctgagtacaggaaatacacctattttacctgttcctgcggaattggtcttacttccaggttaagaacggaggacttgcctaggtggtgaatctctttcagcaacaacactatcaaaagctcagcaactcttgaggataagaagctttttcttgaaggagatgagagtagcaccaaacttaccctttaaaatcttctttgaaattgcaataagccaaagctcttatttttctttaggtgtagtggctaaaagagcgatataggaggattagaaaacattgtaccaagaagctcctgcactatttgggtgcttccagagttgtgtagtatcttagcaccagacggtattgctgtagaagttttcttagaacagtagtcgtttcttctgaaaccatgtttaccgttttattatttctagttggagtgcgagaaaataaagagttgtgttcgatgaatgaatatgagcaagggggatggagtgaacatcgggaggggtcatttaaataataaaatttgtgctctcaatttctcatgtattgaaatcttaaaaacaaaactaccccacaaaatttatggtttaatattttagagaaatgatgaaaaggcattcatttcaacatggcattgtactccatggaacccttggtcacagggcttgtgttctaagcaatacggataagaatatccagaaataaatgttaggaactttaaaaggtgccccactgaggcatgcagtgtgtcaatataaatttcctggtattattatcactataatttgaggggaatataaattaaagtgccattcttgctcttgcagttggtggagagagatgtatgcttcatcaccttaaaggagcaagtctcaggctacataagaaataggaagggaaagttgagccatcatctagggaatttgttagttaatattgccttaataccttctccaatgtcaggaatttttgttggtttgttttcattcaaactgtatctgagattttatttcccttttgtgtaagacataggcagaaatgcactgagcaagtccactgacaaggggtggttttaagtaaatgtggatagccgcattaaaagtcaagaggggctgtgaataatgagtttattgttggttttctaaatttgaaaattttagttggttatatttagggcttgactgagaacattcaaagctgttctcatttgggtaacattagggtgactactatgcacagtatatccaacagtaattaatctgtatcagaatcgatacatcccaaattgaaagcaaggagtaatactttgatcagttattgcccataattatgttaatgataaattaaagtcaatgtattctaatataattccaattaacatgaaaatattaacaaggtctcagaattatctatgagaatccaaataactagtctgccaaaaattttggcaagaatttctataaagaattatggtgagctgaaagtcaagaagatctgccaggatttaatgtcattggcattagtaagaaaggctaaacagttaaatataatgtatggggaggtaaggcacaccaatattggaatggcatatctttgagtaccattgaactgtatcttataatgctcataattatatgccacctagaggatgacgggtttaagtatttgcaatgttaaatataaattaaacattataaagagatatttaaaattatggaaattatatagattattccatcaacaagttgccattggttgaatgttccatgtgaaaccatgttttgccttgtgtgtgatgaagagaaagaatggttaaggaagagaaagctgcaggaagggagagatagagagaaaggcttcaaccccttggagactggcttaaattctttaatcaaattaaggtaactaaatatgagttctattattttggtatttagttaccttatttgattctttaatcaaataaggtaactaaataaaagttctattatttggtattattttggtatttggaatagcaattgttttcccacttgaattttaggatatgactccttaattatagcaataataatacaagttttttaaaataaagccttttattccttttatttagtaaaatctgagcatcagaggcaaaccattttgtgtaatccaattgatgaattgaactaaataaaattctagacaaatttacaaaaataccttaaaaaaagcacacatatttacacctcacacatacctaaaattataataatagataaagagctaaacaatttagtgtcttatgaaggcaagaggattcagtcaagagataaccacatacaatatttttatactctaatatatatttcttgtattttctttttcattgcggtggatgtattattacgtttttataagtatttgca

SEQ ID NO: 121960 - DNA, 1267 bp, Homo sapiens
ttcctcacttatgcagtgtaaggtttttcatgttaatagcatgtcatggacacttccatataagcttttatagacaattgactgaaaaatattcctaaaataacagattttagtttctgtaagcaaaatgcacttacagtttcatctccatgctgattcaatatttatgtcatcacagagaaggtttcgtatccatatgtttatttatttttaaatttttacctccatagactgtgaataactcaggtggtcagggaaggtaaatttgtttcacaaagtttcaagcccacagatgaaaatcctggcacttttagctttctcttcactgatagccagagggatcaatggaagtgaatgactaaatcaataggaaaccatcatcattactgcgtaaaaaaataagctctaaactgtattcttggttatggtggctcatcaccatcatttcatctaggaagaataacatggtgacatattttgatatctccattacattttctggaacaacactatattatctaaacgtgcttggactgatgtaaactaggggaaccagtgatcttgcactgctgggtggctgattcaaaagctgaggcattgatcttaggcattggtcttcttatagcacatcaagatgcaaatttggatgagaggaaaactacacttctaaggctcccctgacatagtttctttggagtgcaattcagcctctctttattgagggcctatggggcaagaactgaagtgatgatggcaggcacaagagtaagtatgatttaagctctgacctcaagcagcttagagtttaagtggagaagccagtaagaacaaatagaaaggagtgatgagacaccagctgctttaacctagggatgtcaccttggtattaaacaagggtgtccaggaaaaactcaaaaagaccaaaaaagaaaatctgttttgtgtaacatggatctaggcatgctgtggctaaggcttgacaacaaaaattatttagttccttaaaaaaagcaagtttccattgctttctatactaattttaactctgacagagttttttgttgttgttgttgttgttttgttttttttggacaatgcaggaacctattagtagtatgaacacaggtagtcccaaactaacaaattcagtggttgattcagtccttggaggtcatagggtaatcttttaatggaaatgtaactaagtatatacttttaaagtaagtaggaaatgcttaccttttaagaaacttaaatcttcaaggaa

SEQ ID NO: 121961 - DNA, 1181 bp, Homo sapiens
cccaataaggtgctgaacattgtttttgtttgttggggatgaagagacagcagtttttctttgactaccagaaggattaaacattgtgaatctgctcatttagtcccaagaaactttatttgacaatcagaaccctgaattttgtcagaatttatcagctgccgtggttgatagaagtgtgataacaccacagtcaatttccattgcaatggaagcttctaactggctgattaacaggacatcatctgtatagtgaaagctttgcaccatggagagtagggacacttatgctgacttatgtactactgatggcaaatggcagaggaatgttggtacccctgggagtaacctgtagtaatgtgggaggttactacaaatgtatattggtggctatgttgtgacttgatctttgtcctcagaagccagtggtatagaaaagctggtactggcacagtccaagacaggataccaagagtttaatctgtgcaatggattcagttacatgaatagttgggattatgggattaacaacttgattcagttggtgataatccattccaagcttctagctctcattacactgtttcactggtcatacagtgctgttgtattaaaacactgcatctcttagcacccatgttcccttcaagtctgtaatcaaggctgtgattttctttcctctttttcttcttattgtttttgttggaccatctgggaggaaatagagaacaagaccagaaagtgatttatgtgtccctttagcacttcactacatttggcctttcccaattgtgataatctccccaggcacttaactgatgatgaagtataagcacttaatatattaattactatacaatcggatatagaaaatacaacagtacatggaattggcccaaagggctccattcatgagatgatgttaacttgcctttctcactgtgaacactgcttaaactccattagctaaatcagacaatcttttctttctataaatccagttaaaaacatgacttaggtgtccacatcccaatatcctaaaagtctgattcccttattttcctgaaattccccaacattcttggataggtgcatatgtcatttgatacccattgggaatagagataccctgacttctagtaatatttctctttaaataagctgagattatgggagaaggg

SEQ ID NO: 121962 - DNA, 1028 bp, Homo sapiens
ttggaatatttaataggcctgcagggctctcatcttttctcttccagaaagccatgactttgtcagcatcccatcctcatcactaacattataaaaatctctgaagggtctgagatttttctctgctcacaacttaacatgaaagtctgccacagttgaatggatgctggtagaaaacaatagactcctaggtcagagatgaaggacaatttatttttcacagcaatagcagtagcaaaaatatcaacattttggtcctgttccctgggtcccaatttccacaaggcaacatgaagtatacacattacaaacaaaaaggccctcaatttaaggaatgtcacccctttataatgggcagtgaacatgcctctctttgttccagaagatactatttctatccaaggctgtctgctttacaaacatgttcttaaaacagttcaaaacaaaagcagtcaatgattctttcataagatgtgcaaaatgtgaaagacccatggaaaattgtctcccagtagtgacaaaagacttcaataagtgactgtttggataggcttcttatctgtggtatgatatatgttcatccttgctatttcctactgatggaatgcattaaacttttgttatctgagattgatgaacctttcactaagatagaaaataagaaggaagcttttggaacaaatatattgtatttaagctgcaatattagagtctaaattagtaatttctgactataatctatatagattacagcatagggcgtgttaaagaattgggaatttctatgtcaggaagtaaaaatgtgagcctaaaccacaaaatatattaagcatatactttgtgtaattataatgtattgtaaatcaaaatcattaagcaaaaatgtgttattacatatttcccatggccataatatttctccaatgctttatagtttgaagggtgtccaaattttcctaaataatcaaaagaaaaaggtgcaatgctgctttaatatgtttaattttttcaagactgagcataattgt

SEQ ID NO: 121963 - DNA, 2142 bp, Homo sapiens
tcatattctaaaaacaacaaaaacatcaacaaaaggactgtctctaagggacagctgccctttccttctgtgcagtgaacttgaaggatcagataaagtgatgggttctctggcttttattctttatttgttggttattcaagggctggctgtgtcttcacttcacttcaagggctgtatttttctgctttttttccagagccattttggaaatttaagaattctaaattcttggattttcattagccaatgttttgctgttttcttcataaaaaaacaggtttttgtaatttttttgtccctacattgccttgttatttaatagcaacattaacatgtgaataccttagaacttataaaatatgtgtgtcatttcaaggaataaaaaggttggagtgaatcaaacacaagacagatatgtttttatgggaagaatggaaggtcaagaaatgactggcttgcttggagtatgccagtggcaatcttgtgcagaagaaaagaggaagatatcaaacaacagaaaaacaaagaaattctgtagagagaagaaggggcaaagtagaagttctagaaaaatagagacaaatatttacctatattataatagggcttcatggaaacactgcgttacatggaaaaaaaaacacagagctgtaaccagatataactgggttcaaattcttacctgtttattgagttaactgttcgactggtacaaaatcactgtggttttggccagtatttttaatggcaaaggaatgcttaattaaacattgagtaatgtttaatgtttttaattaaacaaagacttaatatcaactatttagctgagagattaaagtcaaatttcttagtatatctgagactctttttcctattacataaaaattttgcttaattattttgaatatggaattggataatatgtagaaatctttgaaacactgactggcactgtaaattctaattcaataaatgttacatcttctccatacttaagaatttaagaagacataatcatttcagtttgtaacaaataaaatgagcctatttcccaaatagacaattagcaagtgacaattggataatccaattcgataatcagcaactaggagaactttggaactttcagaatattatataataatgcaggaagaagcatataatgagcacggaagagctaattagaatcatactttccatgataatatgaagtaatcacttagaaaagaagttatctattttaataattattcagtcacagtggtataaaattttttccacaagaattaaaactcatgaacaggaggagttcttcttttaaccaggatgaacaaaactggaaagactatcaatcccaccatcacaaaacaaagccagaggaactacaaaaccataacttttgttaaacctgttgtaaaaccgagttcaccaggcaaacaaatatctaggttttcaggaaatgataggttcctccactgagaaacgagtcatggggatagtgtcatatgtggcagagaatagaataggacctggctgtcatacaagcgatgatagaaattattattatctaaattatctaacaagaaattctgtaaaaagctaaaatcattacaaattgccaaagactgactgacagtttagaaactctggtaatccctgacgcaagggtagtttgatgtcacccattggggcttatatgtggacttccactaggtacgtatgagaaatattggaagcagggtggggacaggagggagcctcttggtaatacaggtgcagagtaagggattggctgccacttcagataaagcacaaaatcccagtctattcaagctcgcatcccacatcctaagcacaaggctagaggaatgtgaagtctttggcatcctgaagatcaactcttgactagagtaactcaatgccccaaacgaatggcttcagaatagcaaaagtacactctgtttctaggtataaatgattggcatcattcccaattattttgcacttgatatttgacatttaattgacaaattataagatatacaaaaatttaaagaaagaaaaacgattgtcaaaagaagtcaagcaatgaacaaaaccagacttagggatgatccaggagttgaaattatcaaacag

SEQ ID NO: 121964 - DNA, 1042 bp, Homo sapiens
tgctccatctactagtcatcaaaaacttagttatattgattagtacattttgaagaattgactattgctctaaggaaattggccccaaatttaaatactttacttctacttttaagtctttttaaatatatttttcctagtaatttatttctcagtatattttacaaaattcttgatggagaagaattttaaaacaaaactagtactttacttcaattggtttgagaaacactcattcccaggcattcaaactaactaaataaaaatgacaactgaaagatctgtagccaatgtggcctatggctttccagtttgcagttcttcctttaaatattctaaacttgagacctgtgtaccaagactgcattattctcaccttttgcagaactgatgtacctatgttatgttttcagtttacattgagctctgtggaacatattgttacatttaaaataggacttttaaaaaaaatccagtttattacataatacagagtccttttatgataatctacaggagaaatgtttctcacactttgtttcccggaggagtcgtacttattttgttactgattttattgaatgagcctctttttaatggctgctaggaagctcagtgtcaactttctatccctaatgactatggagagactatgatatgcctttttaaattaagtgacttaatttatgaatgttgttgtttaattttatgtttccaaccttattcagtcagtaatttttttcgcataatacatgttaacttttaataaagtaaaggacactagaaagaaagacaagtagtaaggaaagaaaagaaaggaaggattactcaaatatgcttgtatactacatattaaatatctgagtaactctagagtacattacttctttaaattttactctcctagatacctagttgaaaaatattctttgaaaatataactttgaaaattttaatgttaagaatacctgcagtagggggaaatttaatactattgtctttacgtgaaagtaggcagtaaaattcacccatatttcctttt

SEQ ID NO: 121965 - DNA, 1487 bp, Homo sapiens
atattatatgtattatattaatataatatattatgtttattatattaatataatataatacattatgtttattatattaatataatataatacattatgtttattatattaatataatataatacattatgtttattatattaatataatataatacattatgtttattatattaatataatataatacattatgtttattatattaatataatataatacattatgtttattatattaatataatataatacagtattataattaaaatataatataatatttaataataatattatgaaagttctcatctgcaaaagaatacttttgattttagatttcttatatattttgagccaaaacctttatacttcagaatcgagattctatataaatactaaatagcttaatatttaaaacataattttcatccaagatgttctttaaaataatatttgagttaattttgtaaggttctaagcagatttccatgctgcaagagtaacaaattatgaagagtaaatatatatctgaaatttgctattataattaaataaaaccaagagcaatgttaatctgatacattgagtctgttcatggtttgcataatcgtgatggtgcagatgattattagacataaatgctaagtaattcacataaatgactatcagtagaattacttggttaaactaactttttgggttttgtttcttcccattttgtcagtagggcctttagcggtggtaacttccccataacatgtacatttaatcatgattgttattaactcaaatataacataatgtaaattgtttcttccttacagaaccttaagtttctttcactggagagctcttcagttcatccatgaagctgagtcccagattaaaaaccattgctgtggtttgtctgtattttggtgtatcaaagcagacaaaagaaaaggaaagcacctccaatccatcttaataatcatcccaccttcctttctgctttcatatgacatttatttaaaccaagctatagctgtgcttctcaaaccttacagtccatgtgaatcacctgaagatattattaaaatgcagattcttattcaatagatctgggttgggatgggagatttctaacaaactcttaagtaaactcctactctggaaaccacactttgacaagcaagggtctgtaaaactagaaagctagaggccttttagttcatggctcttaaccaagagcctgcgaatctctgggacatttatccacaggttttaggattctatgagtcccaagaaataaatgcaaaattttatatgtatgtgggtatgggcatttttttattttctggagagttaacagttattagcctttgtaagaggcttatgaagacctaattaaaataagtgggtagtgattgaatcagtcccatttttagatgagtaaactaaggtctaaggaagctaaattatctgcgaggttcacagagtttgttac

SEQ ID NO: 121966 - DNA, 1009 bp, Homo sapiens
aactgaggccatctcaggcttctattagcagaacatctggctaaccaaaacaagccaaaacccatttttaattcttcttctttgccgttatgcgttaaaactataaagtgaatttgaaaaagaatgtgggagactatgaggaaaatatagggtaacttcctttaaattttttctattatgcttttaaaaaatgttaagaattcagaagaaatttggcatttctagaaaagcagttctcttccagaatggtagctggggaaaaatatgtccaatatgtttcccaccagctgccagagatatatttaaaatgcaaatctgactaggtccaatctattcttcaacatccatcaatgacttttaattgatatcaggatagtgtttgaatagctttaaatggctttgaacactttcttaatctagttcttgtttatgtcacaaatctcatttttcactggtccccagtttctactttaagctttggtgatactgacctgaatgaccttctttgcaccatctacatgaaaatgtggctcttctttagcttatgctttcattctgcacagaatatcctctttggcctggttaattaaccaaaaactcaggtgtcacctcttccaggaaaacttccccaaacaaccagcctggaataatcaagcctcccctcaatgcttcaatatttctaccttagcacttaatgtattattctgaaattatgttagtgaacctgcccttctttctgcattgaataatctctaagagtagatgcatgactttccttttggtacttctatcactaagcttagtgatgggcacataatttacgctcagcagatgtttattcaattgaactgaacatcattcagttatatatatgtatacacacacacccacacacacacgtatatgccattagtgaaaaccaagcaatggagtgcaattagtgccaactatgtggaatgcaggcatgagacaagagaggaacttcacagtcctcagagtatgtttatgg

SEQ ID NO: 121967 - DNA, 1269 bp, Homo sapiens
aagaacaaaacacattctatttgaggcactgaaaatttcaactcaggcctacaataaattcatttatttatccatcaactcactagtgcagtcatgtggtctaaaaagagcactgcttattagctagtattccacaagtgaaaaggcataagagtgcaaaaccatggtgcattcctagaactagcaatcctcgatattcttggagaataaagctggaagtagaaaagggaatgaagaagtagaaggtcatgtgacattcagaaggatcagatcaaaaaacacctttcacgacaggcaattgagccggcattttattttgtcggtgatcctactctgtagtatcctggcaatcaagtagagggttggagtgactaaacccagataccacagttcaaagaaaagagatggggagagcaagaacagtgcagtgtggatagaggggaatctatgtaaaaaggtacctgttttggaggtagcattattagagcttgaatgatggaatgtgggcattgaaggccaaggagaaatctaggatgaatccctggatttggcttagtggtaacattcaccaagacactggaagatggccaagtttgttgaagttgatgttatagcagtttctttgtacttggcctttttatcacttttatttgtttctactattgtttaaagggtttaatgagagggtgggaaaggaagaggaattgatgcactagaattctcagatttgagcctacatgtgtctttacctgtgactgcccgccccctttcctcatcatcagctgccccatctcttatttgttctgcttttctctaggctgggccagtgtccctcccggtttatgcctttccccagtttttctctcctgtgacccatcttgcaaaacacgactttgtacatgtatttacacatcagtgtcttccccatctagtagactgccaacttcttgaggacagggtttatgtgtccacaaagcagccagcagaatgcctgatacacaataaaatattttatatattgaattcttatttaagtgttctgaagctaagaaattcagagtgatggattttctattactcaagttcttccctactgtgcttggtagaatacatgatttataacttacatgtaaatttcataagctttgtgtaaataattcaaaattaaatgtaatcttttactgttccctgaatgtaaacagacatctactcatattaaggtaaatgattttatctatggatttccttccaacatcccatttctatgca

SEQ ID NO: 121968 - DNA, 1945 bp, Homo sapiens
ttctattcctgctataacaaattgccagaaacttggtagcttaaagcaaggtaagcttattatcttacagttatctaagtcagaagtccaactcaggtcttactgggataaatcaagatgttagcagagttatatctctttctagaagcttttgaggaaaatttgtttccttgacttttctatcttctagacgctgcctgcattctttggctcatggttcttcctccatttttcaaagtcagcaagtttcattgccctgacccttcttctatagatacgttcctctgaccacagcaagtaaagggtctctatttttagagacccatgtgattatattgggccctccagaaaatccaggatatcacttgatcttaaggtttttaacttaatcatatctgcaaagtctctttagccatataaggtaacatattcacagctttcagggattcccacccagacatcttctgggggatggggaggttcattctgcctgtcagagtgggtaagtggaatgataagtgctagggagataaatttgatgaaaatgagcagtaacattggaaatcattacatgcctaccactgttactcaatgggaagtgtttgtagcttgagcttgagaagagaactttcctgtgtaagatgtaaggaaggattgacaaagagaagcaaggtttccaaattggacaaaaggataaatggtactcccattcatgaagttggggctagaaggagagaataatggagagtgaattcatattgtcatattgatttaagttcctatgatacttaatgctacatctgggaggagatgagtgtattctcatggaacggaagcgaagaaaagagatcggcagtggatgctttgattagcatgtgctcactgattcatcaaatgttcctggacacgtcctaagtgccagttgtgggaaatgagagggggggaactgaccaagtacaattggaactgattcaaagtctgattttcctgagtggtgcatctgcagtaaaaccaggtgtggaagagcaggaatgctatagtcagcttgtctgcatttgaatcctgattctactaccttctacttgggtaaccttcaggaaattatttactctcactgtgcttcactctcctttcttctgggatagttataataataaaaatgttttcttcatagttttgttgtgagttcctacatgtaaaattatttgaatagtgcctgacacatattaaataaatactacttataaatatgaaaagacaagggaaaattatggaatggatcctcttgaagtaagggtttgattggtctaagtcagaaagtaatggataggaagaagaggcggacatagagtcatcaaatcatctcttccttccaaggttgtagccttctgggtgctgtcctctggaatccttagttctcaggctgcttttctggagtctctttctaagaattatgcaagctagcaacattcagtctcctggcatgtcaatcatcaaaatgccaaaacacatgctgctcactgataaaattcagtgtttaaatagaagactaaaaacatttatacacaatttacacatctctttctaataaaggaagtatatcttagtcctgtccttcttgagtgggtaaacaactctttcttacatcttccacatctcctatgaggccatcctgtttcaaaggcgagggccaaggtaaactatcagagagaggtttgaaaagaggtggttggttttaatactcatccatttgtattagcatgagaataaatgagagatctaccagactcccatgttggccccaaaatttacagcgtctggagtgagaaatacaaattggacaatagttttgacttttcctcctctttagactctgttttgcttatcttaattatttcttttgtgttttgagcatctctgttattttcattcacagaaaagagag

SEQ ID NO: 121969 - DNA, 1995 bp, Homo sapiens
tggagaaagctcaataagagacatcaggaggtttggcttcttttcagaggacttaggaagttttgatacctaaatgatataacataagactaacttttgaagtaagtgctaaaactatttatatatactagacaattttctcaagatttgtcctttttgtctcttagactctcactaaaactccgtcatcaagttgtaattcacacatgtagacaagccttcagcctctccaaacatttttaaaatctgtaaattcaaaacatttaaaaagaagacacatgatctcatctggactgctgcttgatcttgtttgatattcttcagcactctactttttataacgggtcaatagcagacgggcggtaactgatctccttatttcagagctgaaaacacaaggcactttgcgttgggtgcagttctattctgttatgctactcccgtttgtcagtaggtaaaaacttttcccattccccagaaggcagtacttctatgaatagttgctttagacaagcattcattgttcaaagggtttgattcctcactgagcaaaagctacagcattataaagatgccagttgaaatttttttaagcttgaattttttaaagctagaaaggaaccctcactgttggggaagtcatgaaagaaaaccccttttcacaagccctggaacaagtggattaagagagtaagagtaaaagtgcaaagactgggaacctggctttattccaaaaaaaaaaaaaaaaaagccagaaaaaagccacagttagaagtaattgaacactttggaaatccctttgaagacctaatgcagtagaattttttgaaatgaataaaagctaaatgcataataatttcaggtaaaaaaatacaaacgaatgtttgaagaaccaaataataaatttataaatgtttaacgcagcgggacctagcagtaccaacctttgataatgtatggtaagcattagcaatgttgttacttggaaaagacaaattaaaaacctggcaatcttacctcatgttgttttgtactttgtatacttggcttggtttatagtgatgatattatctgtactgattatacttgttcagtagaattttgtacacttgcaaatggaatttttagacacaagaaacaaggtacaaaaattgcctaactacaaaaatttctccctcttttatattgggactaatgatatgttaaacaatctgatgtatcactttagaaaaacagtaatggcagttgcatttgccaggaaaatgttacaatagattttagctctcttaatagaacataaaatattagtttttaatatcttgctatatgtggtgtttttaaataaaaaggcatagaaatcattgatatttgaagaatgttgatataaaataatctgtgtggaggataatgtaggttgtgaactaaaacggaaaaagccccaagagtgtatatcacactaaagaagagtgtattttctgctaaatggagtatagaatgttgtgcatttagtacataggacatatgcttgcaatcctcccctaaatatcccagtggtttctttgtgcaagttttctttagactcatttctccatcttgatctgtgctgactccacgtgaggtcagtcagagaataatgttagtccaaccacttgtgtgcacacctgcatacacacataccagaaagttaatgttgttttactttaaagcagtgattttactctggaccatgtgtatgtggcagaaggatgatagtgacttgtacataagcatctacagaggaggaataactgatatgtatggtggagtttgacagaatcctggatcaggaaaaataacaatcttaaggttggaggagatttttaaaatcatcttgaccagctatccatttcattacatcattcctcactctgaggctcatttctaactggtgttaccttggaagatgactaatttttagtgcttgttttgaatttagtttgtggaatgatttctcag

SEQ ID NO: 121970 - DNA, 1048 bp, Homo sapiens
cgctatctgagctcactgcaacctctgcctcccaggctcaagcaattctcctgcctcagcctccccagtagctggggttacaggtgcccaccaccacacccagctaatttttgtatttttttgtagagacaggttttcaccatgttagccaggctgttctcaaactcctaacctcaagtgatctgcctgcctgggcctcccaaagtgctgggattacaggcgtgagccatggcacctggccagcatacttaacctttacagaggcatttttagctggacatttacagcatttaaaggatggaattcaattaataaaaaagactttttataacattgaaacagtgagtttaagagagtaaatctgttgccattttagttagttttgacaaagcaaatattataaatggccaaatacataagcctgttattacacattaaaatgtatcctatatttaatgagcattaaaattgaagtttactagtaattccatgggatattattatgaagttataagaataggagagaacttatagtttatttctgtctcattttaggatcttcctattatggcacatgaattttaatcgactttataatggtgtcattgaagcagagtctatgatattatcattctagtatttaactacatctccccttaagaatgattttatcacccattattctttaaacctctcaagatacttcttaggctctgttctctctggagttgtgtaaattctaataatcataacatatattattatcttagaagtcattaagtcttctcttctttatttgtttttagtattcctagtttctcatgggtatagttttacaaacgctttcattctttgtatcagttttcatttcatatttgcctttcccaaaaatgcatcaaactgcttccttttttattttcttgtttcccatggggttggtaaactccttcttaaaaccttacagtagacttatgcaaagtctcatggaatttttaatgctttttatatttttttctgattttattttgttaaactgatctccactatg

SEQ ID NO: 121971 - DNA, 1023 bp, Homo sapiens
gggaggataggatggagagaggaaaacctacatacctagggtttaacactgcatagtgaaatttcagaagatttttttcttctttatacctttttgtatggcttggatattttacaatgagtaggtaatgtttttataaaaataagaggaaaataaactgtttcccctttgtaaaaaaagaaaatcttaaattaaaacaaagatcaacaacaaaacaacaacaaaacaacaaaaagatcaaaaacaacaaaaaagtgccttcagttaaatgatctcttttaatactggagagaaaaagagttaaagtagctggcctataatccattcacttactttctgaggaaacagaaatgggggtgttgctggaatgatgtggagcagggaatttggtgtaatttccttgtgaaaagataatgactaaacctcctcgtaaatgaactaatagtattagaagaaaaagataccttatctatgaaatactcttagcaggatgttcctggtttaaggttgcttataaaacatcaatccagaatctgtggatttatggaaaatgagaaatataaaagctggctgacaatttagggtgtattaggccattcttgccttgctataaacaccagaggctgggtaattcttaagaaaataggtttaattggctcacggttctgtatgttttacaggaagtatggtgccaacatctgctcagcttctggggaggcctcaggaagcttacaatcatggcagaaggcaaagggggaacaagcgcatcacatggcaaaagcaggaacaagggagagagtatggggggcacactttacaacaatcagatctcatgtgaactcagagtgaaagctcggttattaccaagggaatagctcaagccattcaggggcattcgggggcatgatccagacacctcccaccaggacccacctccaacactggggattacatttcaacatgagatttaggcacagacaaatatcctaactctatcatggggtatgaaatgtaaatatttaa

SEQ ID NO: 121972 - DNA, 1168 bp, Homo sapiens
acttatgcttcactgttttgtgagatagatgaaggcaatgaagcattgcagggtcatggatggataaagttactggatctagtgagtacataaagtgggaagcaaaaagttttatctttggagacgtaatttggtgaaggatcctgaagatgccacctataccctgcgcaccaggcagatgcaccaaagtatctcagccaatttcattgagattcagactggcaaggagcttatggtaaagtctttataattgaattaaaaacttaagtaattgtttctgttatttaaactcactggaaaagcttcaaaatgagacaatgatttgaatgaaccagtagtctcttggttacactattagggataatagatatccccatcgatctagaacttataatgtcacaattgctaccaaagttcacaggacagttagtgtaaggaaatccagaactactcacattggggtagaacaattacctcatttttgctagctcaggattaaccattagtggataagttgcttgttcacactggctttctgtgataaagaactcatcctgcacctattattaatgttattaccatggtattcaaccaatagtctcatatcttcatcagaaacttgttacctatgagtttagtactgagacccagcctgggtctccctgctgagaaggagaactgaatgaggggcatagagagtatagtaatggatcatgtggaaaatgatgtgttttctttgagcattcatcaccccatactggcaatgtacaaagagaatgtgactgacttgcaggtgcatagtaaagacagcaaagaaaaaaatgagggggctgatggcgtcattagagcaaggagctcttagagtcttctcattcccatgggagaacttggcacaaaacctctacttggaagtaacttttctttggctcccagcacacacacactgatctacattgaaaaaaatacaaacataaaagtagctcttatatagaaaagtgggtggatctttaatcagtttgatttgtcctctattcttggcttatttgtaagtagcttctattcaaaccattctttatctttatctttcaccttaatacacacacatgcatgcatgtgcacacacacgcaaacacacatacacacaccattcaattttctccccacctca

SEQ ID NO: 121973 - DNA, 1054 bp, Homo sapiens
accactgcattgtttagagttacacaaccctgatttttgagtggttattgtgtttatcccaataactaccttatagtaaggaaatagttaagaaagttaattgattgggctctgttttagtttcttttttctttctatttagaattttgcttattctcatctgtttctttaaagtgatttagtatggttcacattaaaatgcacatttaatacatttgtatatcaatataatattgatataggatagaaatttaaataaaaatctagaactaaggggaatgataatcagaattattttattataagcattatgattctaacaagtatactgattgctctacacattgtcctctgtgacagatgtggcttatttaaccacaagtatgatattatcatttggtactgacagggctattgtcatccgaagccatttattcctgtcaccactcataaattactgtaaaaaagaggccactgttctcctaatttaacatgttcttccacattccaaccatgatggtgattttgtaatccatttgtcttcttaaagcaataggaccataggccaacttcctcaaatggaaagcaagcccccaataattagtaagctgatagagtacataaaaatctttgtataactcatacaaatatatgtactttatttccagaactacttgggaaaggcattacttgcggaatagacatagtaaagattttcctcgttctcctccctgaatattcagagaaactgtgtgtggtatacctcttccagaatcttgcctaattcctggatcttgcacactcaattttttcagttgtaggagaggctgaatttttaaaaatgaacatcatggaccctaaaatatggtttacctaaaagctttatattcttcattactttcttaattcattcatgtgttcagccaaaacttattgaatagctgccatgtgcagagtattgtatattgttaaggttaaaaaatatagatcaataaggcatgacctctccattgaggaattcctagcttaaaggatattgatatatatgtataca

SEQ ID NO: 121974 - DNA, 1219 bp, Homo sapiens
ggatggtattactgataaacatgcaacgcaagtaaaggcctaaaggccagtgagtgtgtagtattcaataggatataggataagcaggtctaaatatcaagagtgaggtcaggttgagaaatggattgaacattatcagtatcttgctattaattaaaatctttgcacagcatgagaagcagagctagaagaatagaggcttgaaagggcgatggggaacagaaacattaaaggcgcgagatgctaatgaggggcccaagatggtgctttaacaaattgtttccctccttataaattgttctatatccagtgctgcctctcattagctgtgtaaccttgtacaaccctcatcctgacacaacatctgtcatctgtggaatgaagaaagactcattcattcattcccaacttgaatccccacaggtagtaatggagttttcaaactaaactaaaattccatttagattttcagtattacaaaataacagtataactacggcttgtttactgatttaaaatcttttaaaatttagggcctgcaattaaaataataaaaaatatctactagtgagaaggttgcaaaccattagcccagatgattccagttctaaaaacctgttattttattatctcaccgaatattagcagtagttggtttttaacataaaatttgtactgcaccaaacaatatccacagtgtccccatccctgagaatgcagcctgcctggcagctgcacgtggcctattagcacagccgtttacataaaatttgatgatgtctgttttctttggtttgttaaaaaataaaacacagcatttacaagcagagctagaagaatagggtcttgcaatgactttcttcccagtcatttcttgggaagaaagcaaatggtataatgaaagtaatattgagtttggacatgaatttcctgaagaagccaagtttattaatatatagttaggagtcagatttttgtttaataataaggctcttggaagaaactaaaattagtcttctggcatgtcccttttcttctttgttaaagggataggatcataactgctctcacttcatacttcatggacatttcctaaagaatattttggagtctcattgttcttttgaacattaggttcaaaaataaggtcatttaaaagcaatatggtcacctatataactatagtttttagaagaaaaattacctttatctctaaaac

SEQ ID NO: 121975 - DNA, 1044 bp, Homo sapiens
agttgactggtagtttttcagagtgtgaagttaattttctcacacacacgtttgtgactgactgtgcgaatactcagttattagcaaattagcaacacagtaaatgtgtctcatagaaattagactaaggggactagctgtatatgagccataaaacctataaatcttgtggacaagatcttgacatacaaattagaaatagaaattattttgaagccttggatactgatagttgcattacttagcacactatggtcttcagtcccaacttctcattactgattcccatttgtatgtcttcactctccacagacatttactctaatgtttgatatacatccctgtttatatatataacccttgcaaaatatactatgtttcgtgtgtgtctattatttaattattttatataaaggatattatgatgcaccaagtgtcataaagtattgttttgttcagtttcttgttttactgaataatttctatccacattgctaaatgtatgtatttcccagtttgactatttgaaaggacttatcaggctccacagaacatattcgcataaggcttttatttaaatttttttaaaaatacagtacagcaaaagaaaaagtgtataagcaaacattagagattccaaagatatgccatgtacagggcactatttctggcatagctcaaaggatgtcttagtccatttgggctgctacaacaaaatagcatactgtgtagcttataaacaataagaatgtatttcttatggttcaggaggctaagaatttctagatcaagatgccagcagagttgatgtctataatctataagggccctcttccctcatagatggcagcttctaactgcgtccttgcatggtgaaagagactagctagctctttgtggtctcttttataagggcactaatgatattcccaagcgtagagcactcacaatctaatcacctttccaagaccgcaccttctaataccattatcttgaagtttaggatttcaacatttttggaggacacaaacattcaaactatgg

SEQ ID NO: 121976 - DNA, 1094 bp, Homo sapiens
ctaaactaattttaagaatggaagagggtattattaataattatgccatgacaacatcatgaaccagagcctgggtaaaccaaggcatagagtactctgaatcacaggctgcacatattcacgttaacactaaccagacttttctccagaccgcataaatgtacctgtctacacactttattgccaacactttgtgttttcagatttccaattttgaaatttgacatgtgcagtgttccttccgtttgcatttatatccacatatttgctagctatgcagtctacctttcttttaatttctgattcaaagctttggtttatttttcctgcttatcaatttgttgtcagctttacacctagcagttattttccttcagtttgtcccctattcattaactttgtcttttaccagaaattcttaattttgatatagtgaatcaactcatttctcatctttaaattatactatatgtaatgcttaagaaatacttccccatcttaaagtcacaaagatattctcctgtattttccttcttaaagtcacaaagatattctcctatattttcttccattagctgtatgattttccctttcataatcaggaatatactggactttaattttgtaatcaatatgaaataggaacccaagtttatttttttcttcatatcaaaaatctggctttgaccacagagttcttgcctttgtgtgtaatccttaatcttaactaagaactcattatctaccatgcacctttgcattttctcagttagttaatattttccactgcttggcctctcttttttgtcctcacactaaaggaagatactgtctgaactaaggtattaaaaggcacaggatgatatcaggaccctgctgtcacagagaataggtttcctgcaattcaggagtgtgcagcctgccaattttcggttagcacctgtgcctcctatatagtcagtggaacacatgccatctcaacacatggggatcagcaaggagacaaacgttacgcatatgggtgaagaccagttcttagcttttgttcttcctgttgtacttgtttttaaaaatctagacctggtttttagata

SEQ ID NO: 121977 - DNA, 1055 bp, Homo sapiens
aaagtgtagcacaattttgatagcactccatgtcctttctcacctcatgcttctgctcaggctcttcttttggcctggaacacctacgtcctcttcgtgatatgtggtaaattcttatttacacactagtttaaatgtcacatcatctgtgaagccatctattaacccttcaatcacatgcccatatatacagaataagcactaatgagctataatttcataaaataatgtgaatgatccctcacctttaaagagcatctcctatgtttaaacccagctctaaacattgcaaatctcatttcttaatacttacaataattacttattattatctaatttccctccagttcacatatcagttctcagattctctttccaggaaactcctctatggagatgattacattgcctgattgactcctttcctcaactttcgcttgaatacattcaactaggcttgccccaccattcaccatagcttttcctgtctaacataccaacagctgctacattaatgaattcagacaaagtatcagtcctcatttatttaaattatcagcagcatttgacaaagttagtccctttttagaagttcaaacccattcttcacttttctttcaggatgctgtcatttctggtttgctttgtacatcactggcaattttttttatggtttactttgccggttcttctcatctttacaatttctatatgttgtcctgccccagcctttggccagtaattccattggtgatttcatcaaatttcatgttgggcattatggctaagaggacagacctttgcaccaggctgtctggctttgaattacagctcaactagtttgttagatgtgtaaccatgggctagcgatctatctctacctttctatgtctacctctcttttacctcatcggtaaaaatagggattatagcagtacctcagtcatagaactgttgtcatattacatgatgtgatgtttgtaaagagcataatgtccagcaatatatgtttttgctgatattacctataatctaatgactcataaaacctatct

SEQ ID NO: 121978 - DNA, 1270 bp, Homo sapiens
aagttagttaaattgctaaagaaaacttatttcctattttattgtcaagaaattatataattacacattttgtgggatcacaaatgtctgcttattaaacattttagttcataaggctgcttttctttttttcttttttcttttttttttttttttgagacagagtttggctctgtcgcccaggctggagtgcagtggcacaatctcagctcactgcaagctccgcctcccgggttcacaccattctcctgcctcagtctcctgagtagctggaactaaaggcgcctgccaccacgaccggctaatttttctatttttagtagagacagggtttcaccaagttagccaggatggtctcgatcctctgaccttgtgatcagcccacctcggcctcccaaagtgctgggattacaggcgtgagccactgtgcctgaccaaggctgcttttctctaaatccatgcttacatagattagtgattatctttaatttttatttttgtttttttgtttcatttttttgcattttctctctctttaatataaattgtgttcttacttgcttatattccattctagaatggcttctagtctcctcccagaagtctgaccctgccagttctaaatttttttctgactctcatcctcctgaattttgctctcctccatagtcaacaattttgtacgcctccttttctttttttaaatgacattcagtttctgaaatattggcttctctcattatacttccacccccattcttccaccatgcaaaaaataactcttcctctctcttcttttggctaaactttccaaaaagatgtataattttttatttttgaaaaatgtgttagtgacattcgtcctggttaacttattccaaataatgtctctatcttgcattctgtcttactgttctacaacctattccagcaccatcaacagatgactcatttcagcctgacctcatgaaaagagcttgcattctaggttcagacagaataacaagagactcctatttttaccatttgctggctgatgtaatcttacatgagtaatttaagctataggggtctcacctcctttatctgtaaaataggaattctagtacatgggatggtaatgatgatgtaaagaaatcatgtatagaaaacatataaatagcatactctttctacccaggaggagctacataattgttaaatcttgtgtttatttcttattatctcttactatgttgactgttcttccaaattgcataaccaaaagatc

SEQ ID NO: 121979 - DNA, 1048 bp, Homo sapiens
gcaatagaaaaagtgatcattattcttctgactcattctaaaactcttacaatgtacgaggaaactcttggagctttgcttttctctttactgtggcagtgcaaacttattgcttgctactctgcagctatttctgaactcaagttattttagaaattcttcaaaatttaacattttctcctgatcctttttgaggaatcagtacaccatagtggtcgtccctgcttataagacggggttaataatattaccacctacactgttggtttgagaatgacacaagatggtgtgtatttgttatgtgcaggacccactacctggcttgtatggaggagccctttctaaataagtactgctagcattattttttcttctatgagttcctatttctcttttactctaaattatcatcacaataggctatacattatttattttccaaaataaatgttatggtaactacctgcatgaagaaaagtgaaaaaaaatagaacatattatgaatgactatttctgaaaattcaactatctagcattgtacaaataacaccttgacgagtagcttgatttttctcattttcaacttattttttctttccttctctttccatatttatattgtaagtggttgccagcactgaccaatgcagttatccagactacaaatgtagtgttgtcatactcctccaaacacacacatacacacgaacacacacacctttgtttcaaatcgtcaaccttaatcataattgtttaagcaaaaggaggaatgcaggctacaaatccctatctctgagaagaaagttttatagacagcttattcgcattctactgcttctagaccttcagaggaaatatgtgcttgttccataacctcagaatgctttagggaatcccagcttccacgttcattcagtgattcttctgggagtcattctcataagtaccccaaagaaattgagattgagaaaagatttcctataactttgcagacattatggaaaccaaaagaagtatcctttttttcttcacctggtatacaacaaat

SEQ ID NO: 121980 - DNA, 1313 bp, Homo sapiens
ctcccttttctcctttccttcttcttatttttaatataccctttccccatatctcaacccccaattattagaaataccacatcctcaatacatgtgtgttaggcacagggtcatttggaactgtttactaccagtatttgtccaaaaagattattttaaaatataaaaatataaaatcgttgggtggattgaaattttagataagatggctgagtcactgtttgtttgcacagaggtaagtgggaatgtactatcttgaaagaagctaggagggagtcatataacagaggatagagaaatgcccatttaaataatttaagcagattgcccttgcttattccacaccacccaactgcttttaatttttaccacttggaaataggtaatgctggttgtgtacttagaaagccccaattcagcaagtgaagagataagtcttcccagataaaatagtgaactgtaccccttaatccctgtgctcttcctctccaaactggctctcctgtttaccctgctcttgttcagaactctctcttggatatgttttctcgacatggaggcttcagctgcacacactcatatacgtagagtaatgcaaacttgtttgttatatcatctgtgactcctgcttttgggggaagttagtttctaaatcctttttcttccttagtgatttttttttccaattagttgaacgaatgatggtatttgtttgcagcttccagtgttgcccataaagaagagtagttattcatttagggaaattgcttgatcagtgctatgcagggccattatatcttctttgtgctggtaggagaaaagagtgatattctagattgaaacaactggaaaaacagattgctgaattaggagtgaagatataattagatgcaccctacaataattggatagaattgaaagcatttaagtctgtacataatcaaatattgcctggaaatgctacagcatcttcattttatgctaaacagatttttatggaagggctataaaggaggaaatctgcttgctaatttgattaaaaacaccatggatctccgtgatttcagctattaagattccaaatgggaggaggctaattataaaagaaaataagaaattgatttcatctttaagatctattatcaaacattgcatagtttaagtggaattattcataacaaagatgcacttcaataattgctctaagaatagatatattcttagttccattttaaactgaaaggaatctaaagaaaaaacaacactgtataatcagtatttatgggagaggtattttattaaccacataagcc

SEQ ID NO: 121981 - DNA, 1220 bp, Homo sapiens
catcagttgatgacatccagccatgacggattcaggcttgcataaataatctgcaggagttctttgaatatatcacagccacactagataaaagatgatctgggactacgatatagttaatatttcagaaaaaaaagtgcatttgatatgtttctgcatcagagataaaggtaaaagaaccaccgaacatgggataaagagtaccgaagcgaaaattagttttagaaacactacaaagcaaagactttaaaagcaacttttatgttggaaagaaaaaaaaaatattgaaactgggcagcccatgtgcaattaattgaagtccagtccttccttaaaaacgctttctaacacaccaaatatctcacaaagctgatggtgactaaaagtctttccaacagtttagtgcaatagacttatcactaagcttggaatgtaaaaatctaagttctagctgattaaatgatcttgagtaattagcactcagggtctcagattccaacctacagaataggaaattgggtctagaaagattgccaaagtccctcctatctccacaactatttgattctaacagctccacgtagctctggggaatttaatcatcaagcaagtttctccattaaggtggataattaaaatgagggagtactctgtaatgcatcaaaacagattcagattgctggctttttcaaatttacagtttcgctttcagtaaaaattacatggtataatcagtcgagctgtggaaatgggctctgaaggctattgattcctgagttcttgatactttcattgaccctatcaaaacacttaaatgttccaaagcctggagtggccctggagaagcccaagttgtaacaattttgtactgcctgaggtttatattactccagagagtatgtattttgtaatagggttgaaaagacagtaaaatttttaaaaagtggccactcctatagtagtgtagatacatgaacatttaaccaaatgtattgcctttattctgagtctgtacatgcgcagaaatcccagcaaaatgttctctaactagtcttatgtgaccctggcttaaaatgtgggctgttagacttttaactacttgaggccaggcacagtggttcacatttgcaatcccagcactttgggaggcagaggtgggcagatcacctgaggtcaggagttcgagaccagcttggccaatatggtgaaaccttgtctct

SEQ ID NO: 121982 - DNA, 1221 bp, Homo sapiens
catttcaattccactcttttagttattttgaaatatacaataagttattgttaactatagtcaccctattgtgccaccaaacactagattttactctatctaattgtattttcatactcattaaccctcccctctttaccccccttctccattacccttcccagcctgtggtaaccatcattctattctctataatttgtaataattatacttctagagcaaaagataaactctgcctacctgggtcttgattctcttaggacggataagtcatgtccaagaatagaatacaaaaagagaaaatggtgtcagtagtatggtgttatactggtgtgctatactaaatggtgtctgtttcaggtaaaatgacattagaattcagaatgaaggagtgattccagctggagcaattaggaatcagggaagtcattgtaaacaaagtggcatttttgatagacctggactttaaaatatggaaattagtgcagagcgtgatgaatccagcattccgaggaaaaaggaaaaggagaaggaggtgtgaggcaccaactgaaaagaggacttgatcttcctgagcctctagtgtgtgaaagagaacaatgggctgtgaggggctagatggtgcaaagctttggaggcctgatgtgcactttaatcatcaggcttggaccaggtacagagggttttaagaaggagaatgacagaaccagagctgtgcttttggagatttattctggcagcagtgtgtaggatggattgaaggaggtgatgccagctcaggctcaacaatttcttaaagtggagaaaaggcacagttgcagtagagactaatccacgtgccactaaaaattgccctgtgttccatctgcagcaccaatgtgaagactgttcacctctttccagaataccgtggatctgtgaacagttaaaacctattacatgagctgtgtggagctgacctgataggaataattataatgaaaggtttatatcattccctaggactgggggtaagggcaatataacactctaacactcctactttgttcctgttttagcttttgaagttttataatagcaagttacttgatttgtcttgagatttgagctgtatcactgatataagctttctaattatctttatcaacgtggctacggcaaggaaaagtgtgattccacaatttagatttgcagataccaaatagaatgctaattgatact

SEQ ID NO: 121983 - DNA, 1039 bp, Homo sapiens
gaaattgttttcctgttatcaggccaaatgcagacatactttaagggaccagccttctttaaagattttatcaggtagagacatcagttctgccttcctccttgcttcagggcactgcaaatggcttcagagtacatctatatgctagttcactggaaggaatcgttgttccaaagttttgcagaacaaaactcccctaaattctcaagagaccagttccacaaagctgtgagctgagttttgttatattcagattcactatccatatctctcatgagctctgagtttcagctacgatattttgaacctaaggaatactttaccctttctttttctccaggaagcaacgatccagtataaaaggagttatataatcaagacataactgtgagctttgaaactattttaatcaccagagcctgcttcttaccataaaacgatttctcaagctccataatttgggatagaaaacaatagcaatcttgaagaaataccaggaaggacattagagagatgaagtagagaagcattcaaaatgggatcagaggatgcatctattcacaggtccacctgatgccagggcttgtagaaaaaaatttagagatatatttagagccattgaaactgttcccatttttacatagggagagatcagcattatattttgagaaaccatagggaaggagcctgtcttttaaagtctggtgctacccaggattctgtctttgatcataggcttatctaatgggtcatatcttactctgtcatagtttttacctattacacgctgtatatgctggtaacatccaagtctaaaaatccagcccagacataatccctgaggttcagatttgaagatctgtgtaatgacctagatttatatgtggatatcgctcccacaggcatctggcacccaccctgtcttctagagtacccctcatagcactccttgtattgagttctaagtgcttatgtcactgcctatctcttccactggaccaaaagtactgggaaggtcagggtgaggtctgttttgttc

SEQ ID NO: 121984 - DNA, 1088 bp, Homo sapiens
ttatctaattatcttttctaataatgcttgttctattagtgattctttaagactggataatataattgatatttacaagtaaaattatagagttagagaaaaaataaggagctagagaaatcacatttttacaaatgtattcctttcatttgcatcatatctttaagcaaaaatgagcctgtctctaaagaacagacaggagtagatttgaagacaagtgatttttgaatcaacagagaaaaaaatgcaaggcagtgttgctctatattaatatgatattgattcaaattataattgcaggactgagtagttcctactgaggaatggttttattcctgttttataaaacatgtcaaataagattttgaaatcattaactgaattagttttatagtcttcattggcatttctgagggttagatgtttaaattttcctacattgcttttgcttgattcagagaaccattaaaaccatggttgccttcaaatgtcattatttgtctagaataaattctaaactggaactttctttataactaaaataaacactcccaaatccaggagtattgttcactctaactcagtgtacattcctcaactcattttattaggcattctcttccaaaggaaaaacacaaaactaaactcaccaaaataataaaaagattatgaaaagacagagaatctttacagtttaccgcatttaatacttatttaacatattctgaggagctcaaggtcctcctttgtgatgttttcagtgactttggtaacagactctgaggtgtcatgggcagaattgtcacactcgtttcataattacaagagaaaacgaaagtgaaggtactgatcatattacatagactcaaagaatataagaagaaatcctagaaaaacacacatcttagttagcctttttagccagtcatagtttcatgtctttctctggggctaggtacagttaactcaattcctttggggataggcttttaggcaaaagcattgcactttatttctttctctttcatctaacaaagaaccaacacaaatttaataggaatggaggggaaaaagaacatttcaaacta

SEQ ID NO: 121985 - DNA, 1036 bp, Homo sapiens
ggttgctaagtatatgtagtttataatgtgcacagtaggtcaaatcgatattgtgatccttagagttaaatgttttattggataaatgcagaaacccaagtttgactctaacagaagtttaaaataagttataaataagatttaatgttaacagcagggattttttctaaccataaactgaaaaatatacccatattaataagttaggattatgtacaacaatatatcaaaatcaaactgtccttttttttcttccaaaagaatagccaatgaactagttagagctagttaaatcagaataaaatccctttcacacacacacacacacacacacacacaattgaatagtaataaaataagaaaataatgttactgtcacttagaatcattgccttctaggttgaaaacaatggttttcctatgatatcttcataagttaatacaaatcaataaagtatataataatgacaaaagaaccactgtcctggtattagaaagaaatatctttttctaactctccattcatacaacatattttaaaccctggagaatgggacatttggggattgtgctctgagtcaagtagaaattcaaagaaaattccagtgataaaacaaactgtcccactttctctaagttactcataacagtgatttagtacataaatgaagtaactgtctacacttttgaggacaacatgtagttcactcattctgcttttttccccctttctttccctacattctcactgtttcagctgtagtacttttgaaagcagggtctgagacaaagacttgattgccaatcatttggaggagcatacaatcctaagaaacagaagtgcagaacagggcaagtgaaaatgaaaaggggcaataactgattccagaatgcattttcaagttggcaaccaaacaggtgactgagactcaagcccatggcacattctgaggaggcttcagagctgttttcctggaggatgaaagatgaaagcatttatctgtcagttccaacccgcatttggatgagagtgact

SEQ ID NO: 121986 - DNA, 1072 bp, Homo sapiens
ccttgttaaaagaaattaatctaaattcaactcatcgttaaatagttcttaattacagaataaaaggtagagaccagggaaatcaagacaacaaaacttgagataccaatagcaaatggattattcacgtttgtattatttgttcaaagtagattacagaaggaaagagagagcacaatccagtggttaagctggttacttgtatctgtggcctgcaatttcctcatctgtgaagggatgagaaaaggtgtcctttttaggggttctagaaggattaaaggaaatgatgtgtgtaaaatgcttggcacaaggcctggctaagggtgagcatttattaaatggtggctatttcatttataacctgattatattgaactgacatcatttatttaatggtttttgccattgcatttcagttcaaaaaggatttaaggaaacttttaatcagagtatttctaaaaacattaaacattggtctcacaggaagaaaacactgcaacagtcagtcaaatcattcatattaaaagttaatgtttttccaatgaaaagagaccctttcagtaaggtttttcagtctgtaagttctggagtctagatggaattgagagattgtccaattaaatttatacttaggatcaaatgcaactaaacttccataaacgtactcttgaatcacatcacgatctatttctaatatttattattgctgaatttttgtatttttgcatctgtgttcataagcacaaatgactttttttttttaaacaaagtcatatcttgcttgggtaacaagattataattgacctcatgagctaagcttctttcttaatttttgtattttccaaaataatttttaaaaaaggtggatggtattcctaatttattgaattgttgatatcataggaaaaccatttagacctagtatttgcctttagttgttgttgtttatgaattccatttctttaactgttaactgctgaatcagaatttttctttcacaaatattggtatttctgtatttgtacaaaaatacaactatttagtcatatttcaaatttttcaacataaaat

SEQ ID NO: 121987 - DNA, 1210 bp, Homo sapiens
ttttaaaaacagtttagttttctaacgaattccatctgaaccacaaagttatggtacagtctcaatatgcgagtaaataagtgattatatcaactgggagatgttcacaaatctgatgtggttacaaaatactaaaaattttagtcatggctttagcgatgacagtctaggttgtgccacttttctacaagcaaataaaagtagaacagttaaggatagcattgaaaaaaacgttacttggtttgaagatatgctggtacttttagaagagtttttgggaaacttccttttgaaagctgtttcttggctttgaggaaagttctgtttctctcaatggtttgataacactgaaaaggaaaatgcagttgattactacttgtttatctcatatttatgattttaaatatatctccaatatatttatgattttctcttcattcccaccgctacctccccttctgtctttctctatttcgtaggaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagttgggatctgacaaatttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctacttgtaaattttat

SEQ ID NO: 121988 - DNA, 2118 bp, Homo sapiens
tggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgttttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactccgaagatgaatgaagtgtataactgtctctatttgatctattttttttacctgtttatcacatttgtgaaggtgaaattattcatggagtgaataagaaagatatgaagcagaactgttctattcgggaagctattagacttctcatttattttcattaagctgatttgcagctacttattctcatggtcttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggtcttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacacagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggctagaggagagctggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagcaccagaaagatttgagcagaggaatattcctgtaatgaatagaggattgtttgattctcaggtatatttcttaagccaagattgaatgcagtgtcaggcactgccttaacacccacagagataagatgaacaaggtactatcactgcctaaaatgagcttacaattaagtggatagacatataaaagcttcctttcaattcagcctgagactgtttatatgcatgtgctactccgaatgacgtttgtatgggtcaatgctgatttaatggggaaaaaaagtagaaaatttccccaattgcttagctgtttgacatgtttctgagctgcaaactttgtcaactct

SEQ ID NO: 121989 - DNA, 7277 bp, Homo sapiens
agaaataatatttttatgtggatgtcctcctcaataagtaaagatctccatccatatttaattaattggtaagacagtcaaattcatacatttacatttactttgtcaaattttttggtctataaaaagcatagagatctaaagaggatacactgctaacaagtttagaaagcacctgcttttttttattattattatttttgtgatagagtcttgctctgtcgcccaggccggagtgcagtggtgcagtctcggctcactgcaacctcggcctcccaggttcaagtgattctcctgtatcagcctcccgagtagctaggattacaggcgtgtaccactatgcctggctagtttttgtatttttagtagagatgggtttcactgtgttggccaggctggtcttgaactcctgacctcaaatgatccacttgcctcagcctcccaaagtgctgggattacaggtatgagccactgtgtctggcccacctgttttttttgaaggcagaaaaacattcaatattaaaagcattcaatattatttcaacctgccttggctctagtgaatgttcatgatttgaaagaactgaaagacctaaaggcagtgtctctattgttgactacaaatgtaggctctttgttggactatgactataatcacacactgataatatgacgcaagtagaggcagtactactaagtatctagcaggtgctttgaaaccccattactaagtcccagaagactgtttcctaaatttgaagtggaagaattaaatgactcaatggaaccctttagctgtgggtccattgatgtgtgagttttagagctggaaggaattataattttgttgtttataattgctataatatagaaattataattgcttttctttctacttatgagttaactagatccagagatatttattcaagacacacattcacacacacatacacacacacacacacacaccccacagctagtgacaatagttaagatttggatttaaggatcctatctttctttatcccactttcttttcaatcgcattcataacttattatagaattatgtctcaatttttacaaatgtgaatgtcttattggtatttttagggcctatagaatggtacacctcatgtagaagaacttcgacttttgaaggtatacaataaataaaacatcaaacttgttagcattcgttctggtttaaatattttaggagttgagttcagcagaaggaaatgggctatcactacatttaagtgaaatacaaccctcaagaaagtgtatggttcacagccactcctttaataaatcctgtgggttgcaattctttgtaagaaactcatgaaaaagatatattgattcaacaaaattggtttgctgttgattatacaaaccaataattatgcctagaattaaattgtggacacaaaaaagggaacagaccatttaaaatgttttatttcaaaatatcgaaaagctattaccttcaatactctaaatatttaaatattaattattgtagacatcagtaagaataaataaatgttaatcattatagaccttactaataagaatatatactgaattgtccacatccagagtattacaccctgaacaagaaagacatgagagcctgacagtcatatatattatgacagctgtatatctgacaatatgaagtagaaactgaaaaaaaaaatcatcttagtgggaaacaaatacatgcttaaaattgttatatttactgtaaaactcctgataatcttagattgtgcagaaatgtttcttattttgaggggcttagaaagctcagcgcatttgatgtataaagcaacagaatatttaggaattatttgcggaggctttaaattcttacctccaattggaggttaaatattaaaagaataggaaactatgcctctgatattttttttgtcagcctatttttaaactagattccatgagtcttaaggtaatatcctagaattttttttttgcgtgaattaaagttaccacaaatttcaggtccttaccttatgactgtgtttgatcatatctttgagttcccttgaactctgatctcattttgagaaacattttgagaaacttcttaacaattacaatcgagctgttaaatataacaaacatcagaatctaaaggataagcacagtgcctaatgtacaggagggtcatatcaaatacttgttgaataaatacatgaatgtgataagtggtcctgtaaaatattttttaagagtagtgacaatgtttattggtaccaattggagatgatattttatatttattttgttagtttgtcacctggatgcaaaaggaaggcattttaattcctttctatcttacaacattgtaaagcatcaaaagaagtaacatctcaagaaagattagaaaggatttggatcacgttaacattctatgcaaatattagtaacatatcaactgtttctaaaaggaaagaaaattagtatttaaggagagtataaagtgcgagcactgtgaagggcagatatctattaccaaaccacatggagagaaatatagtctctctcctaacttcattccattgtattgcaatcagtcaattaaggtgattttttttttctggatgtctcaatctagagattttgtagcattttgcaaatgggtatgcttcactactatccacagtgttctcccctttagtaattcatattgaatatatccatattcatatgcattttataaaacagttaacagaatctaaataagatatagccggctaaatctggaatgtgagtgctaccctaggttattagttcaacaaactaattttgagagagccacttaacctctctggaccttgtttgtaagctttcttctagcactattactcttatctaagatcgaaattgatatatgcatgaaattcctaatggaatttcaatgtccatctcaaagtaattttttaggatattccatacagatttccttctcatttctctgtgtagatatttaaagtatgaaattgattatttaaactaatatgtggaaagaacctaatccagagcttggaatatagaaagtgctcaattaactgacattcctcctgtatttcctccctccccttagttgtctatgacttttgaactcactgctcactgacatcttaattgcctgcagaaaaatcaatcatattttaggcattattttgaaatattttagagttttctgtactattcaaactcttattacaaaaatctaaagatatttattgatgcaaaaaatttagggagtcattggaaatacctgaggcaatcccaggctaacaataaaatagcataattttaagtaagctagattgagttcatttgaacatttagttattttttagctcatagttaacatatgtccatgcatttgatttactttaaaaatattttatttaaaaataacctctcaaacaccagttgctttctgtcagttttactcaaagcatgcttcctaggtcacctgacctagaatcaccagaagtgttaacaataccgatttctgggctttgagccatgaaattagaatttcttcaaataatccatgcccccccgtcacccaaaaaaagagcatgcttttaatacatttccaaaattatcctgtttctgctataactggtgaaccatcctgtcctaaactagcagttctcaaacatgcatatgcctttgaaacttcctagatcatctacataaaaatcatttgaaatattgttaataatacacagcttctgaatctctgggtgtgagatgggaccaggaatcttattttaaaaatctccccagatggttctggtgtcctgctagttttgaggttttcatcccacctgtttagatgggtagtattctattaaatatgaggtattacctttctttagttcacctggaatcttcttaaatatatcggtaaagtattctacttcaaaatccaagacattttgtatacctaattatttcacacaagagcgtggaactcaccagtcttgtgacttggggcaggttatttatagtctccagacactttttccagttgcgagttgcttatagtagttcgcgaacctgaatgcacattagaaccatctggagaggctttaaaattgcagatgtccaaaccccacctccagagagctgatctatttagtttgaggaagagcccagaagtctaacaggtgtaaatgttccacaggtaatactaatgcaggcatacctcaggaaatcaccagttctcgtcttggaggaactattaggaaaataaaagattatatatcttgaaaaaaatctctaatttgctttctaggttctaactgcatgtttatattttgcaacaggaaagactggtctagacaattactaggatatatgcttctgtgatctgcttttctattgtatgtgtttaagagaccacattcttgggttccaaagtctccttgtctgataggtaatttgcaattgagatatggcaaagaattgtagcatccaaatttttgacaactacagatttagaattgaatccaaggtctgccattcactagctatgtgcaagttactcaacttctcttatcctcagattttgcagctgtaaagcagaggtagcatatttctgagaaattatattcaggtgactagatatgtgttcaagtgttatcttttattcttataaaagataattgtgaggaatccagtgctattttcacaattttaattctaaaactctgaagacattaaacaggcagtttgtaggaatcattgaaattttatacaagccgaaggaacaacattcagcaaaacggaaacaaataaatacagcatggaagcatatattcatgtttcccataattactaagttacggaaggggtgtgaggagctggcagtggtggtgaataggcattgtttgcattactaaatatatataccatttcttaagataattggaactcaagcagtcctaattttctctccctgttatgagcaatcagtaaatttgtagtcaatttaacttattatcagttggtatagcgcatgtcacagaataggatagcaagaagattctcagagatcattttctggtaaagaaaaaggcctagcaatatttaacagtttgacttaatccatcacttcagctggtccactagttttgacacaggactagttaatgatttgttaggaagtctccatctactcttaaactaatttaaaaaaaagctaaaagttgcttttaatatgttagggtataacttcaataaacaggagtatttatctagtggttcagaaataaaataattgttagccagcctgtgattaaggctaccataattgcataataaatagctttgacgtgaataatctcagttgttcaagtgtacaaatttaaagctgtactatgttagaataaaaaagtaggctcaaggaaaatttctatttttctatatgaaaaagagaatgatattcaaaatagtatttttaagtagtttctaattgtgttcctttaaagagtattagaaatgtctgttatgtcagtaacattagaaaacttcaaaaactgatttatttttctgagttctctggaaaccaaacaattttgaattagttgtgtaagtaaagtaagttaagttatagcttgctggaattttattgtggaaaacaaatatagattttatctgaaaaattttaagggccaattctacagaaagttatgctaacatgctaactttccacacatggctgcattccattttgattaatgagggttcaggaaatagaaaggcagtctctgcagaagcagtatccaaaggctaaattaacaacccaggactaccactcattatgtgagaaatatgggccagagttacaatatcacatctccagtctcagattggcctcattagccaccttcagttccttaaatgagataatcctgaagatgccatccttgtccaaggtgagattgccagaggatatgagctcatctaggatggaatacatgtctccagggactgtaatgagatcaggcttttcatttactggttttctgcctcaagagtccttaagcaaatgaagattatctgattgtctatgtaaacctggaagtagtctactttttagataaaagataatctatcttgaatatttcatatgtgattttaaaataattaatcaaaaaacaaagactatcatatttgagaacaagattttacttagaagggaaaaaaaagaactttcagcttaatcggggttaagggagtaattgtgacaatataaaatggcattgttatagaatccctaaaaggtaaataatgtatgagatgaaggtaggaagtaatgtgtgcttgcagaaatgcaactggtcaaaattacttgaatgaaattgttgaggttaaacatcttcattataataatatgtcttattctgattccaagacaatacgaatgtagagaagagatttttaaatggaaaaagtaaggagctaacaagtctgtacctagattcaagttcacaaagcggcaaaaaggagaaaagtgtcaacaagaaacaagaagaggagtagtaaactaaggatcaaagcccaagttccagttttcacaatctgctgtataattcactaacatttctgagccatagatttttaatctgtaaaaggagtgtgatggactgtacattagaagtacctgagaagctcttaataaatcttgatgaattggttagaaattctaatttaattagcctggcacagtgcacaaactgccatatattcgtgcagatgttttcttcttttcttactgcgcatttccatgtggccatgtcactacaaggggtggggaagaagttaatgtgtaattgcttcaggagctctgaataaaaggttgctgaagcaaaatactgcaatgaagttctgaaaatgaagagttaggactttacatgatttctcttgcctcattccctcaagaatgcacatatagacacacatatgccaatatcttttttatgtagttcaagtataactttgaataaaatgacttacattcaaggaaggtcaaaactattattctgaaacaaaatgtgacaattctagccattatgtgaattgtaagggtcagtaatccataaattatttggatggtaattgtatgttttattaatgtgatgtaattttgcactattgtattgtcatatttaatcaaactcttaaaaataccctgaaacataatgccaaatgtacagttta

SEQ ID NO: 121990 - DNA, 1356 bp, Homo sapiens
aaattgcatgcaattggtgaatcatgcagctttggggacatttacactgccactcacacacaggctctgtctcaatccgtatgcatgattcacgtcctttcaaaagtcccttttcaacatttggtaaagtgaaaatgttattcatagtgctaatgagccaataaacaatgctgcgtttcttttttctaactgcagcatattgtggtaaattttctcccaaaactttatttttggagttattgttggcaataaatacaacaaattatttgttggcaagtgatacaatttactgtataacaacttaatagtacaaagcatgaagatgtgaaaatatcatcttaaccagtttcattctatgaacataatattctggcagctttttctataactgagaatggtatatctttttatacactgcctaaatcagtactactgccagtcacctgaggtcaggtctgcacaacactaaattgggcaataacatagaacatctaggcagtcttgacagtcaaccagtgtaatcactaggggaagaaaaagtaggcctacccttttacttattaacttaagtaataaaaattgtataaaaatatgaatgttggctgcagaggagcctttacatgcagataatttgaagcagtctttgaaaataacaaaaattattccatttaatgaagggtttgttttgtttagcttttctcttttattcagaaaacatacctgtgcttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatagtgtatgtgtgtgacattcagctaacattgatctaggcacttagtttgctaccacattgttcccttcattgattgaaactgtaaataacataacactttaaggcagctaagcaaatattttaataagccatgaaaggcaagatgccagagaaaatctgtatattcagctatttggagaactcgtgttttccacaaattaaactggagatgtcatttg

SEQ ID NO: 121991 - DNA, 1629 bp, Homo sapiens
tgcctgcttgcagaccatgtgtgtaagtgaggcaattatgcacttaatttaaaagaaaattctgattaaactggaaattagggcattttttgttttgttttgttttgttttttcttttttcctacctaaataaatgtcttcaattttcccttcagatttgaagattggaagcaggcctgtaagagacaacagacttgaaatttgtgatgggatgatgtgtaccaattaaataaatgatttaagcatatgtaaacctacttactctgaaaggtttttttttaacttattgaatcagttagtgaaaaatacagatattgtgatgtagaagttagtgactaaacaaactttttaaaagcctgttttcatacattgtattaattttattgagcgccaatgtctcaagtggacttttgaaacaactttttttctttccctcaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtaggtaattctttagtgtttttttttttcttggatttttggaaggggcaaaacaaacaaacaaaacccgtaaacatgtaattgcatactaaattatagattgtaagatatcgttttcaattgttaatttgataatcaggcttaatatttttactgggttcatgcaaacatggtcatataatttaaatgaactcaaatgttgtcacttaaaatattttatcattttgagttatgtgtactatacatgaattaattgtttctttttacaattcattaatttattgcatgactcagggaagggtattcagctgccttttattaggtggtaattgtgaagggggacagtatcttacaggattatagatttttgaaaatcaaggctgtatttctttttaaggcttacttgtacttacaaattaggtaactcaatccagtgtggtgctacaccaatcatattgtatgaaatgctgttaaaaacacgcacaaagttggtttcctttgtcttcttaaaatttgaacagactaccaagcatatttgaatactatttgattaaaatagaagcaattatgaaagcctctcttcatattatcagagtgtaacattggtctttgtctttttttatttatctattttccttcatagtacctttaaaatatgagctataatttgaattacttaacagattttcttatgctgatatgtagaagcctaccttttagtatcaaataattgaaaaaaagttcatcttaatttagttgtcaatatctctttgatcacagtagataaattctgaattgtgaagggaaatgaatacccttcatagatagagccaatttgtgtgccagttggtgctcataattggcctgatgttatttaaaaaaaaaaaaaaaattgaaagtaagttattgcttatggcttcagccatgaagacttagccatcagctaatggtgtgtatttgaagacattgattattctggctctctgttctatgcaggactttgaccaaaacttaaatgttagaatttatagctttgggttggtat

SEQ ID NO: 121992 - DNA, 1053 bp, Homo sapiens
cgctctttatgagaacctaatgcctgatgatctgagatggaacagtttcatcctgaaaccatcccccacaacccgggtccgtgcaaaatttgtcttccatgaaaccagttcctggtgctaaaaaggatggggaccgttgaactaggagatacatatacacatgtacatacacccctctatacatctgtatttctgtatctttatgtgtattgaaaactgtgagtttgtgctgatacttccatttctagtccaataccgtaagtttcatttcattctagtttccttcttttccatgtttgtagctttgttcactgactaagaaaaatctaactcctattatccttaatgtatttagttacttgattaattccccttatgtgactggtttcccattgctactgcagctccctttctcatgtgggtgttctctttattccatgtaggctctgacagtctgtgccacatcaccctcctaacacaagaaatgggtggttgtttctggggaaagaaactgggtagctgggtggtaggaatggagagggattcttcagttttgtaacttttttgtaccctgttcatttattactttgtcaaaaactaaaaactaaaaatatctttgttcctatttataaatatttaccttttttctttgactaattattgtggtgatggtaattttcatcaaaatcagctgtgtttttctcattcatagtagtcctgagtttcgctatatggaggtaccatcaaataatgagaggaaaataagttttgagcctcaaaagatgttgctaggttgtgtggcttccagatagtaccatttaaggcaccatatctttgtatttgtctcttaaaaataacgaaccatcccacttttctagtctaacttcaaaggagacacctgcatctctgacttttaaaaagtttatattttttgtttttatggatatttcttgttatcatggatagccagagagaagagcaggaagcagttagtgagaagaatgatgtatgtaggtatactaaatacgttgtattccaaattgacgtaaaaat

SEQ ID NO: 121993 - DNA, 1330 bp, Homo sapiens
aagttattctaaattctgtgtctgaaattctactgtcatttggataaattggactgaatttagttattaaaacaattagcatatatatatataagatatatatacacacatatatatagcttacttagtttgatcagttttataatccaagtcaaactgcataacagattacttcctcagtaataaacctgtaagtccttagtatataaataatttaaacgtatggtagaatactgggttttttccttacgttttcttgacttcctgagttgtacttttcagtttcttcaattataatcatggattagaactttgttataactagttttcttaagcatgattatttggggtggagttagaggagttaagaaggtagacatctctaataactttattggctataacttttaagtctttatttttcacttttgtcttacatgtaattgacaattctaatccaactttgtgatatatttgtagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcagtatgttttatcttttcctcacttttctttaaacagtgacaactgatattttactaatatttgaccatttagaaattaggatacataaaggtggtcttggctttggaggcaaattctaatcattgttataacaaaaataatctttatgcttaaagtctttcgggtgaccttctacatgtggacagtcaacatccagaattctataaatctcaaaacaaacaagcaaacaatataacactcctgttaatcctgataaagaattgatgagacttctcacatcttttccacgcattcacagccgtactggcatcaggcattgtgtagcatttgtttattccttatccattaatctctgctaatgtattaacacaagctgccttggcacggatagtgtttacttcagtgttcaatgttgatctgcccttcagtatgccaaaaagataagtgtagataaagataaataaacgaggccaatccattattttctagtcgggcccagaccctctttataaagcagaaattctctgttttggatatgaaagtcccaaagattccagatttaactgtttttttattcatctaacaaaactaccttctgtgtgccaggcaccgttctattaatacttgttggggatatggtagccagacaagcttgctgtctttaggagggacac

SEQ ID NO: 121994 - DNA, 1712 bp, Homo sapiens
tttgcataaaaaaatagagatttctattcttaagccttatttccatagaaacaaaattccttatctatataaatactcagtacattttaataaactaaatatatttgtcttatgcacagacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcaggtatacttaatctttgttaatcttgttttttcattgattttcataatttggggaataaattagttttaataaaggtcctttattttccagatgacacacaggctgctcttaccaaacacttgctgaagtcagtgtgtactgatatcactaacctcattttcaacttcttagcttcggatttaatgatggcagtagacgatcctgcagccattacaagtgaagtatgttaatgatctccctaccactattgatgtgttctgttttgcatctatacacattttattttatcttatttggagtaaagaggaaaataaaatacagtgaaagaggtttgaggaaaaaaatctaaaagttttttattcaactttagtactatatatacagttgctagcaggattggtagtataactagtctgttaaaagtaatgatgcttaattactttagaataaacagttttttccctaattattatgtcacattccctcttcctaatgactggcaaatcccataacattctgacccatttccataactttgaagttattttcctttaaggacatctcatttcaatatttagactaattccaattaattttttaaaactctaatctcaaactaaattcaaaagctcatctcctcccttcttgctatgtaatgtagagaatggctcccagttgcctagaggaagaaaggtgccatctatcccaagatgacaacccctccttctccttctctttcttctctgtcctcctcccaccttctctacctcctcttcctcctcctctttcctgttcttcttccttcttcctcacctctctaggtccacttcgagttggagatttaggaaaaatgaggcaggaaaaagcgtcttgatgtgactgactacatgtcactgctttgatcaaggtcaaaccaaatcagtctgatgtttgtggtctttggtgatgtagttagtcattgcctcataggcgatataagttgtttccctggaatgttgtttagtttcatgtgacttctcacagtaaggaccatccctcaaacagaggaacagttatttcttcctccttccccagcaaggtgctggcccccttcccttcttctgcttaagaagcaaatccccagttgtctagacagtttcatgtctcctgcccttataccaatctctgctatggaaaatacagaatatcttgttccatgccctttaagggccacagaaggattggtgtgggattggggcagagaggctagacaggagcaactagcccttaatcttcccagacattatacacttcagggcctggtgtcaagccatactagcaagtctgctccaaaattttatgccagaagaaactaaaagactctgatcaagaataccataaaacttcagtggacacttacatgtagagagaggtgctgaaaagattc

SEQ ID NO: 121995 - DNA, 1135 bp, Homo sapiens
gaaaagatacaataatgtcaaatctcccatttcagcttctttaggtttaacttatccatcaaggacccattcaaaagtcttgtcctatcccttttagctaaaaaacccctcagctaaaagggaacttccctatccctttgactgtatctttggtgatagaaccaggtgataagttgactttaccataagtcaacttatggtaaagtgatttgcattcatgttttatctctcctaaattgtacactccttgagagcagaaactgctagattagacttgctacttacatggccagttttttgtaaagatgaggaccttcaatgtgtattagttgaagaaattctactttatctgttccacaaaaagataaattgtgttgattaacttttctttcccttttcacaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaacta

SEQ ID NO: 121996 - DNA, 1104 bp, Homo sapiens
agttggattagatgaatctctaacgtcctgtccagctcaaatgtgctttcctctatactagggtatagatttttgaagagcctagctgacttcagcatcacctcaccctttggtctccagtattacttctttacattttacttcattagctatttcttaatattaaatgtctgaagagtgtggcactgtatcaggagttggggcattgaaaggttgaagacatcatgaaatatctgggaaactctgctcttaaggaaattgcaccgatgttggaactcattgtccagttaaagagctctttggggactcaagcatattattcaacatgttgttttgggattatcttcaaatgatagtcacctacctctttcatttctaatttttattcacaggtaaaattgtttttgtccatagggattttataggacataagcactgtagtagatactagtagcattttgaagtgtattatgctctccattttccatataaactagatttcaagcagatattgataaggacattttttattagacttttctctgaggaaagtcagcatgatctgtattcatcttacatattgataggtcatgaagactcctttttggctggaggtgaaactgagctttgttttctttgttcctgttttatgggcagtctttaggtactttcatgctgcttaataggcagtgcctcatttggtgagagctctggagtgcctgccgagacgctccctgtttgtgaacaaagattatgaaggggtctttgtgagaattcagcagcaacactgaacagcagttctttttacactggattatcttgatctgatgagagtttacaaatcattttgaacatttttattatgtatacattgtgaaagctttaaaaataagtactatggagcacctttgagaaacgtaggtgcaaaatcatatgttgcctattcccccatattttcttgaggcagggaaagataccactactaattctcactgcttacaggcataatcagaaatggttttttgtttgcctgtttttccttctggctagtaagaagcgtaaaagagataatgaaatatttgtggtcaaaagaaagatgcaagg

SEQ ID NO: 121997 - DNA, 1026 bp, Homo sapiens
gttctttgatgcttgttaaggttagctccatggacaatggcaggtgttctctacaaataagtgttccacgtgtagctttaaaacgatgtgtattctctagctactggatgcagtttcatgtgtatctataagatgaaaattttaaatgtgctatttaaatctttatccttcttcatgtttttatctacttgatcatttaattactgagagattataattatggatttattattttcatctggttaattcaccttttactttatatgtttttgaggtttattattagatacatacaagtttagatttttaaatatttttgtgggaaattaacccttttgtcatatgtcataccttctgtatctctaatagtattgtttgaattaaagtctctttttctttgatagtaatacaacgatgaagggtcccctatagattatgatgggcttgacacacctttccctacttgttggctttaaagttggatctatatccttatgattttagatgtgtctcttgtaaatagcatatagctggatctttgcatttaactggagagtttagtctctttatatttagaatgaagactgacttggatttatttatcatattattatgtattttctattctgctttttctttgtcttctttcctttcttgccttcttttggatagactgaccctctgcccctaccattttttttttttttttactgtttttatttggggggtcaggagattacctataagttctacatctattattttagtggttacccagacaattttaatatatactctttctagtctaaagttaatatctttgccttctattacggaattgaattgtatcccccaaaattcatatgctgaagccctaatccccaatatgactatatttggagatagggcctataaggaggtaatgaagattaaataagactataagggtagggccctgatccaataagatctctgtggaggtacagagatctctctctccctctgcatacacagagggaaggccat

SEQ ID NO: 121998 - DNA, 1853 bp, Homo sapiens
atgggaagcaggcacggcttatattgccagagcaagcagaagcggggtgtgggggaggtgctacacacttttaaacaaccatatctggtgagaactctatcacgagaatagcaccaaagagggaaatccactcccatgatctagtcactttccaccatgccctacgtccaactttggggactacaatttggtgacatgagatttgggtggggacacagatccaaaccatattagttgttatttgaagaggaatagtgtagatttgagaagtatgaaagtagatgtcaaatcttttctctcatcctaaaaccttttttttttgatactaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaggaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaatttgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgactt

SEQ ID NO: 121999 - DNA, 1033 bp, Homo sapiens
agtattttcctaacagtccaaatgattatgtttattttttaaaaaaattaaagtggttaggccgggcgcggtagctcaagcctgtaatctcagcactttgggaggccgaggcgggcagatcacctgaggtcaggagttcgagaccagcctggccaacatggctaaaccccgtctctacaaacaatgcaaaaattagccgggcgtggtggcgcgcctgtagcctcagcttgtcgggaggctgaggtgggagaatctctcgaacccgggaggcggaggttgcagggagccgagatcgcgcgactgcactccagtctgggcaacagagcgagactccgactcaaaaaagaaaataaaagaaagcgtttgtgttaagcgtttaggatattacaggaaattttccttgattttaatattgtgacttttttcctttccttagtctatccagaagttaaaggagagattgctcgtaaagatgaaaagctgctgtcgtttctaaaagatgtgtatgttgattccaaagatcctgtgtcttccttgcaggtaaatgtgtgtttaattaagtgaatacacaatttacttattttggggcttcaggaaaatgattaagtgtggcaagtagtaaaaagagtgctctgcaagtgtgtgttgtgatcaatctacacgccttggcaaagtttaagcacactggtgtaagacagcaagacacttatgccttggttcactggatatttaccagaattctaaaataacttgtggaagtattgatacaagcaactgtgtgaattatttcatagtatttcagaatttgtaggatttggtaaggcattacttccagtggttgtcatttgagtgacaaaagcagagctttaatattattttctcattcttctgtggattgaggtatgttctaatctcagagactcctttagtaagtggtgttgttggattttgtggggtgttcctgtttgtttttttaaggatgtattcagataggatatttaaaattagaaggatcaaagaatacattaggaat

SEQ ID NO: 122000 - DNA, 1011 bp, Homo sapiens
tcctcatatttgagcaaaacacatgtacagttatagaataacaccctataatttcccttcagtggtttgatcatagtctctgagccaaaagacaatattcatccatctagtcattgatggctgggattgcatcagagcattactcaatactggattgatgacatgagacttctaaataaaatgatagctcctgcatatttacataacatgtcctactagatgttgaaggaactttgcatgtggtcactgaggtatttagcttatattgtataactacactggaaaatgagagaaaaccaatttggtcaataaaagaaaacccttctgtatcacattggcaatagggactagagtgacctcatgtgggtcacaacaccccccattgtttcctagctactgcatgcaataaggatgcattaccagggtgaagtcagctgaaatggccagggaaatcctgatgcttttttctatcacaaattggtatatgcctatagaggtaaatctgacacaaggaaaagaatacaggacttgatgtcaaaagacccatttctgcaacctaatatatttgtgcatttatgaaaaaccaacatgctgatactcagttttatcaacatactgatactcagcaaaacaagtatgataatacctatgtcatagggttctacggaagactgaatgcgatcagacatgtgaaggtgcctggtaaactgatatttagacaatgtacagaatttatatgatggcaatatgcctccaagagatgaaggtattccccaatataattatccttttaaattcatgataaagccatcacatgcagaccatttttatgtaatacaacattgtgtgttagtgatgtaaattttgagagattgctatagttgataagaaatttgctatacagtattaaatacttcacatatttaaagtgataataaaaccatggcagcacaacagattataaactagctcttatgattaaccatatttcacacaaataaactcagtaat

SEQ ID NO: 122001 - DNA, 1027 bp, Homo sapiens
tcacagatgaggatgtttaagccaacattatgtcagactgcctactaactagtttgggcaagttatttaacttgtctaaggcagttttcttaaatgaagtaatgctacctacctcataattgttctgaagattaaatgcttataaatatacatgtatgtatatatgtacatccaaaaacatactaacatagtgtagcatttagtaggagcttaataaatatttctagtaccatccaagcaagaaaaagaattcctaagatatggtgatggtgacataactgaatttaagttcagaatttcttttatgtatacatagctttattttgagcagtcatctttgatacacaagcttcttctcttcctcttttgtaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaattt

SEQ ID NO: 122002 - DNA, 1440 bp, Homo sapiens
aatgtcatttttcactaaatgattttaaataagacatctgagagttacttgaggcaagtttagatacctgtacaagtttagattttgagaaactccctatttcctcattgtgtgtctctttcacatgctttttagaatcatttattccacaacatgtttccaaattctatctagtaatttttaaacttcaaaaataatctccctgttcaattacaaggttctaaagacaataaaataccttataatttcagtaacaacatttttctttttcttgggcaaagtattacaaagtgttcgcctaatcctcataatgttcttttaaattaacgtggaaatcagtaattatcctccttaaaaggtgggaaaactgaagcactgtaaagttaggttctgacccaaggtcagagtaaccaaggtgaaaaatctgggtatttcaacaactgctgttccagtgtatgtctattattattcgtatcaccttgaataaaatatggcatttaaaaatttatgatgtcataatgctgagtgagtctctactgagcagggctgcataatgttaaattttaaaaagaaaaattacaagcccggctttaaataataaagggattaagtacagaatatatatatttttaagatcatcgatgccattgtgtccaataaattgccttactaacagtgttatgttgtcttaagacagtgctgattagaaaaagtgtacaaagaatgctctaaagacccatggaacacaatataccttaaattggcactaagctataccacaataaaagtcatacatattgaatgttgacatacactgagaagggtgacgagttttcaataacgtattttagaaaattgttcattttttgcttaaatttatccgaatataagacctataaagcaagacaaggaagcatggagcactgagtcttttcatgcccagtatccaacagtcagagctatgttttcctcctgttcatgatggcttggcttttcagatggtgccaatcctgtgatgaggcacttgaagagtttgaaggttagggcatgtaaaatatggagctggaaggaagcatgctgctattccattggaagcaaaagggagtgtaggcccatagaatacttcttctttgccttctctgcttacatccagtacctacaaaagaggaagagaagaagcttgtgtatcaaagatgactgctcaaaataaagctatgtatacataaaagaaattctgaacttaaattcagttatgtcaccatcaccatatcttaggaattctttttcttgcttggatggtactagaaatatttattaagctcctactaaatgctacactatgttagtatgtttttggatgtacatatatacatacatgtatatttataagcatttaatcttcagaacaattatgaggtaggtagcattacttcatttaag

SEQ ID NO: 122003 - DNA, 1317 bp, Homo sapiens
acttataagaagttaaaagaagaaaatgggatatatactgaaattgctacacaggtctattttatggttacagaatttttgttttaatacttacgcttgtgatacaagtcttcccattgtaatcataccatcattgtccttaaataatattccatgaatgcattttattacccgtgagcattataatatttcggaaggttaatgaacttttacatgtcatttttagcacacattttatatataaaaatcatactttaatacatcttaacatctaggtttactcacaatagatataaagcattactttttaagaagtgttgtgctaagcctgctggatggatggctgaatagatggatggatggatgatgggcagacttaatttgtaaatactgaaatgaaaaataatgaaaatgttaatatatttgctttcttttcttttttcttaaacagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgagagtgttttctgtgtgtgagtattaagcagatacttcatccatagactttttgttgtagtatgacttcctgcctccctgccttgtgactgatttgtcatgtttattttttatttttacaataatagttatgttttaaaatgatactttttcaaagtacctggctaccctatactgtgtttttggtgggggaaaggtgttgggaaatgtgactgtgtatttgtttttcttttttatatgtgtgaggcaagttaacaaagaaaacccttacaaagcacacttaactgtgttaggaatgagactgaatctggctaaaggattatacagctgatatccaaaaagaagtgtaaacatgccaacagggtttatatttaggttccaagagttgccaaattttttttttattcatcctttcttttggagttgtcattaaaaaaaaaatcatatcaggaggaggaaataaaggagactttaagaggagagtaaataaaaatattctagaaaagtaacaatagt

SEQ ID NO: 122004 - DNA, 1034 bp, Homo sapiens
ggtcctagactgggtttgagagagtaaagtgggaaatgtgagtcatgatgacaggtacacaggccttcagaccttgctaaacatgttccgctggatccattgtagaagtacatgtcactgcttttctgacttgctttagtatactaactgtagcttcagaaagctccgttatgtttaatttgtgaagcatggactttatagaagtagatctattgttcataagaataacagtgcaacttgaggcatattttctttttcttccctgtcttgttccctttagagtcttgtgctgttagggcaatacgtttttgtatttctttctgaagatttcttccagttcacctttattattcctatctctgccttaccactaccatgagaaataatttgcgttcgtttccttcattctatgttggatctttgatacctccatttttctcatcacataattagtgcctgtcaagtgtttatagtttatttaaattgtgatcagtcagtaacaatggatttgtgaaaattgtgaagccctaggaggggagaaaaggattttctatgatcaaagattgaatgttatctataatttactaagcgaggtggcttttcattttgttgattggtagtggagggtagaggttttaaggctaaatatagaatttttatttataaagaccttctatgggtctaaagtcttttattcagttaaggaacataaaatatattaggaataacttgctttcctcataaaaatattgtttgacttatatagagctacaaagaactaaaaaataactaggaaatctgacttttttctgttactgtctcccatatcctttccactcagattcaatatgtagaatattgcaaaaaagtcccgggattagatttttaccccttcttctccctcccaagcttccaactcttcccttccctgctcctccccacagtgctttcactctggtcatggctcaacttaaataagccacttcaattctttattttaaagtgttttaaatagttttcatattgcatccaga

SEQ ID NO: 122005 - DNA, 1041 bp, Homo sapiens
tgttcacggtatctagtttgctacttacatgtttgtgagggggtgggaggaatatgcttatgaatttttaaaaaatcaatctgcctgtctgtaaatcagctgaatttgtaaaggctttcttttgtcggtatgttactgtttgtaggattaggatggtgtaacttttttgaatatgggcacctttctaagagaaaaataggtcttcatgtattatttcagactaaaaagtagacttttaaacttttatattttcttaaaatggaagataggtatactttagaataaaacaaaaacttagaactatttcattttgaaaaatagaaaaaggatgtacatactttaagaaaacaacatatttttctaaatcaagagtgttcataaaaatgaggatccagatggtcaattcagacacagtgcctaatgctgtaatttttccttctagttaaaaggctggccacagagaacctgcaatacatggtaaaagcctgccaagtggggtcagaagaagaaccttcctcccagctgacttctgtgtttaggtaactggaaaatatgccacctggcaaggaaactattgccagccatttgacagccaacatgttttttaaataactaattatccaaaacataatgtgttactacttgtttatagtatttcaattattgtatttttggcagtagttttgttacactgtgatgttttattgaaaaataaaagtgccagtgaaaaagataagtgaggggacttaaaattacctgtgaatttagtgaggaagaatcttgcatgaacagtcatgtgtctcttaacgatagggataagttctgagaaatgtatagttagccagtttcaccattgtgtgaccatcaaatagagtgtacttatacaaacctaggtgctatagcccactctgcacctaagctatatggtatggcctaatggtcctaggctgcaaatcagtataacatgtctctgcactgaatgctgtaggcagttgtaacacagtggtaaatatttgtgtatctaaatgtatccaaacatag

SEQ ID NO: 122006 - DNA, 5032 bp, Homo sapiens
cacagacacttatggtagtgtgctcagtattttttttttcagacctcatctattagactatgggtgaggagatataagagaatacactgtagaggacatcagaggtaaaagagcaaaatgggtaggagttggagggcttttcatttcagagggagcaacatgtacaagggcatgagctttaagaaaatatagaatggttctgttgtggctggagagtcatatgggaggagccatgtaatggagggctttatattccatcctaagaagtttggacttaatcttttacatggggacctgatgaatttggagcagagaagtagaagtgacataatgatatttacattttagaaagatgattctggtggtcatatgtaagataattggtgtggaggttttggaaagcagtggtaactagttccttgtaataatccacatattgtcagaaggttttgacctaaggcagtgggaataaaacccataacagcagatttcaaaaacatttgggagctgtgattaagagtacttgctaattgagtgttgtggaggaactcaaagaagtgaaatgcttcctagattccagagtggctatctgcgtagatagtagttctacttactaacgtgggaaatcctggagatgtcgggatgaaggtaaggattggtttctgagcagctttagtttgaggtaggcagttggaaatattgatctgccattcaggaaaggatgagactggaggtgtactttattattcattagtgtctgatgttaaagataagtgcttcttaatttgaggtccaacaagggaagctgaggaggaaagggaaaatggattttgattatgtaacaatcttttttcaaagatgtatttcttaacagagttttaagattcctgagaagttttaaattttccctctaatttttattcataatagcatttaaaatgaagtttagtgtgttaatctagcagaatgacaaaaaggggaggcagccacaccacagcctgaaccgccaatcccacagagggagagatgaatagaggggagtggtgagcagcaggagagtctggaatatttcttccatgtggtcctcttaaacccaaacagtccatttaataagaattctcttaagcttcgtaagtggtaaatttaaaagtttggtgtattatctgtttggtagaactggagctatgtctttaatttcttcatggtacccagctctcctcttcggaattttcagaaaatattcatttattacttcatcttcttctgatttaatgtgcttttccttaaactactcaagaaacagagttggtggtggcgggtgggttgggggaggggttcattgtttgatttttttcagttgtttatttggtacagttttaacagctgtatgctatttttcattacaaataaactttcagaatttcttattgggtaagtacccgtttacaactaaaatggagacttcaaacattttaaattatttctcttggaaaatacgttgtgagtcaccaagtaccaaattaagagttaacttttataatataatgtattgctgtgttggtgattatctatatttagtagcatttaatatttactaatactagcagaaaacattattttctctcagagtattggtttaagtattaaatactgtaatatatatgaaagtattttgttaactgctatacaaatgtaagagattaaataaacagacatgcaaccagatatcaagagttctgtgtgactgtattaaactcttcacttttctaaaccttagttatcctagctgtaaaatggagatacaatattactaactcagtggttctttgagaaatttaaatgaaatagtgaatataaagcacacagcacagtgcctgttataggaaaactaagtaaattgttattccgagtcttaatttccatattcctcgccctttgttattactttaaaaaagattatcagatttttagcatggaagacttttagcaaaaattgtatagtcttagacaaaataaccagtacctagaaaaaaatgacctaaaggtgttttataactttgtaagtacacataaatgtagttgatgagcaagatgttcaagtgttctgatgattacaggaaaagaatctgcctttgtcttcctactgttctcccctgcttcctttgtccacacctcagacacacatgcttagttagatgccatatcatatgtattgcccaggcttaactccttgtaattcgtatgtacattatctgtggattacgtgaggtatcctttttgatttttatattctcacatgattattaatgctggggacttcattagtgagtttctaaatattgtttgttctttgaaactttacctcttagtatttcttactttttttccttgtagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggtacatctaaatattaaatataggtggtatgtacaaattattaagctctattaaagtgataaagtggcatttcaaacatattggcaacccttaggatactagtagttcagaagctttttgttttcctgagaagcattatctaagattttattaaaatgacatttgcttatggcagcctaagacaatgctctttaaattccttctcttttctctatgtagctattaccttccttatatatgtcctaaaggtatatttttgctttttagtttttcatcagataaacaatatttgtattttatactgtataaaacacagtaattatatttggctgggtgtggtggctcacacctataatcccagccctttgggaggcagaggtgggtggattactagaggtcaggagttcgagaccagcctggccatcatggtgaaacccagtctgtactaaaaatacaaaaaaattagttggacatggtagcggatggctctaatcccagctactcaggaggctgaggcaggagaattgcttgaatctgggaggcagaggttgcagtaagctgacattgtgccactgtactatagcctgggtgacagagcgagacaccatctcaaaaaaataaaatacagtaattatattttataaagataattaagtgaaaaaatgaatgctaatattggaaatgaagcaccctgaagtcttgttagtttagtcttaactcagttttattaagcaaatgaaaaacaaaacttcttaaatattctactaagtctatatcctttaactttaacattagaaagttcagtaataaaaaatgttttgtcattgccttcatgtattatttatttttatatgaaattagcttttaaactttaagatgctatggtgatgtatgttattcttatctagtattagttttctgtgttttttaatgacccaataatatctgttacctctcatagaattccatgcctaaaatctgtctcccctctcacctttttgagttcttagtgtcctgttactcaggtttggaagctttatcttctttgcttcctttccttgcccatcctttggcaatcctgtcctccttttcctatttctcttcccttagtgcattatacctagactattgtcagaatctcctgactgctttctgcatctctagtcttttcttctagtccaccctaaacaatgcccccagattacttttcctaaaatactctttcattatgaaacttccctgccattaaacctgcaatatcttttttgtccatgaaataaatttcatgctccttagctctctgcaatccatcacttaccgtttccaaatgtattacatatggtgtcatacaacccctaataagattcatattgcccctccaaaatgcctcatacctccctatgtcacagctttattcaaattgctttctccattaaaatgtcatttttttgggctaaatcccacgtatcctttataaaacctacacctgatatgtcagtgtaccatgtatgtttccttttttgaaatcatatgccctgtacagctcaatttgcagaattatgatagttttgccttacttgtatctgaatttccaacaggattgtagtaacctaacacagtgtttgagatattgcataagtaattatagtacaaactaaatgacagatgctgaagtgaaattgaatctgtaaaactgtttaaaaccccagtgtttaggatcccagaattagttgactttcctatttacttaacacacagtgaaaatgtttttcttgtggtttatagttgaaggctttttttttaatactcaggaaagatatagagattgtcttctatgacttcttccatgccatgcttctctattcctgcactccctcatctgagttagggctcttttctctgaattcctgagaattctgtgcttatctttgtcaaaagcaccattatgctatattataattgtctttttctttttctcatttaacttctccactccatggtgggcctcttgctttcagagaccatattttattcaattttatattcttgttcttagacatgtacctggcattccactggcgcccaatatatgtttgttctaggcattaggaattcagcagtaaacaaaattggacaaaacctcaaagaatgaattttctaatatgtagtatttgttggaagtcactgtagggaatagaaataattactaagacatagttcctgtccttatgtttataatacttagtggtttctcttccttatggttattattactttgcaaatatatatatatatggatgtctagtttatatttagctgtatttgacagattttcacattgtctagacatttgtagaaactaagcaattccaacttttatttattcacttaataaatgtatactgaacacttgttatgggcccgga

SEQ ID NO: 122007 - DNA, 1549 bp, Homo sapiens
gcaccaattgctttcagtagtctgtcatgagtcacatttcaatacctgaataactagaatggaccttttttaaaaaaacgcttatctattgttagaattaaaaacatcagaaaactatcgcttacatctatttctatgctctgctctgtatgaaggagataggatttaatacagcactaaaaatatttatgcttcaaatcttgtttctcacaatactcttcccttttcaaaaagaaatcattttctatgcccgttctataacaatggagtttatctttctttaggaagtcagtgattaacatatctttttttcacgaaaaccatggtgctaaccaaaactaggaattggataaaggtaaatgagaaagatttccttagaagtttttatatagaatttaagttttttgtttttttcctttatttctctgtggtcaaaaccttttatctgttccctttaatcttatgaatgtatgagtaagcctgattcgggttgtctgaaaccttttatctttgttgtaaaagataaaggcgaatgtgaaaatgtgtaaatatagaagatgtaaattacaggaaaagctatagcaattcaggcatcttaattttagagaaaaatgtaagtgagaatttataagtttaatagtaaaatacacattaataaatatattggcattcatgcttataatttattagtgtctacaaaagttttctgtttccagatttagatttttgccaagataaatgtctgatatagacatgggacaaaattctacttaggaaaaattgaagactttctttgctttgctgccttgttgatttttgtctccatgcgcagatctgtattctttccttttgtctaggtttcaaagactaggaagagtatattgctacagtgttgcccatttatttgttaggaattaggataggtaacttaatgatttcttcatgttaaaggattagaataaaacagagaaagagcaaagtataaactttggagagctccaaggtgttttaaaatgtgttggggttgggatagcataaccatttgagggaaggagttaaccactgaaacactgtactctatttaccttgacagttcctaactggggacacctctgctgttcacttacaaggttgcaagactgctagtgaaaggcacagaactgttgatgaaatcacctttcatattaaggagaaggcatctgtgatcttaattgtagctcagttatttctgaaaaggcatggtggatccatcaacttctctcctctgtagattttgttttgttttgtttttctcattcttcatatctgatagttttctgtttccatgtataaagctttcaatcatccctgtctctttggccattcttccccattttgctttgtaattgaaattcaagtcatgaccctttggtgccaagtgcaaatttccccacttttcccacattgccaagtagacttgatcatctctctcattacacttcatctatccttttcttgtgatatgatattatttatagtttgccatttgttaaaattacttgtgtacttg

SEQ ID NO: 122008 - DNA, 3390 bp, Homo sapiens
cacttgttattttcatgaaggttggcctgaaaaaaatcctccaaatttattttaatattttattatattagttggtgttacatgaataacttttggggcaaggatgttcataagtgagagaaatttaatttgaagtccttgtgtggaaatttgaattttaaaagaaagcatgtcataagtgaagaatactgtattacttctcatatatacattatatatatgttgtatgtgtggttatgtatatagtatgttatataaattgatataacaaatactattttattttaacagaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggtatttgtcatttattagtataattgtccagattaattacaattaattttcagaaaaacctgaagtattcttaaagtttttctataaaatgaattcttataaattgaatcatattattgattgcctgctattataaagttctggaggaagaaaaatgtgaatctaaggtatagtacaattcacacttaaggacagcagaaaaattacattaatgaagaataataaaactaaagaataccacaaaaaagctttactctaaggctaatctaaattgtaggaatattgacacagttgctggacaaccgcattgttcagatgcttgggaactgaatatccttgtaaacattccatgatactcccaccttagtgtttatcaccctgtagcgaacagtgtaggcataagcaccatctacttcgtatgatagtatagttggagcattaaaatccaatccatttgttttgttttgtttccataataaacagtaccattcaaaattttatttttaattattaattgtacagaaatttatctatgtgagagtgtttgttttgcaaacctagttgttaatgtgtttggattagtgtcttttgtaagctattaattgtaaaagttggtttattttcccacagagtggttggtattagctgcagtgaaaataattaaaatcaataagctctttccataaatgttaattcttccattggtttctattaagttaaagtacaattgtatgacaattagagatgtcatgcaatctctaaaaatatttgataatagtaaatgcagatgtaaaatacacattccatttggacccttatttagttgttgattggatctgaacctgcaattaaatgcctgtggtgtgctaggagctataatggatcagaaatagagctagaaatcaagttcttcattgatagttttcatctagcccaaattaattgttctttcaccactaagaaaatgagttttttgctgaatgctagataatattatgctagaacttcgtagggatttgaaaaatcaaaagaagtagttctttatctcaggtggcctttacttctctgtggatataagacatacacaaagactaaaatagtaacacaaggcattatatgctaagtgccagttggttgacagatcaatcagtaggtaaagaatttaaagcattttagtataagaagtttggattttatcctgtgaagattgtgaaggctttgtaagtttttaagtagatatgatttggttaaataatttttttaatgaaaataagtaacaataatataacttaaaggtgcagagaactgttggccaaaagctaatgaggtttagaaggaatcaaagattgaatggttgtgggatttctgaatggatatgaaataaatgctgtgtttgactaaaagagtgatgataccttaaggagaaataggaacatcatgatttagggtgacagagaagtaggtgaggaattcagttttaaatttattcatttttaagttgtgtcaggtctccccaagattatccctcggttctgtgattcataggacttagcatatagttgtattcacagctatgacttattaacagagggatacgaagcataatcagcaaaaggaaaagatgcatgaggaaaagtctgaagaaaccagggacagcttccaagattcttttcccagtgaaattacacaggatatgcttaattctttcagcaaggaattgtgacaagacatgtgaaacactacctgccagggaagttccttagtgactcagtgcccatggttattattggggactggtcacgtatgccctctttgcctcatacttagagaattccagttccagaaggaaagcaggtattcagcataagccatattatttgcatagaccagtttaggatcaaggaattgtaggaagcttttcaaaatctaagaccccaaataccagccaagagccagccttgcaagcaggacattttaagagtagcagtcttgggtctgctgtattaactcttttctgcacagaaatgatagtatgacatctaagttattattatcaaggtaccgagaaatacatgttttttaggctagggaagttaagcctaagcatagagcaatattgagaagtctaaggcactggtgttcaaaagtgtagtccatagacccctgggaattactgataccacctgctcaaaacagtattaatatttgcacaaatagtgtaaaatcttttacatgaatcaacactgcggcccaagattatactagtattcattataattgatactgccatgcatttacagaagaaaaagccagtttcacttaagaatatcttcaatgaagcagtaaaattatttattttattacgttttgactcttgagtacatgtactttcagtattccgtgaacgacaatgcaaagtgcacttaaagcacttttgctgcataccaaagcaatgtggttgcctaaatgaaaagcacttgtgtgattatttgagttgcaagctgaactgactgcttttatcttaaaagaacaactgacaaagtatggttattcagacttggctatttggcagacattttctcaaaaaatgaatgaagtgagcctgtcacttcaaagcaaacaactgacagtatttgttgctaataatataattcaagctttcaagaaaattagaattttgagaaacttgtatttgtcatcgtgatcttgagagcttcccgatacttattttctgatgagaatggtggtggtattagcaggtgtgatttttttttcctgatataaataatgaagtgtgtcaacattgggaagctgtgtaactcagtgaaccacaattttccaaatgacgaatataggctttttaaaaagcattcatggatgtaaaagattcactcaaaatacaggatagaccaatggcttttaatttaacagaatataaaatgtttattgacatggt

SEQ ID NO: 122009 - DNA, 1037 bp, Homo sapiens
tttgtttagcatggttaactaaggaattctagttcctagactttgtgggttctaaaggaagtggagtgtcattgattgtaggagatctctgtttaatagaagagaatgtccagtgtctaaggtgagaaggaactgttcacctgtggcagatgacaggcaaatttgcttccttagaagactagatgctggacatattttataaataggtcttttgaatggtggaggcacattagccaaaacctcaggcatagaatttgtaattagagggagccattatagatctgtaatgataatgcagagataaattcttctaggcctttcttggagatctagatgctacagaaatttctatgacaacatgaatttgttcagttttagctttttgtttgctctacatttctaagtagaacattttattatttgttacttaaaaaaaaaaaaaacacttgttataattggccaggggtgtgtgggtcagaaatggtttttaaagattcctgactttaagtttctctcattttgaatctagactttactttgctagcaatggacatgccaagcacagctccatcagattttcagcctcagccagttatatcaattattcaactttttggttgggatgatatcatctgccctcaagttgtagcaagatatttaagtcatgtcctacaaaataggtacgtgcttttatttcaggcatacacattaatgcaaacctgtgacagatcagtatcctaggaagctaagaattttcacaaatgaggactgatctctactacatatactctcactttgtcaggtttttgctttcagatatatcagcctttcgacagtagtaatagtaagaacactaacttatattttgtggcctgctttaaaaaaaaaaagttgtttgttaagccctttcaaaactgtttttgtaagactgccttatcatcatactgaagtgacctttctacacatcccactgtgaaagaaattacacatttattattactgaatctgtaagatactggtatttattacagtcttcg

SEQ ID NO: 122010 - DNA, 1161 bp, Homo sapiens
gtagagttaaaagaattcaattattgctgttaatccttaccagtcatatttattatattatgctttttccatgtgatgaaaagtccatcaatagacaattttaattttccttaaactttgaggcatcatgtattagaaataattaatatacaactgtgaataccaggaaagtggtatataggatgtcataccttattctataacagttataggagaaacaatggtatgccaagattagaggcgaaaactataagcagtggtccagtaagtgttcccagaagcctgcctaagttactagggaggagcagaaactgagagaccagactggcaggtagaagtttcaggtacagggttccatgcgtctcatatgatagatgcctcaataaatttgtgtgtctgtggggataaggtatctgtgtgggagtagagaggtgggggcaaaatggataagtaaacatgaaatcaaagcaagaagtagcagacaaataaaaacaggaaatcttggaaagtggggcaaaagagcagtcagatgaaagaatcaggaaaatacttgaagataatgaggaaagctaaaggaggcagggtaactgagctaaaatagaagcgtaggaacacctggataattggtatgtgaaagtgtgggtgtttatatagtgtaatgataggcttctaaacttttcagaatgttatttcctgtggtcttcacaataaccctgttaggtggatatagcaacaattgttcctgttcttgactctaaagaaaacagcgagttgggaggttacttgtttttccaaagccacactgctctggatagctatgctaataaccatgtttattacgcagcataattactccttttgtctcaattttctcatatataagatttgaataataattatgcctacctcatagggtgagaaacgatgcttataaaacactttgcatggtgctggtctcatagtaaataccagtaaatgctggatgttgctgttatttccaccatgagagctgcaatttgaataacttgacattcagcaaatttattttctactatactgtattgtatcttttataatgtaagagagctggttacatgtgtgtatttccttatctgatcttgtatttccaaactgatcttaatgtgaaatctgtctttactc

SEQ ID NO: 122011 - DNA, 1175 bp, Homo sapiens
tcttaaaagatgtttcctgatcattgtacaagtacaatgttattgtacaaagttctatcaatcatcatccccatactgtgatttcttttttatacataaagctcaccacaagttcaggtattacatggttgtatgtttaattatctgtctctcattagaatataagttccagagggcagagactttgtctgtttgctagttttgtaccctactgcttagaacgtatgctgtatatgttgaattagagagtaagtgatttgattttatatacctttgtgtttttactttcctccttttcacctaaacactccttacctatcctttgagaatctcttccacgcccattttcttgtgcttccccccaaaggtttttctcctctgagttggtaaaacaatcttatactttgttttgcacttatacctatagagtaaaggagtattttcaatcctcctccatgacaggattatgtatgatcttgttacttagtctatgaactgctagttgcatggtcattgccttatctgttgcaggaattaaataaggcctattcaataaatgaaataattattgatcagaaaatcaaagattgtttattgaaaatatatatgccagatctattctaagtgtttggcctttattaatgtaattctgtaggtactattattatccctttttttttagatgaggaaagccaagaaggtgactgcccacagcatggtgcaccataggatagcagcatctgcctggtagaaatgtagaccctcggccgggcatggtggctaacgcctagaatcccagcactttgggaggccaaggtgagcggatctcaaggtcaagatatcaagaccatcgtggccaacatgatgaaaccccgtctttactaaatatgcaaaaattagcggagcatggtggcacgcacctgtagttccagctactcgggaggctgaggcaggagaattgcttgaacccaggaggtggaggttgcagtgagctgagatggcgccactgcgctccagcctggcaccagagcgagactctgtctcaaaaataaacaaatgaggccaggcacggtggctcacgcctgtaatcccagcactttgggaggccaaggtgggcagatcacgaggtcaggagatcgagaccatcctggctaacacggtgaaaccccgtctct

SEQ ID NO: 122012 - DNA, 1040 bp, Homo sapiens
tatgttgggtatataagttggttttctctcatttccagctaccttaaagactttacttttggctctaactttttgagatgacatgatcctctatgacctgttccttatcaatactatagttacattatacaaatgtatagttacattgttcttatcagtactacagttccttatcaatactatagttactggcacttgactaaaggtaataccgtctactagtaataccacactgtttgtgaatcccttcatgtaccatgcaatttcatgtcactatgctttactcatgttattttaactttctgcaactctattatttttttaattaactaatatgacttctgtaacaggtaatggcatgtcttctccaggaagtcttctttgaatcctgttttttactctttacatacctctgtctcggcacttaactgtacattctttgaaaggaaggactatatttgataacatctagtacaatggctcatgtaattaacagacattgacgtgttcattaagatgatctgaactattaggtagaatgattcctgagtctgattgtactcttcgactctaggtccagatttccaaaaatattttcgatagtgttacttcaattttctcttttcatatcaaattatatcctcctgttataattaactgtccctcgtaactttcagtttttctcccccaaaatttggcaatgacaggctgctccttcctttccctcacaaaatgcgaaataattagtgttggctttttccttcataaagtaactgaaaatgcacattagctcttacctggatgtttacagaagcttcttaattagtttcttttatctttagtcagttcttgttctgacccattctgtttgccattacctgattaatctttcccaaagcacttttttcattatatcaccctccagttcagaatccttcagtgtcttcttaccactttaagaatgaagtcttgatttttcttttaacagcaggattaaccatttttgtatctctagcatcagacatagtgactagcactga

SEQ ID NO: 122013 - DNA, 1026 bp, Homo sapiens
tattttaaaaattacacgtttttcagcaaacagtggaatagccaaagcaagacagagatagagatgcagggtgggggaggattgggaggaggaagaaaattaaagattgtgaggtgttcttaatatcatagtaattattggctccagtgctgctaagttagatagattggtggtctcttccaaaatgaaaatgagggcatattccataaatattttgttcacactgttgcttgtattctaactttcttttttagtcaccaattcctaactgccccccggcctgagctcattcttttttcttctatgagaattcaatacataacattttggataagatctagtgcatgtgtgcttgcacagttataccctatccatttacatttgaagaggaagataattgtatttgaaatcccaaaaaccagtataacaacttcacatattttataaggcatgtacattttgttgtgagattattttcagagatgatctcacctctgagtgcctttaaccccaaggacaaagatcctggaccttaactagtggtcctacccacgtgatactctggtagtagaaaacttggagactgactagcttcatattcagccataatctccccctcttttactttcgttcattacgttgtacccacacacttgctattaaatttggaggatgagttcctggaaatgggagccctaactgaatacaagcagtgcaagttgtcacaatcagatgatgatcattctgctcttcttttagaaattactaacctacgatgacgtctgtagttccttatagttataatgccaaaggatgtacccaagccttaattgtggcctttaccctcaaccatttccttgaaggcatcttgtgatgctgtaaaacttaaattttaacatccagcgtgaaaatttttattttttttgtgtgtgttaacttcaggactataacttgttggtcataatgatgcttataggtgaagctgatgcttatgggtcagcaccgaagcttatgggtagctctgcc

SEQ ID NO: 122014 - DNA, 1356 bp, Homo sapiens
cttatcccagcatatgcatggatttttttttcatcaggagatgagcttttttgatgtgcagataaatgttatcaatggtgctacgcagatgaaacctgtcatgtacaaatagcatgtatcaagccctaagcatgcagataccagataaatcggttcatttgctgaagccttgcaaaaagaaattagtgctataataaacgcctttgaggctctcagccctaataatggagctttataataaaccccacagatcattgactcaatggataatcttttaggaaactttttcccctcctctatcttttcctcccttttaaagaactacagtaaaagtggtaaatagcatctctatagggaatgtatgtggtatgaaactacatatctggaaaaccataatttaaaattaagaaatttatttactgctaaatatgatattattctaaacgagcttatactttttgatgattttcataattgatcttaaacatgtattagtcactgctttttctacatagaattcatattaaacattcctcctaagttagtgcattttgtacatgaggttacagttggattgttgactacaacagaggcacagagtgaggagatcaaaataaggcagaagaggagtcagggagagaaattgagaggaggcattcagcttgtacttagaagtgtttataaagtggtagaaagcagaagaaaggggatggggcttatacacatttatgtatacacaaaactttacacataatttcaaggagtttgcagatttctaaagattatatatgtactgcaggtttagcactatattacaatggtgactagactgttatttccattagggtttggttatacttttgatgaataaacactttaaaaaatatccctaggtactttttgactcttacttgactgagttttgaaatccaaaaagaaaaaaaaaaacaagtcactattggagctgatgatgaggtttgtagatccattaacacaattggcaatggtcactagtttctggttgtataatttactgcattttttgagtgtgagagaagtgttgaggatgcagaatgcttaagaggttttagaaaaattatttatcaaagaacactacttttccagtgcattagctattgtaattatacattggtacaatctgttcacatagaattggatttgatttaaatggaggtggggggaagagactggacattttcaatatttattgatacatagtccgttaaggtaaattataaagcaaatttcactgtgacgggaacatttgggttgatgtagttaataatcagtcaacattaccattagaccctttatttataaaaatttattaccaac

SEQ ID NO: 122015 - DNA, 1428 bp, Homo sapiens
tatatcctttttgtacaaagcaattattttttttgatgtggcaaacaaaatgcataaaaacaaggctggaaaccttaaggaaaagaactcaactgccaacattaatgaccagtagtcatcttaacctgatcatcccttgattagtagtatagttctttaatgaataaatgttggtgattaagagtattataaagatacacctcttataaataattctgtgtgtgctttagtcttattttactattaggtactcttttaaaccttcaagtgtaagagtttaattattacagttaaatcttgaacaaagatggtttatagtgaaaaatgctttggagtcagatacacctgggttataattccatttctgttacttagtggtcaagttatttaacctctgagtccattttttcatcaccaaactgtagatgatattatttactttacagtatctaaaaaaccaaattagaaaatactagaaagtagtactgagttaatcaggttagtcaacgctaaggtaatagctcaggaacccaaagtcattgaagattatatgcataggatccctcccataatgctagaaaggatatttaaaagttgtgttgcagcgatcttcgcagctttgctctatatatatagatctgaaacatccattgccatatttaaaggtatatgatctcaggcaagtggatagagaggttgccaggtaaacacccttctgttagtgcacaggagtagctacttggaaagccatctgtatgaaatctatgctagtttaaaattcctaggaaggcctgaatagtaaactgttatttaggataggtgggtgagctctatttatgtcctttccagcttgagtgattactcagttgtttagtacacagcaaaatatatgtaaatattgtcatctgtgttaagtgctaagtaaaagacaaaggtatgttgttataagaagaatacagtggtctcttggtttactttctcctaattggcagtgaacatgtgtcctctgctatatgtaagcacaaaaatgttactgtggaaacatttgtaggctttctaaaagtattgttcgagggaataagctaagactgatatttatcttaaacacatagcttgtccaatatttaaacctaatggacaagatgtgtaccagttgaaaatgtaatatttatccagtcatttctattctgtcaatctaggctctaaagcaatagattgcactcatagagtaataaatttttagtgaatttggagataaaggctattggtggtgattgcttaaactctttttgctcaatcatctgaatggtgcaaatcaaagcattttgtcagactgtgagaagtttcacctagatattgcttcccacacacgcgggtcaccatataaattacattcacggttttacagcatagctggtgctggaagtt

SEQ ID NO: 122016 - DNA, 1049 bp, Homo sapiens
atttttagaggttgggtctcacttattgcccaggctagtctcgaactcctgggctcaagtgatcctcctgccttggcctcccaaagtgttgggattacaagcatgagccactgtggccagccctagttgattcttttaaaatgctaatgttttatagctctatgcatttgttttgggtttcatttctttcacgttcactgtttagagtgatctgtgatgtcatgcctaatacctgcctcttcagtgtccattatacatccagttaatgttatcttaaccatgaggatggtaaattttctgaagattcataacttgaaatttaggtttctactgaaaggaattcctagtaatagatactaagatgtcagttctattgaaggggaggcatggggatgaaatgcttgactgactttgaaacacttaacaatgtcagtttggaacactttgaaaattttatcctgttttataaaaaaatacaaatacatgccaaataatattgtttaataaacaacaacaactttttctataaattttttcggagcatcagttaatctatgctgctgtgttacagtagggtttggcattcctcactgtgtcattgaacatggaaagtatgggccactgttaaagtttggctgcctttaagtggtagtcagctactactgctggagaaatttagcatcatatattgtttacttgttaatatgcattaaatataatgagctaagtacttttaaaccacttttattcaatattgtgggggaaaatttagccccttccagaagaaagagatggtcagaaacagctgctttgtaaagttggcatacaatcattatatttctccaaagaaaaaatggttaccctgtaataatcggtctaatgaattcagaaattcattgattgtcccagctctgggtagattaggtagagacttgcttcaaggagtggaatttatgaaatgtttgctgcatccagcaagcagagctgctataatacagctgcctcctcagtggtttgctttgatcctgtggaatgaaaggacaggagga

SEQ ID NO: 122017 - DNA, 1132 bp, Homo sapiens
gttaaatgtgtgctataaattgtgcttcttgaaagaggtaggaaggaatgtggaaaaggaaagtagagaaattaaaaatcatttcaataaaatgctttaatttatgcctctgcagttaagcagtgctcctggttaacagaaatacccttcagctacacaggattttggagggttggagggcactcatttgcacataaatagccattaactgataaattcccagaggtctcctgttgcatgttagtggttctgacctacttagctagctggaatttgttttacagaattattataattctatccttggtgcttaaactttgtgattaatgcatgcctcacaatacaattaaagtataattacacagttttgcagtttcctattgtggagttattattacaaagatctggattttgcaaatagaagagttacggtttccatatttctcacttttgctgttattaggtgattatcttaaatgggaccattttatgtctgaagaagggattggagggaaggtgaatcattattaaatgtagcatttgttagcttggaaatgattgggtcagctaatgtgtggtcatttttgcatgctgtctgcattgacgtgtcacaggcattcttaaaactgttttgtgcttttcattgttgctttttcaagtgtttctgaattatagtagaatcttcacaccattttctaagaaaagtagtgttgggttaaatgttaggaaacagtagagagacacagtgggtctcaggagatctaaattctgatgctgacacttgctgcttagttatgcagaacaattcatgtccctgaaagtttgtcgcgtcatctgaaaaatgagtagtttagactagaaaggattggaaaactaaggcactgttggtcagatcttgtccatagcccattattgtgtagccatagaacttaggatattttttacatttttaaagaattgtaaaacaacaggaagaatatgtgagctagacattgcatctgtaggcacagcaacttagtctgggcaacatagggagacttaaatgcttaaccctgtctcttaaaaaaaaaaatacgtggccgagtatggtggctcatgcctgtaatcccagcactttgggaggccgagatgg

SEQ ID NO: 122018 - DNA, 1059 bp, Homo sapiens
gcattacacttttgaggtatactactagaagatgaagattttacattagggaaatgaaagattaagtcaagaagaagaaatcttttgatatgtttgctttgaaaagcctataacacagaatgtggattgttctgataccctcttattaagtaatctattttttcttttaatattaatttgccacaaaattgtattaaatacatcaatcttctatacattacgtatgttgcaaatatattggccccacttgaaatttgcattttatgtatttttttggatgtgtaaaagttttaagggatttttatatataaatgtcataatcttaaaaaattatatacacacacacaaaagtaaacagctaacagttttttaattgtggtttcctaagaggaattccaatgtaattcagcaaatgttttttgaatgcttctgtgtcccagaactgtgctagtaagtactcttgtgtacatgaaaatgttcctgcacttgtagagcttatagtatagtagaaagcatttatactatcatgccatttaatgccaccaagtttttatgtctccatggtcattcctttttaaattctgaaatggttggaccattaatttgatacaaaatatggaatctcttacattctgcagactactcatggaagatggtaagtggcctctggaatataagaaattacatatattaggttgaattaatggtccagctatttcagaattatattacagtagaagttttgtgagaacgtgtaaccaaaatatcccttgtttcccagaaggcaagtgtattttgcctaatttagagattcaacacagttcagtctttccatgatttctatatggactaatacaacacagttcaatctttccatgatttctatatagactaatacagtcatgtcttgtcttttggtatgctgttctgaatttgtcatttagaatgtactagtgggcaccaggaacttgaataacttaaatatatgaacttgtttacatgttggacagatgtatttattctcattggaataatgattgtgggagaatgagtcagatt

SEQ ID NO: 122019 - DNA, 1018 bp, Homo sapiens
ctgtagtcttcaacaagtcttgtcacttctttgaacctcagtctttctgacctgtaaaatgtgtataatgatacgtattgaagagctgatttggagaataaaaaaggtaatatatgtcatgtctaacagagtacctagcggtgattgcttttataatcattactgtgtgttggtttcagagaagtaaagtgagagaatggtttattagacagagttttccattctaaattaagattttttagggctccattctgaatcagtacaatgataggtattccatgaaaagaatactatttatgctttaagtacataaattgctttcttggtcacatctctgtccccttttatttttcttatgtctttggagaaaattctgctgtattaattttgtgcttatgcatgaaacagaaatgtctgtattttccagccagtacacttattgagtgcccatcaagtacctgccatgacagactttgtgctggtattggagaaagtagagatgcataaaatcagaatgctgctcttaagtgccccacagtgtagtgaggtagacatataaacaaataaatgaaatacactgtgatggatagaataatagacagatgttggagacttttcttaaaacttccatgtcacttacagaattttctctgagattgccctacataaaataaagcatgtgattagattatgtggcagtaagtcagctacactatgtcatatagatgataggtggcaaatattagaagggaggaattttaagtctttagaagtttgtgtttatttagatagcagttcaaaagtttttaaagtttttcctgacatctttcacacattccattaataataaaaataattaactttgctacttgtacacatatttaaggtcttgagtgaattgttattatagcactgtgttattgatacactttgccgcatttctttcttctgacatctacttttctacttctgacattaggtgtcagagaatgggaatagaagaaaaatagatgtcaga

SEQ ID NO: 122020 - DNA, 1599 bp, Homo sapiens
atggaagaaaaatgtttctcctataagtcaaatgatttgaaaaaaaaaaaaaaacaaaaaaaatagtaaaatcttatgatataagatctctttgtttcattttactcctacagctgtaattttttaagaaatcaatattaggctgctattatatatatttctggtgttaaacttagaaaatgtagatggattttttaaaaagttatttaactcaccatgctgagagaactactattgatattttgttgtattcttctacacattactattcatatacttttttaaaaccaaaaataagattaaatgctgtttagtgggctggcttcttcgcttactatatcatcaacaactttccatattgatgacatctacattattattggtgttcattgtgtagatataccataatattccatggtgtggattaactatttcttatttgtgaaaacttctgctattttgaatttttcaccattagatacaaggctgtggggaatgtgctcctgtgtgtcttggcagggctcttgggtattgtacaaattgtgtgctgcataacctcaagggtaccattcacagcagtgtaaatgaggctttgatcttcatagacttgtttgattatgtgtagaaggtattttttttaatgatttgatttaaaaaatagaaccttagatgtaattcttaaaaatgaatgggagccatagcgtatgttcaagatccaattacatatatccaacagatgcaaatttttaactagttgaaaaaccttagactagaaaatttttttttaactttttccagatttttaaaacaaagctgtagttctgtagatggaaaaacagataggaggcttctagagcctgtggtgaaatgataggtaaaaggattaataaattaacttttattttccagtattagtattttttctatgcttgttagtataggtaccccactatttctctaagccttttttcttactattaatatcaaatatcaaataacattttcagtgtaatttctgaagcagttgaaggctctagagagtttttaatgcctctcttttacatttttatattatcaaatttatgtatcttgcaaagaatgtaaataatacagaattatatgtagtagaagatgaaactcattcttttcctaaaccctacccttcgtctgcaaagggagccactatgaacactttggagaatatttttcccagctgctattgcttctccttttatctacactgcctcctttaccacctgttttattttgaagggtggggggacaaaagtgggattatactatggaaatttctacaacctctttctttttttttgaggtggagttttgctcttgttgcccaggctggagtacaatggcgtgatcttggctcaccacagcctccacctcctgtgttcaagtgattctcctgcctcagcctcctgagtagctgggaccacaggcatgcgccatcatgcctggctaattttgtatttttagtagagatggggtttttccatgttggtcaggctggtcttgaactcccgacctcagatgatctgcccaccttggcctcccaaagtgctgggattacaggcgtga

SEQ ID NO: 122021 - DNA, 2412 bp, Homo sapiens
taattaacgtgggaggtgaatgaagctttataattagattttatttggctgggtgcagtggctcacacctgtaatcctagcactttgggagtctgaggcaggcagatcacctgaggtcaggagtttgagaccagcctggccgacacggcgaaaccccacctctactaaaaatacaaaaaattagctgggcgtggtggtgggcacctgtaatcccagctactcaagggctgaggaggctgaggcaggagaatcgcttgaacctgggaggtggagacttcagtgagccgagaatgcgccattgcactccagcctgagcaacaagagtgaaactccgcctcaaaaaaataaataaataatgaattaaaaataaaaatatattagattttttacaagattactcctactttcaagaagcatagaatagaatagagctttatgatttctgatttatagttattaccaaaatttgaagttaccagtaatatgatttttctaggatgaaacccagaaaattgtcttctcataattacagaggaaaaagagaaaacataagggtggagaaagaacactgtaaaacagaaactagagtgaagaacattggataaaaggagaaggaaaaaataaatatactctgtaaagaaagcatttcattcctttgaaagtggatcaattcagttgtttagggaatagaagtgccatgattatttttctttaccagccactggaatatttctctttagcaaatggcaataaatcaaaagatgatgggatgaggcaaaagctacttttcccaatcttatttatgtcactgtgattcctagtctgaaccctgtggttcactataggtgtttagaccacccagatctttgaagctttagatgaaattcagcaatgagtttgtaggaagacatcactactgtgctctttcatggcaccacacggtgctgtttcttaaaccaaagacaggctgtcatagtaagtatattgaagactggtaaatcccattcgtgacagattggttaaagttaactcttctctgactatggaataggttaaaaacacctaaaattgtgactttggtacattgacctagtttaaaaaaactcagtatgataaactggcattgtggcttttggttataaaagggaagtacttgggaagcaagtaaaatttcagcatttacattcaataaatgcactagaataagctaccagacttttttttttaatgatgtaatatgacagtgagggaaggaaaccaatcttaattattcctgtaattaattacttttggattaataaaacctcagaaggcactataaattgtggagaaaatagattcattatagttttaaaatacttctagctattctcaccatcttactgttaccctaaagctattttctttaagatgtgttttgtagaaaacatcagagtacatgtttaatgatatgaatttactgttgccaccatattgtttatgggaagcagttcttagctttcttcatccgccttgtggaaaaaggtgagtaactgctgtttgaaattttatttatattttaaagaaattgaggacaaacaaggagtgaaactagcatttgaaactcttaatttcaattgtttcttctttaccttacaagatatatatttttctctctttagggtatctcttgtcagatttaaggcttatttaaaatgaaaagaaagctggagcaattttctttattccatttcagtctcctaaggcctatttccccctggtgagctcatagcaacaggggggtttaagggaattcagctttctgcaaattaatgtctcacatcatgaaaattcaggacttttttttttatcttgaaaagtaatacagtgagtgcgagtattatttcttgccagcgggtggaagatgaatgattttgtcacagttttactgcttgatgagcagtgtcctgagggtcaggcttaagtctgtgtcactatgctgctcattactcttgagctaaataagggctgattggatctaaattgcctagcacatgggccacagatgagctcagtgagcaggggatgacctgctattcagtctgggagtaaccccggtgtgcaaatgcagcattagaacactgtgggagaatgagaggctaccggctgctgccagcaaaagaaatcgaaatgtaaaaactctttgatgctgtgatgttagaatttgaaatgtaggaagtgacaggttgatggtacttatcagctttggctggattagagaacagtgtcatcttgcttatataatgacagaagaatgaagtcagcagctaactactgtgcagagcagagccgctgctgttgccacagccagtcattgctgcctcctactggcagttttcctggaaactagtaaaatattataaagaaaaaatc

SEQ ID NO: 122022 - DNA, 1249 bp, Homo sapiens
cttgtagtattgagtgagttctcacgagatctgatggttttataagcatctggcattttccctgctagcagctcttcctcctgctgtcatgtgaagatttctgctgtccagtagggtagcactagctatgtgtgacagtttaaattagtgaatataaaataaaaaattcaattcaggggtccttgcttccccttcaccttcctccatgattttgggttccctgaggcctctctggccatggggaactatgagtcaattaaacctcttttctttataaattacccagtctagggtgtttatggcagtgtgagaaccgactaatacaccagtcttgaataatctctattcctgttgaatttcctgaatagttactaaatctctaatgtcctttattgttttttaccttgtgttgtaattattttctaaaggggagacatattcatgaaaaacaatttattcaacaaatttaactagtatttttgaatgcctactatgatagtaggcacttaggatatatcagtgaaccagtcacatgaagcatatgtagtatgcactcatgtattttttacatgaaagactaagatggtagagaggaaggacaaagaaacttgtatttatttaaaccatcactttttcaccatttcatactacttgctaatggtttatacttgtcctgaaattttatatgcttatccaacaattcttgccagtgtccatatgcaagcagacaacagtatccatgcagtcaggatatggatttaatgcataatctgaatttcatctctgtgtttattgtcttctaagtacccatgggtagaagggacctctagaggatgataggaggtttgttcttcccagttgaaaggttttcggtgttattgaaaaattcagtgtgttttccttagtattttctggatgactattattattttatctttctaattcactagttatcattgaattttttccactgaactatggaaacaggtgcagcaagtgggtcctttgagcctttaccttccttttgagacatttcggaaccagtctctcaaggctgggtctgcaggaacactttgaatctacaagtgcagattgtctgtattgggattagagtggaaggaaggcatttggaagagggaacttagaaaatggaatgaaggaaataatcaataaaacaatttaagaaaatttctcagaaccgaagattctgtaatgaaagggcctattgagtgactccagcacaacataa

SEQ ID NO: 122023 - DNA, 1017 bp, Homo sapiens
aaagaaacttttagtgacactctaatagacacagtagaaaatttcacatttcttatcatggtctttaaagccatccacagtcttcttttaccttaatctgtaactttttcttgtgattctcctttagtcagatggagctactagttctcaagaaatccccaagtctttctacctttatttatatcttcttgtccaacgaagttgagggtcaaagttgacaagtttgacctcttgtcaaaaccaattgagggttcaggccagaacatgaccagtatagcagagctgaagctgaggactgaataagcatgtcatgtgagagtcactgcttagaaaaaggttaagttgggggaatggaagtaattgtcaaaatcaagagtcagaagtggtcagtgttggtaatagtagacataggggtgagatggcagagtatagaaaaagaaaaaactagaggtatttgaggagaatggaaagtgttttcagaagttagtagtatgttgatgagaggtagagatggaattaaagagcatcatatatgggaggagccagtattccaggcaggagacttatgcacacagcaagttttgctttttgcctttgcttcttaaggaacctctagtagtgcctgatagttgctgctgtcaaaacattgtattaaaaagcaggagctttaaggtcagtaaacctgagttcagatcaccctctttcatttaccaacagtgcaatcttaggaagttacttaatcttttctaagtttcagctgcatctttgtaaaataatatccacctcataggatttccatgaacatctgcttagatttctgctgtccagtagggtagcactagctatgtgtgacagtttaaattagtgaatataaaataaaaaattcaactgttctgtaacaccagctatatattaagtcctcaatagctatatttagttagtggataatgtagtggatagcagcagaaagacttgccaagggatagcactgactttgatgctgcacctgtccagaac

SEQ ID NO: 122024 - DNA, 2152 bp, Homo sapiens
taagtaaaataagagcaagtgttcgtgagggggtgcagggagaaaagagtttaaggaaaattgttacataaaattgtcctgttaagatctctgtaaaagcatatcaaattgtatttaaaagattatatattctttcttatttactaatcaaaataagaaaagaaaggtgatgggggacttgaataaaaggaaaagccatgtactatatgaaaacatttctactttcctttggggaaagccattgaatcctttgattcacttacaggtgatttgctgcatcattgggaaatttcaaggtagggccattatgtgttttctaagtaaaaaaagtgacaaggcagcatcaaaataaagaattagcttaaaatttaatgagattgttatgagtattgaaacaaattttcttttaagagatacagatttttgtgaatgaaacaattttattaaagcattttttaatgttttacagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggtatggttttcagttgtatgctaatttatgatttgttttatataattacttatgtggattttatattaaagttatatatatgcatatatacaaatacacatgaaatccaaatgtagaggaaggatttagttttctactacatgggcataaatcagtacaggttgaatatatccgtgtactaaaatgctattatatgaaaagcttgggactagaagtgttttggattttggatttgtttagattttggaatatttgcatatgcataatgagatattttgaggaggggacccaagtctaaacataaaattcagttatgtttcacatacatcttatacacaggctgaatgtaattttatgcaacattttgaataattttgtgcatgaaacaaagttttgactgcaacccatcccatgaggccagatacaattttccacttgtagtgtcatgttggcactcaaaaagttttgaattttggggcattttggattttgaattttcagattagtgaggctcaacctgtagttttcaagctgtttttcaaacaatagcttttcaaaagaaagcttatatgcaaacacaagatgcagaactaaagtcaagagcagctctggtgcagtctgagagccatgctttctcttagcccttccttcccctgctacctctcagaaaagtgtattattacccagagatacgttacagatattctgagcaagatcatgagctcatgtctgaggtggcttttactgaagcatttgtaattttgtgcccataaggaagttttggtcacattacaccattttttaaaagtgactttctttaaatttttgcagcaaagtcatagccttagctgcatcaaatgctttgaaataaaccagtttgctctgaaattaacatagataattctattaataacaccaatcacctatacaaaacttactgtttttcagatccacttaaattatgcagatatgttaaatacactcagacacaaacttgatgtggataagaacaatggttatgatatttattgcctttaggcacttttcacatagcagttttacctttgaagtacatgttcttaagaagttaaatactaccactcagtatggttactcactgtcacagaaaatgattgtatttgaaatcatgtccaaagataaacagactgcttc

SEQ ID NO: 122025 - DNA, 2097 bp, Homo sapiens
aaaggttaaaatagatgtactctgacaatcctttggttttagaaagaacaactcctataatcctataaaaagatttgaccaagtacttaagtatgaccaagcactctggatttgtgtacatcttaatcgttacatcatttttgccacttctttttggtttgggttccttttctggtttctgggtttccagtaccattcaattatgaaacacctgtaatttttaaataattgaattaaaagtcgagttatgtgacttctgttatctgaatgtgttaatggtgtttaaaacatgtttttggaagtatgtgttgtgttgatttagacctagtctgcatatgagaatgggtatgattgggtgacacatatttattttctttttagctgcaggttatatacagcacaatatcaagtgaaaatgtttatattgccagagcccatttaccttctcataacttcagtttattttttagggtgtcattctagaagaacaattacgaatgtatcttcactgttgtttgacactttgtgatttctgggagccaaacattgcaattgttaccattttatgggaatattatagtaagaacctggtgagtgaatagaataggaatttgctccaggaattttaaaaatttgtacatatttgaggaatgtctttatggtttaattatgaatagttatggatttttcttaaaaagttaatttttttcagagtagattggagtagctcgtgaatagttttatctttaacattgtagagctttgtcataagggaaacagcatttggtatcctttttctcttgagagcaagggtaaacaaagtagctaaaatgtatcagatatttataaaatcttcatttataaatgtttctaataataattgattgctcatgacacattgaacaggcactgctgtcctgagtaagaaacaatcctggcatttgagtagcttataggctactagtgggtgggtatacatacattgtgggaaaaaagttataattgtggaactccagaggagagggtatctaacccggtatctgtatttgtggaagacttcatgaggtcataatttttgaacttggctttgggaatgagtagaattttctaacagaagaaaaagggatccaggcagaatgaacaacatggacaaatacatggaggtatgaaaaagcatggtctgttcctaccatgttaaatagttctgaattataggcctcggataactatggagagaccgaagataggagactagagaaggcagtctggggctaggctatgaagggttgaagataatgtacagttaattctggtttattcaggagacactaaatagcgaggatgtgacttaggtatgtgtttgagaaagctttttttttttttctgaaagtggtgtaaatgaattgggtacagacaacttagtggtttattgtagttgtatgagcaaatgatactatggctgagaactgaaataggaacaatatatttagaaaggagaggatgagtttggaagattgaaaatttaaaggtagatttaaaggatttatactttgtatatagaaaggaaatttgggatgttttgggtttggggtaaataattagtgaacctctcaatcaaaatagaaaatggtaatggaagatttacaagtaaataatgtttggatttgtggataatggagcttattaaaaaattagaaaaatgcccttctctgaagcataattttaggctagttggagaaatgactgattgtagtcttgaggcaggaagagtccagggtgagtctagggtgtcttgtcataccagaaagcaggaaaggtatcaaattaagctagagtcatgtcagaagaacacaggagccaacctgaaggaatgtccattgcccagaaaatgggaaaatttgagcataagaaagaataatgactgcaatagattaaaacatattaaatatgtttaaatctctgagtttatgcttctttgtaaaaagttactctgaaaaaagaaacacctaattctgaaaactgtaaagaaaatacaaactatattttagagtaatcagatttctgatgagttaattaagaaaacgtgatagaattaga

SEQ ID NO: 122026 - DNA, 1483 bp, Homo sapiens
tcaatttattttctgtataaaatttttagttactttgtttactaaagtagatggtctcaggtttgttattcacaaaatgaaggaaaaagctctagtgattaaagtggaaaatagggatgattactcagcataaaaaaaaaaacaaacaccaaaaatacatgtggctatataattttttttttttcctgttggattttgtatctgaaagcagaaattaaatatttggtagaatatttataatcttactgaagcaccactgttacaactcctgatatggtttgtattggattggaatagttgtacatttttttctgccaagtttgttaactctttaccaaaggaatattagaaattcaagaaatcacattgatgctgaatgatagaggaaaatgtactgcacacttaatttgctataccctaattttaaatataggcataatcaagagcaataattttgatgcactattttctccctttctagagaaaagtggaatcaaattggaactttgtagaagaactgctgaaaaagtccatcagtgttcaggtatgcaattaaagtaagacagtttgtggattttgcttaatttttatgttacaaattttatttttaaaaccaagcaagctgttaaaatgattcagaaaacaaataactttcatgctttgaagggttaactcacagtagtttcttttagtgattattctttaaagatttttaacactaagttgtcagttaaaggacaataatatcctagttgatgactttgacaaaatgtattcaaaataagtggtagatgcttcagaactgtatgccattccttgactgtatgatatcaaactaggtgacacaatgagggagatagtcattggcattgaaaattcagctatatcctcatcacagcaggaaggtgacttgccttgctgagcaatttgtcttacaggcttgaatcatattctaactgataaggtcctagtttctgaccattcgtttcataccttatcatttttctttctgcagagctgttaatgtagtgcttcatggcctagaggtcagacttgacctccttttaaaatagttttaaacatgctgttcatcacatttttaaacatattgtatggaagccctgtaaagttttgtaatatgttatcatttttgtaagagtttatggagaattataataaataatattttggaatttgggaaatatttttcttttaagaaataaagattatttaaaacttgaagaggaataaaaaatattgtagtataatattgctttatatgtgtgtgtgtgtgtgtgtgtgtgtgtgtgtgtgtgtgtgtctgtagtagctatgtctttggaaaaattttaattgcttgaaattttcttttacccattatctgcattaactcttacttttttaggaaacataaaggcatttagttataatatgaatcacataattatgaactaaaaattttagcttagaatgccaaagaatt

SEQ ID NO: 122027 - DNA, 1450 bp, Homo sapiens
gtgcctatcagagaatacacatgaaatagattgtactactttttttttttttttttgagatggagtctcactctgtcacccaggctggagtataatggcgtgatctcggcttactgcaaactctgcctcacgggttcaggtgattctcctgcctcagcctcccgagtagctgggattacaggtacacaccaccacgcccagctaatttttgtatttttagtagagatggggtttcaccatgttggccaggctggtttcgaactcctgacctcggttaatctgcctacctcagttaatctgcctgcctcggcctcccaaaagtgctgggattacaggtgtgagccaccgcaccctgccagattgtactacttcttgcttcaaggaacatgcttttaggttattaaaaacttgttggaactgtattaacacttttttgagtgcgtagtatattttaatattagttgatattgaccccgccagatattctcagtgtggtaggcaatctagtcacattaggatatattgttgccattgctattgtaatatggaattgcagtgatataaccacctatggttgcagtgctgaagtcactcttctatttctttttttttttttttgagatggagtctcgctctgtcgcccaggctggagtgcagtggcgcagtcttggcttactgcaagctccgcctcccgggttcatgccattctcctgcctctgcctcctgagtagttgggactacaggtgccggccaccacgcctggctaattttttgtatttttcgtagaaacggggtttcactgtgttagacaggatagtcttgatcttctgacctcgtgatccgcccgcttcggcctctcaaagtgctgggattacaggcgtgagccaccgtacctagccctacccttccatttcatacagagaactccagaggagattattgcttttattagctctgaatcaagatagtaaatgaattgtctgtgtttaaaatagcttaacttgcgtcttttaatatttgtcagcagttcctgattttcttttgccacgattttaaaaaatcacatattttatgtagaaggttttaaaagaaaaggctgtgataattaatagaaaaaggatatgataaaaatgatgaggatgtgtaatatatatgtgtatatgcacatgtaaaataaactttgcctttatatatgagtcctcaaagagtttatttctggatttcctaaaggtttttaaagaaaagctctctagttaataatagttttcattaggggtaaaatatgtgctgcatttgcaacatatttagtatttcacagtgactgtgtattatctcagtgaaatattttaaagtaggtgagagggtaatatattcattttacaggtaaagaaattgagatacacagtggttaaatatcaccctattttatctcttagataaacttgatatt

SEQ ID NO: 122028 - DNA, 1035 bp, Homo sapiens
cctgggcatttttattatttcagttttatatatgtgttttgtcttttgtatatatgcttcattataaaaatagagaaaaaccacgaaatcaaaggttattgaaactgtcttaatggaatcaaattacttctgtttctatagtcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatggtaagacttcattttttaaaaactttcttatattgtcaattaatatgtaattatttggacaaattagaaaataagtgagcagaaacaagaaaagtcagactacaatcacagagataaattatttatgtataatgtttctgtaaacatcttgaaaaattataaagtttatgttttaattgtttaattaaaaaaaattacttgtagaagatttggtatgtagtcctggccctgctactgaacaattgtgtgaccctgagcaaattacttaaacctttctagctttgtcttccgttaacaaaaaatcatgggattggattgtcacaaagattccttctagttttaaaatctattatgattggcaaagaaatttctcgaggaatgaattacttatttttgtgaataatttaataaaagtacttcagaatagcacttctttagtgaagctttttgctaagataacttattaaacaaccatgaagtttgcttcaaatacaaagagattttaactagtatattaatttctcattagaaacattttttacagtgttacttaaaaaccctatgaataaaatcagctaacagatgtttactttgaagccctatttttatacaatttctaccatattcagaaattaatagtattgtattattgtatcagcctatcagctccataaaataagcatctagaatcatgaagccaacttgtctatattttca

SEQ ID NO: 122029 - DNA, 1164 bp, Homo sapiens
caaaactataggatgatgttaccttttgtataagaaattaggaaaaaggcaatgtgtgtgtgtgtatatatatgtgttcaattgtgcacaaataaatactggaaagacaaactattgagattggtgggtaaaaataaagatgggtgggtgaaaatggagtggaagggtttgatgtaattatttgggtagttctgactttagaatcgtgttaatgttccacatgccctaaaattaaatcaatctgtatgaaaggtgcactcaatggaatataacagaaacaactgaacttaaatgtattttaaatgaataacactctttgaggggattggcaatgttaacccaggtaacttaagaatgtactattttgacactatactataaggctaaagacaatcataaagaattgtaaatacttaggagatttgttttttacattgttatgtgaggattagcaattttaaatctattatatttgtattcttggactggacaaattaataaatacattgtgggtaattggagtcaggtttgtctgtgttggggaattgagttacacatatggaaagaaggaaagccagcatgaagcacattatgttggattagaatttgttatagtatgcaatacttctttttaatatataggactatatataaatgtatatgtgtgtgtgtgcatacctccatttcctacctttttcactgggtgggcttacaagcaatgatactgagtaacaatatacacattgcagctatatcttagtttcaaaataaccattctgtagtgaaaggaaacgagtctttgaacaaatggctgattacaggatgaagcatggaaagtaaacatgagcctgaaacatcttgtaccagaaactaaggaagtgctcaaaaaatgatgagtacatgtcagaaggacatgagagtcagccttaaggtctataggctaaaatagctttattttacctcactttttaaagatattaataggtaaagaattttaggttgacaaatactgttttgatacaataaggatatcatcccactggcctccattgctgttgagctacaaaatagtaagggattgtaatctgttcactaggaatctgtgagtccctactgatataaacaaattgggaaaagggaagctcttcctaatagatgtagagt

SEQ ID NO: 122030 - DNA, 1710 bp, Homo sapiens
aaatttttaaagcaggggaactttacagtcttcaaaaaataaaaaatcacacactaaaatactgttcttttctgaaacaaaaaagcataataaaataaaaagcatctttcaagactttatatatttgttataacagtcttgtatatgaaatgtcttgttttaattggtacttccagttgagcttcttttattttttaagaactctctaggtatatattagttgttcagaattatgtattgcaaatattttcttttatttactttttcatcaagtaagctgactttctaggtcgatttgaattttttagatagttatatttttccgttttttgttttatctatgctgttaaaatattttgattgttgcttttatttctttaattcatgttatttttaaacatgcagtgaggtgagaagtctaactttagtttcttgcaaagttaaaaatcttattttttattgaatgacccatacttttcccatcgatttcagatgccacataaatttatttctgtcttgtctgttcttgctgtttgttatctatttctgtcccaatattgttttgtcagtgtagcattttattttgtttgtatacctaataaggcaggtctactcttcatcattctttctatttgttttaatggaacatgttatgtcattgtatttatttttatagtgatgctaaatgctgacaggaggaaggttattgataacccagtataacacaatacttgaaagtgctgggttttgactcaggtagaattgagtttgaatactaatacatgaattgagaggtaaattttttcacctcttttaacttctgtttcttaatgagatgacaataatgtctacatgacagtctaaagttcttttgttaaaatattttataggagttcctgggtactcatacattaaaaaaaatttcctagctaaattctaaaacaaaattatgaaaatacgtgttaaaaaattcttttactgccttgcagctgtagtagaatcagaggttggttggaaggtacctttactatacaagtctattcagcagccccaaggtgggtttgtcttaaaccaacagatgaaaatatttcctgctttcaaagatcttcagtgaaagaatcctctaatgaacaagacagaggttttccctgagcttttgaatagtggtaggttaattggttctttatccttgtgtttatggaggagtattgtgacatgctatgaaatacctagtaaaatattaatgaattctcaatcacagttgataatgtcatccacagctttttccaccgtcatggcatttattacatctccacttggatatacattggctggtgctagaaattctttacatgctgggtgaaaaattgagtaagtttatggatttatgatttatattctttttaaaatcagcttttattgctttttaaaattacataagtaataagtgctttctgatatttaaaaaaaaatcaaatagtaaacaaagtatgaagtaaaagttttactcctttctttccagagataactattgggaacagcttggtttatctttccatatttaccttctatctgttagtatacatatatagaaactcataggtaaaattttgtttttgtttttaaccacagatatgatcatcatactgttcagtgtgatctttcatttatcagtgttttagcgatctgtttatgttagtacctatagtt

SEQ ID NO: 122031 - DNA, 1257 bp, Homo sapiens
ctactgtgggagcaagttacttgagggtaggcactgtctattagattgggcaatgtgggtgtgattggtgactttaataagagcattttttgaggagtagcggggagcaagaaccataagagaatgtttaatataaaatgttacaagatagagaattgctgccggtatggcttacaacattttttgtcactgcccatgataattatttgaactatgattaacattgtctattttggtttcagggaaggtatcaactctacactgcaaagcagacaatattaggcagcagtgtgtactatttctccattatgttaaagttttcatcttcaggtaggatatcagatgagtattttgatcactgcatgaatttctgtgtgtattcacacagactctagttgtttattttatctaattattttttaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaaggtttgacttgtttcatttgatttttaaattatcagctttttctccccacaaggagtattcattcaagaaggagagaaattagtcagaattacagctctggaacctgactgcctgagttgaaattcttgccccccatcctccttttattaattgtgtgcttttgggcaaatgacacctcagcctccacatctgtgtaattcttacaacttaccagaatcattggatgaattaaataaattcatatacatgaagttattaaaacatagtagtcattgaatcagtagctattctcttgatttatgacagtataagtgtctgaaaattttaaagcaaatgaaataatctttattttctgaaatttttatcatatattacagtaagattcaagatcagcttataaaaaaaactttcaagaccacatcattatgtgtattctgacttttgaggcctttttggaatgtgattaagattgttttgactgtgccctttttttcctacctgtgataatcattccctctgaagtttggtttttaaaactttatattgttaccgtgcctagcttatagataagtaatagattctgcctatgaaaatgggagcttatatgaataacaaattatggtaattcacagtgagattccctgaagtctcaaccc

SEQ ID NO: 122032 - DNA, 1046 bp, Homo sapiens
ggggagctggtacagttgtagggctcagtttctctctgggagagcaatcttatattgtcttgtgtccagagcctgaaaacttgcttgacgtaatttttatggttttcagctttacagtgggagatggagcaatctgattattttactccgtcttgcctggatgcagatgttcactgcagttatttttaagagagtactgccttaatgggccgagaattgtgaaaattgggatgatatgactttttatgggtgaaataaagccataaaaatgcagtttaatatggaggtatttacacaactgcttcacacttatgcttctattctgccacagtagtggcatgattgttcatttgaattaaactttagtttcatgtttagtatggctgtaaatttgtagcctataattctcatcatgttttctttgcttttgtttactagattgtctcttactcattctctatataatgattattagtgttttgcccatagtaactacctagataattattgctgatataaatgctgaagtaagtgagggaaagctgacatggagtgaggttgggagaaaggcagcaactattaaaaggtcgttcagagctttataaattattattaggagttttgattttattctaaatataataggtattctttcaagagttttgacttgggaacaagataaattgatatacattttaagcagattttttacttagtgtatagggggacaaaagagagcatggaaagacctgtgaagagtgctattgtggtggtttaagtgtttatagggaaaatggatagtttcaatgtatatttggttattaacttaataggactctgaaggattagatacgaggttaaaggaaatgcaagaatcaagaaccatataggccactggtggcaccattttatgaaaggctgaaaacaaggacagcatcaacaggttttgaaagaaatcaaaggaggtattatttgcactgtctgagcaatccaagtataggtgttaggcagtttaacacggaaggtctggagtgcaaaggagagat

SEQ ID NO: 122033 - DNA, 4043 bp, Homo sapiens
atgcgtctgtaatcccagctactcaggaggctgaggcaggagaactgcttgaacccaggaggcggaggttgcagtgatttgagattgcccactgtactccagcctgggtgacagagcgagactctgtctcaaaaaaaaaactcatctcaattaataaaaattaaagttcttcattatcatttaagacacagttcatattcagattttaggtaattttaaacaggagtcagttattgaaagctaattattccaaaacacagtaaaaatctatatgtgatacatttaaaggaaaatggagaggtggaaggaattctctcaccatcatcccatgaaaccttttgaagagacttaaactgtatctacgccatgtcatacgttttattgatagaacaggctcagtgagtgatcctctgtaatcctgaagattacagaatgagcgagtctttatctaggacataggttataaatatgggttaatttttaaagactttgaaatcaactaggaagaatagcaagaaattgctatcaggaattaagatggaacatgataaataacagctttccctgatactttagtctacattattccttttttgaacttctattgtataactgtatgatacagtttaaaattttattatgtaactgttaacctagaatgttttatgtatcttaaacttctttttttttttttttgagagggtgtctcacactgtcaccctggctggagtgcagtggggtgatcttggctcactgcaacttccgcctcccgagtttaagcgcttctttgcctcagcttcccgagtagctcggattacagggtccccccaccacgcccggctaatttttgtgtatttttagtagagatggggtctcaccatgctggccaggctggtcttgaattcctgacctcaggtgttccacctgccttggcctcccaaagtgctaggattacaggcgggagccactgcaccccatcttaaacttcttttttttttgagacgaagtcttgctctgttgcccaggctggagtgcagtggtgcgatctctgcttactgcaagctccagctcctgggttcacaccattctcctgcctcagcctcccgagtagctgggactacaggcgtccgccaccatgccgggctaattttttcgtatttttagtagagacggggtttcaccatgtttgccaggatggtcacgatctcctgacctcgtaatccgcccgcctcggcctcccaaagtgctgggattacaggcaagagccaccacacccggccgtaaacttaaagatataaacagtatcttgctgatggtgaaggctatggtatttgaaataatttttgagatatatgcagtctttaatagataattttggaaggtcaggcaaagatgtattttatcttttcttaaagttttcattacctgaagctgatcctttaattaacattcacaaggtattaatcatcatccccaaattaaagaggtattgaagctgtgtaatttggaaacattgtccacgtaattgttacatgctttaaagtgttctaaaattaactctcaccttacatttttaaaattaggcaacaactgtacaacttggaaaccttgttacagtccagttgtgattttggtaagtttaaggtgtgtttaatgcaaaagggaatggtgcttcattatagtgagttgcacatgggtccatgatggtataattggcatatcatgataatacagaggaagcattaggccagaagtttacgaatttagtgttcagaaaagtatgactttttaaattttgttgtagctgagatatatagtattttcccaaatctgtagattttaaaggtaaaaccgacttaagctaaaattctctgaagagaattagtacttgttttggaggtagggagtgggatagagaacttaaatgagaactaaacagtgccagacctcatgctgtcttcttgattttcttttctgctttctgcttttgtgtttgcttttggtgtgtgatggattactgatttttttttcttttgtttagattggtatagttggtttttttttgctttttttttttttgatagggagttctgctcttttgtccaggctggagtgcaaaggtgccatctcagctcactgtaacctctgccccccgggttcaagtgattctcctgcctcagcctcccgagtagctgggattataggcacctgccaccacccccagctaatttttatatttttagtagagatgggattttgccattttggccaggctgatcgcaaactcctgacctcaagtgatcccctgccttggcctcctgaagtgctaggattacaggcatgagccaccgcatgtatagctaaggtaataaagggaattgaagggcagtgtgttttagtgcagtctggctgcttctcctttctagtaattttggtgcagtgcagtgtttagaatcatggccttgtcaccctggcttccaaccctagctaattgtgggtcttacgtcaagtaatagttctaactttgttgagcgtgttaagtgcttaacacagtgtctaccattattgatgcctagcaaccaaagactacctggaacacttttggtcaaacagaggtttattagattatgaaaaaaggaaaaatacacattacaaggaaaagctggggcttgtcagtaagagggagtaggaagggacttgtgatatgtttggggctcattctggtgattttccgtagggcttaagggggataaggctatattctggattggatgctgttaattagcaggggcaatttgaagagtgggtattttaatttttatctaggaggtgagacaaacaaagggagcatcctaattagtaaaaaagtattgtcctggtcactggaagagggaggatgtgtttttttgttcattttgtgtgtgtgtgtgtgttttgtttggagtgtgtgtgattgcatagtgccatgttttgtattcagacatggttacagaggttttgtttttgtcttgtttcactgtaatggagtggccctgtatcattattatttattattattattattttttgagatggagtctcgctctgtcacccaggctggagtgcagtggcatgattttggcccactgcaacctccagccccctgggttcaagcaattctcctgcctcagcctcctgagtagctgggattacaggcgcacaccaccacacctggataatttttgtatttttggtggagatggggtttcaccatgttggtcaggctggtgtcgaactcctgaccttgtgatccacccacctcggcctcccaaagcgctgggattacaggcgtgagccaccgtgcctggactattttttatgttttatgaaaattgtttattttcagtaggggataccatggcctagctgttagctatcagcttttaggctgttttatattttttgttttcttaatatgttacgtgatttgtaaatgttaagtattattgtttcattatcatctgatgggtccctggttcatgccaggtactttgcaaggtactgacgaatcaaagaggaaaaatatgctgctgatgagtttgcagttgtgtagacagctagacatgcaagcatacatcagcttggtaaatgaaaaggtacggtgataaaggaatgtacaagctgctgtggaagccaagggctttgtctatctgtgagctcctcactaaatgatgccagatctgggtcttcacagatgggaagaaattagctaggcaaaagatttgggaaaagtttttcggacaggaagaattccaggcagaaaaaaataaaactgtataaacaaagacgtgatgtgtgtaaaaacataaaagtttagagagcatggattaaatattaattacatatggttggatcagaatgtgtgtgagtgatgaatttggaagggataaaagcagagttggctttgtaaaccatgacagagagtatgatttttattttggaactcctgtggagccactaaaagattatagtggaaagaaccaaaatacctttacctttacgta

SEQ ID NO: 122034 - DNA, 1191 bp, Homo sapiens
ttttggtaatacctgctgaggcagtttcagtgaggaaactatttttgttgaccttatagttgtaccttgttagaaatcttaaatagaatactcaacttcattagttggatactattctccagacatggctcagaataactgttagcagttttaaaattaaatgtcccctcaaaggatgaaattctacaactgaagactactggtgaagacaggcagaaatatgttttttagaattcttgttgatttttcctcttaagttacattacactttagtcgtacattttatcaatatagaagattgacgttttaatacagtctagctattgtaatcttgaatgtgtaaagtaccaaggcattttctgactttttatacatgtcatgtataatatggattcaaataatgtaaagaaaagagccgtcgtattatggtacttagtatactttttatgagattgaaacaattttcatttcagattgattttgaatcttgaccctttaccaactaattttgaagaagataccttggaaatatttggcattcagtgggttactgaaacagcattagtgaattcatctagagaactctttcatttattcaggtatttcttcgttataactttctgtgagtgtaggtgttgttcacttttgtaaattacgttgttgggtggcttctaatactgatattacaaaagaccagaggaattgtgctggttgctcacttgattatcttaccagtaacaataatcaagcagcaatgcctgatgagtaatggttttaatgagttgcgttttcagaatctttattctttgcatttgacacatgtattgacaaatatttaaggctttgaactataatttttagaagaaaattaaaatatttttgttgtgcaatagccatagtctttcagtgatctttagagtatggtcttaacaaataaattgtttagactgtgtaatagaaatattaattatttggacaacatttaaaatttttttaatgaaaaattttaagcatacacaaaataataatataatgaacatccatataccctccttcagttgcagtaaacaacaactttttattacatttccttcatctgtcttgtctcctcttcttttggcctaagtatttgtaaggaaatcctaggcatcatgtcgtttcacccataaatacttcagtatgaatttctta

SEQ ID NO: 122035 - DNA, 1095 bp, Homo sapiens
cgagtgctgccaggcgtgggcctggtgggtctcgcctcctccttggagggtcggggttggccctaggggttgctttcctaatttccaccccgagccggggagggagcgttctccaccctgctgctgggaaacgggcggagagtggtttagaaacgttgcggagggcgcagttctaggcaagcccgggacgctatgtcctgcagacatttctttgcttttcaccttgtcctgggctgcagagcccgacttagtggccggatttcgaggtccctgccacagccagttggttgtgcattttgtcttaagttctgacagccttgatggacggagggcgagggggaattgggaatttggcctctgggtttgttcgtttgtttttccttcctgctggcggacgtcttgagaactttctgaagtaatccccactctctcggccccacccccccccccccaacaggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcggtaggtaaaactcagagacattttccctcatctgattattcaccagttttttaggaatgttagttatttcagcccattaaactttggtgttcaccaagtcgtgttttataaatcagcttagtatatcataagggtacaaatgattatcagttctgctggcttcttggtaagggcatatctaaagtatttggggtattagggaaaacttccttggtaactgatgttcccttactgtagggagctgggcactaatttttcttctacttaaaatgaattcctaactatctgagccttttgcagtagtatttccttctaaagagtgtgataatattctagagctttccagtaatatttaagagagacaaacattttttattgcccctgttccttctaatcct

SEQ ID NO: 122036 - DNA, 1001 bp, Homo sapiens
atattagccatatataaaacggaggaaagtaggtgctgtcaatgagtagcagcagcaaggttgaaatggtgggcataaaagaagaacatataatcctttaattcttcatgagagactgaagacatagactgctttgggatttaattcattaacatcttctgtctggagtgctcttaaatggatttttaaataaatgagtactcctggctgttttatgaaacagtggcagatccgtgaggtcagtgggcagatctgtattaacaaggatgtggatttgtttacatggaagcaaagcaataggttataattaagaatctgacttactctaaacagtttgcatgtctgagcataacatgtaaaagattggaattatttgatttccagattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacatgagctgcgctctctattttt

SEQ ID NO: 122037 - DNA, 2191 bp, Homo sapiens
taaagtcaccagctcaatcctgatttggggtgactctattggcagttccatcaagctgcagctgatcagtgaatgtcagagctgcagccattcttcaggagtgtcaccagcctgctgcgggttttttgtctttttgtttttgtttttggagggaggagtggtttagcttgtcttgttgttcaattgtagccagactttcaaattgcttacctttgggaaatgaaccgagaggtcatagggaatataggtatctttagggcatccaaaaccatacacaaagtgattacttacatggagactagtaatgattaccttgactccaagccaatcaatggtggagcctctggggactcattaaatggcatttgtggactctgtaacctagcttttgagctgcatttcaggaaaagcagtgacagcctttaatgtctaattgacctcttctctttgtttcactttcattcactttccatatttgcctctgatgtggtccctaatggcagcaaacagcactgctcagcattttgaacttctgttcagagcttcagcacctcagtttaggcagttgtgtcatggtaagtgtttgagaattctttatactactcaattacttgttctctttttcttcctatgggtgaaatgtatcctgactcaccctaccccacacacacccacagtttttcagatttatggttctcttctttgtcccttgctttcaaacatttttcttaaattggaaagtatgtctttgaaacactgacattatttatccatgagagcaaggaaagaagtatagtgtggtggaatagagtatagttctgcctcaagccagatgttgtctccgacaagctaatcacctctctaggtttcttcacaaactaaggtgttagtcatacctaaatgccgatagttcagtaagtttttcactaagctcattttagcttttaaatcctgagatacttttcttgaaattttaatgataatagataggtttattttatctgtttgtttttgtgtttgttttactgtccttactggtcaaaacagaaagattaacaccctatgttggaactcttttttgtgtgtggaaattttactggtctgtgaaatataaaagcctagggactgttggactagataagcttcaaagtccttccagatttttttttttttttttttttttttgagatggagtcttgctctgttgcccgggctggagtgcagcggcgcgatcttgactcactgcaatctccgtctcccggattcaagcaattctcctgcctcaacctcccaagtagctgggattacagggatgtaccactatgcccggctaatttttttgtatttttagtagagatggggtttcaccctattggtcaggctggtcttgggtttcaccatattgggcaggctggtcttgggtttcaccatattgggtaggctggtcttgaactcctgaccttgtgatccgcccgcctcggcctcccaaattgccgggattacaggtgtgagccactgcgcccagcctagtccttccagatttaaaatacgattttatgtgcccttgaaagagctcatggaaagagttaaatgttttaatctaaaccacataattatatagcttttaaataatactgagatataaaggacaatagaaatcttgtgtggagaaggtgtgcatgtgtgtgtttgtgtgcacacataccgtaagtgaatcttccagtgtaactgactggaagaattcattcctcctcacttcatcccctgttccctaaaacaatgtaggtttaggagatccccagaccattccatttctgccttgcattcacttagtaggaagacttgaattagcaaaatgattgcaagattctagaaaacttctggtatgctagggagtatttgctttaagtaaccttacattttgagaaatattttattagagtcaatagacagggtccctgacctaaaatgagtaccatttgaacacctcttagagctcagtgtggcttcagaaatgcctcaagatttggcagtgtagactaagtaggcctcttttgatgacatatttatctctgtgtccccatggtctttaaaatcttgtggttaggtcttattaaaccctaagtatgggctcaggccatctcagtctctagaaacagtcttgggagcccactagattttcctcacttct

SEQ ID NO: 122038 - DNA, 1077 bp, Homo sapiens
gtttactcttccagtttgatcccaggttaagaagcgtatgcttcttatgtgtggcgaattgttgaatttattacttgaagttattcattgggttttgaagctgctgaacagggttaataggtagattttaggtggaatgtaaaataaatcattgtttatgaacatgtattctactgctagatgacagcatgcacctagagtatgttttggtaattctgtagaagaaattatcatggacccagtcactccttagtgaatgccttgccatagttgtttaagtaaggttgccctttgtttgaaaattacaaactcatttgaaaatgaatctgctgccttgcactattaaagctgctattttaattatattttagttttatagaactactcttgtacttctattgaatgagttttgagacctaaccagcagaatgtgtagacttggggacctgaaagatactttatgtcttaaataagaggttcatagaatttttcacttttcatttctgaataaatactgtgccattttcacagtacacctaataatatagctttgatccatccatttgtgtgttctagatatgtagcagtgctgcatatactcattatagtagaattgttttgttctcctaagtagagattggcaaactttttctgtgaagggctaggtagtaaatactttaggccttgcaggccctatgggctctatcacagctactcaatcctgctgttgtagtgtgaaaacagtcacagacaatacattaatgagtgggaatgtctgtgttccagtaaaactttatttacaaaaacaggcagtaggctggatttggcctgtggacagtagtttgccaactcctgctccaaactattgagttggtggtctctacaaaatcaggtccttctgtatctggaaatgaagagttaatttctccgtagtttattctctttgctttgacatcagtaacaacattttaattctgaatactaatagcatggagaaagaatattttaaagatattttaggaggaaacgggttaactggatttaaagacattgtaaactgattccataggcatgttc

SEQ ID NO: 122039 - DNA, 1617 bp, Homo sapiens
aaaatatattatccagtacttgatgggtactgttgagggggaaatatctcccaagagtttagagttttgttatgttttgctgtttttttttgtttttgttttttggctttaccaactcagatgtgaattataggtaagtgggaaaaatatatcttctactttcttaattttccacttagcattagctgactttttatatgatgtgaattcattttgttctctcaagttgatttttttagcctaaccattcatatttcagtatgcagtgaataagaatttaagcaaaacaaattttacattttccctaatagaaatctattctttcaaatgtatctacttagagttgctaaaattccaaagttcttgcaaaaatatcttttagttttataaaattcacatagaatgttgttttggcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagaggtgagagtaattcataattttcatcattgctattatggtagccaactgaagatttggttttctgtaattgctcataataatgtgttttttatttttaaatcaagtttatgatgccttctgactactctgaaatcaatagagctgattcagtcattgtgaagttatttcaaacctaatatgcttttaaattataaggaaatgttcttctctatgctcttaaaatttttgtgatgctatttatgtccccaggaaaaaaaataagcgttggttgaggtaagccaaaatgctggcagggaatgaattagagaaaggtaggaggataatatgtaagaggacatttgcttgcagtgggaggaagcaaagtgatatttatcctggaccagacttgggggttaaaatttgtaataccatagttaatgagtctcatttaaaaaggaatcatgtcatatatattagtctacttgctttttcactaatatctctaggacatgtttccagggtcagtgcatatattatctaactcttttactgtaatagtgtatgttataccataatctatttaacattctccaaatgatcaacatttagtttttccagttgttttccttttacaaactacctagcactaacattcttctgtgcatagttttttttttcttttttgagacggagtctcactctgttgcccaggctggagtgcaatggcatggtctcagctcactgaaacctccgcctgaccagttcaagcgattctcctgcctcagcctcctgagtatctgggattacaggcacgtgccaccatgcccagctaatttttgtatttttagtagagacggggtttcaccatgagcctgtgcatggttttacacatacttactattactgctgttggatagagtcctagaggtggtattgctaggttaaagagtatgtacctgggcccctgtagtacatactgtttgtcatatactttttccctctgctgc

SEQ ID NO: 122040 - DNA, 1286 bp, Homo sapiens
aggtaggtagtatacattttgaaaatttaagtagagataatatgaggatattaaataatctgctcagagtaaaaatatgcaatatgggattcttgagagagagaaagaaagtcagaaaggtagtataggtatagactttatcttattttgctttcaaattccatcattcattaaatcaagttgggaagtttcctattgtctcctaacagtttgctttctggtataaagccagagtctttatagtgacacacactacgtcaactgtccctcatctctgatctactcatctcgccatcattttgcgcctcctgcatcccccgtctcactgttcttcactctgcttgttatcctgccctggactgcccttccctttgcctagaatgctcttcctccagatacctgctttgctcaccctctcgcttccttcagggttttactcaccacatctctgaagcttctctgactactctgtccatccttgacactttctattgcccttccctgcttttatttcctcctgggcacttttcacaaatttgcgacttactttactcatttggttatcatctccttctctcttcaaaacattagtaagcttcatgagagcagggattttgttttgtccactgctatctccccagtgcctagactattgcctggatgatagtagaagctcagggcatatttgttgaatgaatgaatgaatgtgcttcatgtagactgcagtttagctaatacagctagcaaaggaagcagcagtgagaggggttggaggagatccaagagagggagttatgtgaggagtgtcagagttttaaggaaggagtgtgcagttgtatgaaatgtcacaaatcaaataatacaagtttgaatttagaataaacgggtgttcacgtgtaaataagatgtgcaggctactgggttatttacaatatttaaatttgcagcaactgaatttttttattgtttaaatgtgaattggccaagatttaacttatacttaatgtttatggggtgctttgacctttaaaaactgcatttgcgtagtatttcagcttcaatcccacgaggcagtgtggtgaatgttgttacatacttcaagtctgcgtttacagctgaggaaatgctaagacttgagtagatgccttttccaaggtctctgctaggaactagtcaaacaatgcaaaaaactccatcttttaaccagtgttactttcttttatttacacaactaatctgatttagtcaattttactttgtatgtgtatttgtaagctcattaaatc

SEQ ID NO: 122041 - DNA, 1180 bp, Homo sapiens
gctgtccagtgaaacacagtttagtcctttctacttccctttgccccaaacacacatatttcaaattcttttctctgctaataggaccaagaaagaactgaagctaatgaagtctgtgaatatttagagtatacattatcataaaccaagactaactgaatatgaaaacagaacaagtggtgtcagtaagcattattttacattatgtagaccattagggtattttaattaccctcatagctctttcccaatgttttccattattaagaatttattaaacgtttgttttcaccctttgtgtgcaaggcattgtagtgggtgttgatcatatacagagacatgagatatataatatagttcctgccttcaggctacagagaagataaagatattaagataaacatataaacatatcccttatttttataaacagagtaacagggtagtaactaatgtgtagacattaaagaaaatattagtcgtgaatggctgaagtccagctgtactggcaaagtgctgcatatgactgtgataataacgagtaaaatataaagctaatattaatcaattttaaaaactttatgcagcttctggcgcttgagaagaaacatcacttataagaagaaaacttagccatgccatttaaaaaatttttatactagtaatggataaagatcttttgcaaagttagagtttctatctactttctaacccacaatttatcttccattttcaattcacccagggtagttgctgtagagcagtttgaataatcagaaaaagccatatataaatttaagttctcatattttactgtagtatttcagccagtaaaatcataaatcttgatggcattcctttaagtgtagtcactattcccattaagaaaagaaaaagttgaggtaagagggagagagaaccttttcttgtggggggcatattggagttttgcctactgattactgttggcccccatgacttgactgctgaattgatagttattatggcttgtaggcagcattcccagaataaacaataaatatgcatggcttgattattaatgaataatctttgaataagtatggtctatttatgctcagtactatgaagaagacttatttgtaatactttaaagaagaaaagcacatttaaaaactagagaccaatgttgatgagctgc

SEQ ID NO: 122042 - DNA, 1731 bp, Homo sapiens
ggggaacacactggggcctgttggggggtggtggggctaggggagggataacattaggagaaatacctaatgtaggtgacgggttgatgggtgcagcaaaacaccatggcacttgtatacctatgtaacacacctgcatgttctgcacatgtaccccagaacttaaaagtgtttttttttttttttttaaagctgagtgttcctggcacaggtacactgtacactttcactttggagctaggtctgctaggctttagtagcattctgtgtatctttttgtcaaagctattaaaacgtatcattgtccttaccaatccccactggactgtaagcactctgagaatgggcactctttcttttctgtcgccagtgtctggcacgtagtagctgttcagtaatgctgagtatgacaaattgtattagtcaatagattaccaaagtgtatctttgcacctaagaaaatgagtaggcaatgtgaggtgagtatactttgaataatcttgaaatgcactacagtcaaatgcacgtatgatttcttttatttggataattctgttggatgtttatttactatgtgaaaatattgttataaaatgtatgacacttttattccttattagattatgttatatgtttcatagaatgatactgcttttcactcttgatgatcttggtttctctgtcttatttagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggttagtacaaagccttgatgaagtttttttcccccccagcagcaggttatacttattatgtagtggttttcataataaaagtttgaaattatgtaacatgtacttacaaaaataaaaaggaaatatattttgagtgtcatgtttagaatgctgctgcttataaaaaaataagtgttttactatcctcttcagctaaattttatatgaatatgaagggaaactataccctttacttcatgtttcttaaatcccaagtaactttcagcagagctcctgtttcttctttttcatatttgcagcacagatgattaacacattttaaaaactatttccaaatcaaaatctacctctctaatgtgatttgtcagaaatggaaaacaatttattatagaacatttttaattaaatcttaattacatgtgcaatacatcacccagatttagaagctcatttaaactaattatgttgaaaatgcagttgcatgctaaatagacgaccacacttgcagacctgcccaggtgtttccgctcctttctatttaagcatttagtttccttactattaaatgtcacctgttaagcatttgaaagcttgcacaagtgcatattcatttagtaatgccatagtaattttttcttaggatacaaacaggtgtttttctcctaaccttgatcatggtttttctcattgtatgttacatataatcccagcattttcatgaagttaaataatgaagaagtagaaactttagagaaattttctgttatttttaattaatgaatactcttgtattc

SEQ ID NO: 122043 - DNA, 2145 bp, Homo sapiens
acatattacagttaaaatgccatggcacatcctgtgaagtagctaaagttgccacataaaggtgaatttaagtgtccaagttaatttggtctttaagccatgggaccaggatcccacccagacctcatgtgatggaaagggagcttcacagattggacaaaactggcctttactgggaggagggaggaaagatgaaggaaaagctgggtttggggagagagaggagcatgagatactgacagtgttgctcctcagggctctgcggtgggtctgttgttgcagcagtgggagcaattcatctggaggagagtgaatcgctgctttgattcttacccacttgcaaaaactgtaaaatagaaatataatttcagcaaatacattttaaacagtttattgaattttatccagacctgataaaatgcttgacccatagaatttgaatgaaggccagaagacacttgaggcaaagggaagagaaggtacaaagatgagaagtgaaactgtgtgacttgtttggaaactccagtatttcagtgtgaccaaagcataggatttgataggggaggctgcaggagatggaattggatggaggctcagggctgcctcagtgcacagctccatgcacatagatgacagtgattgggactccctgtctttggcagtgtggagtctattctgctgcgtcatagaggtctgtttgggtttcaccaagagatttgcattttatcccttcagccagtgatcttcagggtggtccagtatacagccaaattagtcaaggggagtcacagatactttagactttgcagataatttacttttgctaaaaaattagaacatgccctagagtaggaaaatacaataaagtaaaaatatcggttttccttaatcagtgtattcaatgaagtcccaattaaaatgcaaacagaattttttaaaattgaagtttgcctaaaaatatgaaaatactcaggaacattctggaaaagaagtgtgatagaggagtattagtcctgattctcatttgcagtcaaacaatccatgacattccaacacatatgctttaaaaaacttagttattttacttggaggactattgatatgggagaaatagcatatagataaatggaacagaatagagtccaggaacaggtcaagaggatagtgggaaatgtatcgacaactcccctgggaaagtgttatgtttctgttgttaaaaaaaaaaagaaacacaaataaaaacagttttatatcttttcttccttttttgtctttcagaataaaaacgttttgataccaatgttgtctaggatataagcaaaagggtactttcatacaatttttatggatatataaattgatgggaacattgtgaatggcaattctccacttgcatcaaaacttctaaatgcatgtaatttactataaggatatattttcaaagtttgccaagatgaacatacatgcataatacatacacacaatgatattgcagtattatttgcaataggaaaaaaagcaggacatacatcaatgaggaactagttgaattatgtcacttctatgaaacggaaggaggtgggtctgtatgtgcagatatagaaagatctataagatatatcattaaatgagaaaagcaagttgctgaatggtgtatatagtatcattcttttagtgcaaattcaagaacagaatttcatacacatttatttggaagagatcagaaaaacaatgattatctttggggagagggatggttagaactgagtgtagagaggaagaaacttcttattttagacctttctttaatgtttgggtttactttttacttgaaatttttgatttttgtttgtgtaatattttacacatcaacaggtgtatctggatgatgagatttgttaaagaaaaattattcaatcgttctaggtatagggaccactacaatgggattttgcagtgtctgagagagattgggttcaacagcatgggcaagtgggaattaatagccaaggagcagattagaaagtcagtaaattactaagaaaattactaagaaacatcaggagtaagggagattctggctacaccctctttaaacttattttaaagatcatgttgttgttactctgcgttttgtgatatttt

SEQ ID NO: 122044 - DNA, 1200 bp, Homo sapiens
aaaagctgaagcaggagacctttgtgaagcaaaatgatcagtttagtttccgcagttggtttaagccatgcacacagggagcttcatctttgtgtgttttattctttgggtttacttatcttgtaaactgtaatgttgttcagatacctctaactacatgttccagtttttaaactgatcaatgtgaaatctgtaaaaaaggactgtttggggacttataaaaataaattaataaggtctgtggcatttggttttttaaagttttttatatcttgggaacaatacttatattggattctatttattttgatgactttgtttcacactgtgacatattgggcatgggtctataaccttaagggaccagtagatctcattctaaactgtattatagggaagtttctttttttggcagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgaggtaagccaaaaatatttagcagcagtattggatataacactatagatttttaatctttagatattaatgtttactgagcatcggtaattgagcattggtaagttatatataatttgatgtgttgtatattttgattttggaaaaactagacaaaatcatgttttaactaatttcactgcttttgttttggtttggcattagtgtttctgggtaaactattaagtatatattttcatattgctaattaataataaccaaatacaaaaaccagtaataagtaacaatccactttaattcatattacactttaactgtgggcaatacatgcttaactttttattagttatgttaaagatgatttgctattaaaaataagaatattaataagattgtgagatgaatgcttattctgtttaatctgtagtttctctaagtgtca

SEQ ID NO: 122045 - DNA, 1021 bp, Homo sapiens
ttcacatttgtattttaaaacttgtttttttagtttcattctgagaaattacattgagggtagagcctgttcattaccttatccatgcatttttctgcttatttaaattattttacttcaccaagccattcatttttttagaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaaggtaagactaattttttaatgacctaagttatatggtagaaaggttttggttgttaatattggagatcttttttattgcaagcattcttttaagtaacttaattgaatttgattttgaaaattttccttagttttctgatggggaagagagatcactcatataaagatttaattcaggctttatacctgtaatacctcatactgtaatattcatggcttatgatatttgtatctcataaaatttaccaaaaccaaaaagcacaatttgaactcatagggacatgggccattctggga

SEQ ID NO: 122046 - DNA, 1019 bp, Homo sapiens
gtccagacagcgcctggacaatttggacttctgcattggtcgtagctctccacatgagtcctgagacaatggctccattccctttttcagcttcatttcccagggaaaagtagagagagctatcctttcttctccatatgttcttccccacccctaaaacacttttatgtgtcatcttagcagattggaaaggagtttagaatcaatgaaggacgttagcaatgggtttgtacatttctcttttttatttctatgccttgcttattttcaaaaacaggttttaacttctataacattttccaaatagcactgctggaaaaagaataaatatatttgcttttttggtatatcagactctgcatttccttcctttaaaaatttcttttgccatttttaactttatttcctgaaaaaattagcattaaatattatttttatccatagttgaaaaaaactaaagcatccattttacatttctatattgaagaagtttgaacatataacacatatatttacagtttataactcacttttacatatgttgcctcaatgcaaaattttgcttaactttaacacagcttaaacataatattgcccatatgacagtcttgcttttgatattatcttataatctacaatggtaaaagctgggaaacagtttcaaagtttgtagcttggtatgtcaaacagaatttgactttcacaatttgtctaaaatctttttgccaaaaatgcacaacacagttttataaagaaagggggaggagcttagttgaagcaatttatagaccgtggagtgagaagtgatgtccagagattaagcagtcaacttattcatccactgtggcagatggttttctgtccttcccttgatggtttccaggaataacacatccatagtcttctaaattagctgatttgtcaattgatttgaatacatgttataggttgttctttatttcctaaattttatttttgcagtttaacttgttaattctttttctttttgaaaagagaat

SEQ ID NO: 122047 - DNA, 1581 bp, Homo sapiens
tagtttttccagttctccataatcaacgtactgttttaacacagatttggagtgcaaaaacatcattgtatttgaggaaatggctttcttttacctctctaatcatctctttcatgaatctttctttaatttcaatcagagtttctttgtgaccagagtcaagactcttttatgtattcagaagctgcttttgtactaacagaagttactacttttttcattctctttgaacagtaaaatttcaatatatgtactattccttcttggatggcttcaaagaagttcatacatttgattcttacctattgcgcttcaatttttattacccgtttcctctctttatctctgtatcaagatatggaacatttcttgtgtcattttttggtttacatgtgccttaggaagagttgctggtttcatctctgtgtttattttaaacttattcattttaattctcttatgccatctactcttccagtctccgtaaaacaacagatgtttattgagcatatattggcatgtgctagactctaagggtatggttataattaaggcatgttctccgaacttggggagttcatagtctattcaggtagagaaatatttcagcatgtaagaaatagcaaataatacgaacatataagagcagaggaaaggtgcatggtagataaagtatgaacctgaccttgaaggatgagtaagagagtgccaagcattggaagagagggggcattccagagccatccagcctcagttgaagatttcaggatgctgaggcatgaaagcaggagtgctgctgagggcatggtggaggttctggtgggtctacagcaagggtagtgggtgtggacatgaaagggaaggggaaggcgggctcaaagttagatagaatgttcttgtatatcatgttatcaaaaagacagccttcctttaatggtacctctgtgtatatgagaagaattaggaagaagaaaacctgggaggagactgagaagttaccagaggcaagagggggcataagagcacaagttggtgtaaaagctagagggggccagccaggaaagagagctgataggaatttcagatgctacatcaaattcacattatcattcccctcttttctccattgatgctttctttcattcccctgttttgatttctagattcaaccagaaaagtccttcctcagaatagtatgtcttgatcagtttcagcaggattcagaaataatgagcatttaagggttggccttttttcttgattcattaccacattgagcattctaattacattttggtactatgtagcaaagctgtctaaacttgctttttttttttttttctatgacttcattgacatgtctctgtgggctcttttgcaagtaaatattgtgttacaatttgccttgtatgtatgcctgtgccttattgcctgtcctttttgtgtttttccatgttttttcactgtagtataacttgagaataatcctcttttgagttttaaacttgttttcaggttctttcatctcactgtgaacctagcctttacgctgtcctggctctggttcattctgattgctgc

SEQ ID NO: 122048 - DNA, 1061 bp, Homo sapiens
tataagcctgtggtcaggtagttgcgttggcaggatgcccgtctggctttgtgctccggagggcacattaccaccaggtgcagggatctctgcttgctttggtctgttcacagacacaagctgccttttctggttcttgcgtgcactccttggtttcttaagttcagctataggtatatatttttttctttcaggctcacttcctgcctccattatcctgtaccgcatattgtatctgttggttgagtagagagagattcatccagagtcatcagcgctccaatagtcctttatcagattaaggacttgagggaaatgtgcattatgctttagtaggcactctaaaagttccttgaattggattcttctttccatacttatgttctgagtactaactttgttttaaacttctgcgccaaaagttggcttttctgaactctgcattttcaaactcttcccttctgttatttgaaaatcagataagtcaactcattgtaagatggataatttctttactcacgccgtgatgaaataatgcgattatagtactctgtacaatggtacatatggtacttgcacatatggtcagttaacaaaaactgccccttctttctttactgtgttagtctcatcctcttaatgttgctgcggttaacattctcgatcttaacttcgcggatctaacacagtgtcctttaaaaaaggcctttatctacatgaattgtatataaatatccacctccgttttcttctagtattgttaatgatcttatttatatttaatgtgagataagaaggctctaactttataattttgttagtgactccatcatcatttgttggaattctatttttccctgctgatcagtcctataaataccataggccctaaattcccgtgtattcttgggactttctgaacggtctagtattctttggctccctgtggtgatcctggcttctgtgatgctcttattgctctaggtttataatgtgttttaatatctagggatttgaacgatgcctggcatattgtagacatcactaaatatttttgaaat

SEQ ID NO: 122049 - DNA, 1036 bp, Homo sapiens
gaaaccccatctctattaaaaatacaaaaattagctgggcggtagtggcgtgtgcctgtaatcccagctactcgggaggctgaggcaggagaatcgcttgaagtggggaggtggaggttgtggtgagccgagatcacgccactgcactctagtctgggagacagagtgagaccctgtctcaaaaaaaaagaaaattgatgttaatctcattcttctttctctttctctctaaattatcttagaatttgtatttaatcttaatattctcaagtttcaatatggcatgtgttggtgtgggtctttatatatcctgtttggtcctttataaactcttattatctgaggtctttcatctcttttgaattctggagaattaattatcaattttgttaaaatatttccttttcttttatgtttgtttttcttttccctcttcttccttgttccctattatccagattttggaaactctgcttctattttctatgtctctctactctctacttgaattcttttctgcttctttctggaagcattcctctctctgagcttcctttgcattgctctatgtgtgtttgttgttgttgtttgtttgtttttgtatccattatgctatttaccccatctattgtgttccttattccaacttttgtatttttcttcttaatgttttctttcagtttgtattagtaatctcttcctttatccattggaggatatttattatgttacttaaattttttggtctgtcccaataattctgcttcatgtcgtataattcagtgcactgcccttctcatagtagtggtacttatctagttattttggtttgagaactccttttaccagggatgccaacttctctgcctgggaatttgtactggacgagggctaaagcccaggccacaggtcctgtacctctgagggagtttaaaaaaagaaaggaggtgagcctcaggcatccccaaactactctggtccttttgctttgctgccattcccccaaatggctcctgcagctccggggttcaccttt

SEQ ID NO: 122050 - DNA, 1029 bp, Homo sapiens
gaaatttgtgtctgttaatttacatgaaaataccactttgtgatgggaattatttgactggacaaaatcagttaattgtcagatctatagtttgtgctgtcttggaacattgtctaaatgagttcttgattttaatacctgacttctcgaacattccatttaaatgaaaacatttcttttatagttaatattgccagaaagcagcaattttttttttttacttgacatattttcaaaatgagtcattctgtactgtgaagttgagtgggcccttgggtggtaaacttttcaagagagtttgttttactaaatggggatctgcaggaagtgggcatccatgtgatgaagatacaaagagcttgttcttgcttaggtagaaagaagggggtgtggtgttgtactgggaacaatgcgagggaaccagaggctcaggcagggccaaggggaaggaagagtgaagtttatctgactagaaatcagctgggtcaaatgaagatggaaattgcaaaagggtcccgaggagtggggtatgagtggggctgtgtggaatgatgagcttgcagggatgagaccatatctctttggatggggataaattccactattacttaatgcttgatagtttactaaatagttacagtattaccttatgtaatcctcatgataaaccatacagaattggtactgtcctcactcttcaggtgaagatggtggagagatctaggctaacgtggccagtaggaagcagggcttggatttgacaccagttgtccagacttggaatccagcattcattccattatgtagtggttattgaaaagctgtatgcagggaagtccttctcacccaaaagagtagccaaaggaaaagatggatgtgtggctgagacaggagaaaggggaaaagcaggggtactgaaatacatgctgtgtggtaaaagtggggatactgggaaggcagaaaataaggaagacagagctagagagagagcatccagaaggcaggttccatggcattacaggtgaaaga

SEQ ID NO: 122051 - DNA, 1033 bp, Homo sapiens
tgggattacaggcgtgcaccaccgcgtctggataatttttgtatttttagtagagatagggtttcaccgtgttggccaggctgctcttgaactcctgggatcaagcgatcctctggcctcagtctgctgagttgctgggattacaggcatgaaccattgcacttggctaattttttttttaacttttttgtggagatggggtctcactatgttgcccaggcttgtctcaaactcctggcctcaagaaatcctccctccttggcctcccaaagtgttgggtttataggtgtgagccaccatacttggccagttttgtttctggacaaatgtttgagttgaattagaaagctctgaagtaatgcaaacaataaaaaagggctatttctgaatacttagtaggatgggctttgcatgtgtgactgcatttattcctcacaactgttgtttgttcatttcatagataaggaaattgcagctcagggaggttaagcagcttgcccaagatcacacagtaagagtagtaggatctagattcaaatcagagcctgcagtttttaaccactgcctcttagaaagtacctactttggcccggcgcgcggcagcttacgcctgtaatcccagcactttgggaggctgacgcgggcggatcacgaggtcaagagatcgagaccatctggccaacattgtgaaaccccgtctactaaaaaacaaacaaaaaaaccccacaaaaattagcctggcgtggtggcacgcgcctgtagtcctatagctactcggggagctgaggcaggagaatcgcttgaacccaggaggcggaggttgcagtgagccgagatggtgccactgcactccagcctggcgacagagcgagactccgtctcaaaaaaagtacctactttgaaatccgttttgttggaggaagaggaaggaagagaaatgtggagaactgaagcattgctcagggaagacagacctgtatcaggtgcctttcttgcagcgtctaggggaagaggagtggaggggcaaagggaa

SEQ ID NO: 122052 - DNA, 1838 bp, Homo sapiens
cgacacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggtgagccggagagagggccccgcacaggggcgcagagaggggcacctggctagggcagggctggcgcgagaggggcccgtgccagcccctcggtcaagctgcccagatgcccaagcgccctgcaattacctttccctaaaggcatttgtggtcacctggccgtgaggggcagtttagagttgaaaggagaattaaaccggtgctgggagggaaaaacatttgtctcccaaaatgctctgggtcacttgtcgttatctattaagaaatggccttaggaggatctaagtgcagtgtgtttgcaacaatagaattgggccctgcagaaataggttacacttttatgaaatgccttgtttataagtaataatgctggaatattaactgctaaccttatcttttacctaaaggttagttcttccctaaatgtcaacatcaaaagactgaaaaattgcaaaagctccagaaacctgcgggtccctgttaaagatgcatgaccaagtgtagtggtgggcagctttgatgcagccttaacctggttctctgcttatctggtattgaacgccaagcaccatcttcaggcttagatgtcattgttgtgtgagcagtaggacaggctagcacatgggtgtgttgggcacaacacggagtcgcccagtgccgtaaacagttgcatccgctgccgcagaatgtttacaagattgagttggaaataccagaaaatggaggcccctgctgttggtacatccagccgggacgagatttttgtttgggtagagtaataccacagggcactgagacagtcgtttggctaattgatacatcaattaatggttaaaatttccatgcatttgagccttccgtcactggaagattaccagaagcccagttttcaatagctcagaatgtctctttgccagtattttctaaagtgagagaaatgtgtccacactgccttattccagtggaggaatcctacacaataggttataaacaaagacagtgataggtgacctgtactagcctgcagggatcccaggagattattgtgatggcctaatgtaggcatttggcctaacgtacatattttgaatagttcccatctctgaaagggtgggaaatcatttaggtttggagaaatgtattggttttcatattatttagccatatttgaggaagtttattttaagcttgttgcacatttaattctctcaacacattgccttgaatctagctgaaccaaacaaaaaaatttaaagagaattatctctctagattatttgttaatt

SEQ ID NO: 122053 - DNA, 1883 bp, Homo sapiens
actgcagcctctgcctcccgggttccagtgattctcctgcctcagcctcctgggtagctgggattacaggcacatgccaccatgcctggctaatttttgtatttttagtggagacagtgtttcaccatgttcaccaggctggtcttgaactcatgacctcaggtgatctgcttgcttcagcctccgaaagtgctgggattacaagcgtgagccactgcgccttgctggtgcatacacatttagtattgctttttcttcttggtggattatcccttttattgtgatgtaatgcccctctttgtttctggtactttctttgctctaaagtctactttgtctgaatgtttattgaacaactgagtgttctgcaacacagctgctggctcataaagcaggcccctgtgtaagttgagcatatagactgggtgaatgtttattttaggttttatatatacacatacattttttttcctctgtaaagggtattgagcatatgcaaaaattcatttcatgtagctaatatggaattgacagaatttgaaatagttttgacaaataatttcagaattaatattatcctagtttaaaacataacactttatatttgaatatcattcctgtcattttatgtacataatgtagatgtaaaaactaatggcatgaaaaactttataaacagatgcattacttgttttggctaattacaattttagaaatgtctgggttagagttagataccagaatgtaagacctttattttattttattttttaggtaaaatcttaaattaagtaaaaaacaaacaaaaaccctttgtttatcaattgtaatgtaacagtattaccatataaaataaaattttgtccaggcccagtaaatcccagcactttggaaggttgagacaggagtatcccttgagcccaggagtttcagacccagcctgagcaacatagagagaccccatctcaacaacaataacaacaaaaatgagctgggcctggtggcctgcgcttgtagtccccgctacttgggaagctgaggcgggaggattgcttgagcccaggaggtggaggctacagtgagccatgattgtgccattacactccaacctgggtggcagagcaagactataaaataaataataaaataaaatagaatcttcaattacatgcatatcagggattcttactgtgcaaagcttttctctagatatttaattttttttttcagtttatgtgaagaaccagctcagtgggactctacagattaaaccaggggttttcaatgaatacagaaccatatggttcaaatcctacaggacgatcttttcctgtttgaacagaataaagagtttcaggtgggtttattattactgtggcaaatattcacgtaattatatgtaataggtttttagtattatctttaataaacccagtcagtatgtaatagtccatgtgtcttgattaaagtagcttgtgtttatttaagtagtctcaactaatttattttctaacaatttttaaatttggggagtttcaaacccacagaaacggtaatagaataatacagtatatagacaataaacaaccttcattcagattcagagatagcttttgttttcaatataaggctattacttagagaagaatttttatttcctcataatgtccttatgacaagacacaaacaatgcagtgcttaaaatcataaatattacttataatacctaatacaatattttaaaatttttagaaatcataagtgatttgggtgctgcataaatatgataaggtggctaaggtagcaaaattgattgaaggtaatatctttctgtatttgtattttataagccaacttttaaccttgtgaaaatattgcacagc

SEQ ID NO: 122054 - DNA, 1025 bp, Homo sapiens
gtgatcccagaatccgagatggggactgtactccagcctgggcaacagaacagactctgctaaaaaaaaaaaaaaaaaaaaaagtcggctgcagacggcgaaagtgatctcggaacctttatgttggggatcttttttcgggagggaccggaaaagaggtgggatcgtttgtcgcgatgtggagtggccgtaagctgggctcctccgggggttggtttttaagagtgctggggcctggaggctgtaatacaaaagctgcgcgtcccttaatttcctcggcgggtgagtgtgtgtgcggaggtccttcgcatgcagtcaattgcgagcgctggcgtctctgcgcatgcgccgggggtggggcggtgggttgtctctggacctcgcgaggggtcagcgcgaaacctaaggcttggtcctggccccatctctctccattgtaaacctcgcatagtcccgttggcggacgccggggaaaagagctcaggaccagtggtcctgtctggaaaagcgcaggccgcgggtctcttgtggctgagctccttgccccaggagccggcgacccgctctgcgtgtgctgcagtctgaaggtcatgcatctttcctttgccggggcaggaataactcacgcctcgtagttatgcatagctttgtatctgtgttttgtttgcacaaagcttgctgtttttttcagaaagaatttaaggcagctgtattactttttgattaataggttaatccaacagactgcatttgcaaatgagatcaagaaaataatgcactgctcagtgcttgtagacagcagtctgattttcgaactctcagtattaagtagaaacttaagctcatctttcacatggaactcttaacaaatactgtatgccagacactggtatgagcactgggaatttaaaaatgaatgacaccgcaaggatctctttaaaaatgttaggataaacctaagatcaggatataatgaacaaaaaaatggggaatctaaccgcccattaataaaggttattagttgg

SEQ ID NO: 122055 - DNA, 2372 bp, Homo sapiens
tcctacttgcctcacacccacctctacatcttgatactgtattttgctacactgtccaggagggtaacgtaactaactacaagctatagagaacttgaaatgtggctaggcatgtgctgtgggtataaattacatgctagatttcaaaaactttacttgaaaaagagaacagaatttttttaaatttattatgtgttgaaatgataatatttttggtatattgggttattttacctgtttctttttacttttttaatgtggttactaaaaaattttgaattacttacatggcttgcatcgtaattctattgaaaatggtgttctattgttacagtctggtagcttgacatttggtagtatgagaattttacatgaacattttcttagtgtttttgtctttttctgtttcagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctct

SEQ ID NO: 122056 - DNA, 3143 bp, Homo sapiens
cagcctggaattttgttgaagttttgatgttacagaaaaatgttcaagatactttattccttgaaatggctgctctgatgtctaaaaatattttataaaatggttttgtggctgggcacggtggctcacgcctgtaatcccagtgctttgggaggccaaggcaggcagatcacttgagatcaggagtttaagacaagcctggccaacatggtgaaaccccatctctactgaaaatacaaaaattagctgggtgtggtggtgcacgcctgtagttccagccacttgggagactgaggcaagagaatcacttgaacccaggaggtaggggttgcagtgagccaatatcacgccagtatgatccagcctgggcaacagagtgagactgtctgaaaaaaaaaatggctttgcattttaatatttttgaagatgtcacactattagtagctataataattagaaatactgtataaaatgctcttttttagatgttgctgacaaaaatgcttctaacagaaattctgctggatgtcacagatgaagaaatttattacgtagccaaagatgcacaccgcaaagcaacgaaaggtatattttggtgtttctggttttgcttttcctggggtattttggttctgatgactattttggcctttttttgttgtccttgttggatttctaccagatatttgaatattctcttgcatgttttaactcttaaagattagattcgtagacaccatattaaagctatacaaatatttttgttttatctgacctacatgagtacaaattagcaatcatgctgttttcctctaaaatgtattgtggaaaattccaggtgttcagtttatttcacctgattttttttaatagataacatggcattgttgtgtgacttctgatacagtttattttgactaatgaattttgaattatctacctacaatttttagtttaccacttatctcttacagaagcaagtgatttcctacccctagatttttagtaacaccttaaaaatgtattgaaaacaaaaattaagttacatgtcataatctcagaagtagacatacagatatacctgtcaacattttttctcattataaaccaatttcagctcacatcagagttataatttcaaagccagacatgatactggtttaaaatgaatgttatgtttttaatgtttcttctctccccaaaaagcagcaatagtagtagatttaacaataccatagactcatgactatgaaatcgtggctatttgtgttaacatgttgttcctgttgttgatgtgatacaaagctcctgcaaaacagctggcacagtccagtgcactggcttccctcactggactcggtaagtgttttccatatttgtgagagggcctaaagggaaaaatcacacatacattgtctctctgcgtgttctattttgaaactgtattagtcctactcagtttataaaaacctaggtcttagggttatgtcatcctgtctaaaaaggtttgcctatttttttgactaacgcattcacagtgagaaatttataaatgtgatggttaattcatagtttattggggcaggttatattggaagatttccttattgctccaatatatgcattttatatatatataattatatatgaacacctatagtttgtacttaataattcataatttagccatgatagtatctaagctcactttcagaattattgcatacatgccttagggaagaacctatccactaatgcttttaataacttacatagattgtgttgcggcaagtcaagttttaatatagaggaaagggtttatcttatcatagtaaaatagtagtgatgtgttcataatttactatttgcatggtatattatcaaggctgtaaaagcttgaatttgccttttccacatcttcatttcaaattaatttttgtgaggacccagagaagtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatcattcctttacagtgagaaaaatatgaaatagtccagaaagaataagatattaagtaacctttgcctgaaggttctgtgaactccttaagcgtttgaatgtatacttctccccaccccgaataagcgtattcttctgggaaaaggcaatgaaaaaagaaatgaactttcttctcagaccttgaaaagtttttagtgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaaggtgtagtataccttttagacttaattttggtccagttttgtatttctttttattttttaactaacctaaaaatatcaaaggataaaataaaggctatattataaataatatgtgatataactgaaactaaagtcacaatttttgtttggttgttttaggagccatttattgcagtggctataagccaagctatttagggtatttttatttcttgctaaaagtcttgaaatgaaaaagatgacttttgaaatgggaaaaatatatttgtaagactattgaaaagtaatttgtagctaggatatataaggataatagagaacctagaagttttttacttaagatactttacctaatactaggaataacaaaagagaaaatttacttagaatttcttctttgaaaaatctaaggtaattaagagttagcagctaagacttctctataaaccacttacttacctttaaaattttgctttagttggacaaaagggaagtc

SEQ ID NO: 122057 - DNA, 1110 bp, Homo sapiens
tactgagtttcagggccagctgagatcttggccctgaaaaatctgattagagatttttcattttaagtcgtgcaactttaggtaaatagcttaaatatatagctgtaaaagttatactgaataatatgtctatggtccatttatccaaagttctataagtgtctcatttcaggcccattatatgtaatagatagtaattaaatcagtctctgggcattatgtttttctgggtatttataaaataaggttaaaattgactaagggaaaagtaaaattgaaaaaacaatttattttcctaagccttcttgtaatcttacatttttcccaggttatactttttaaattatcaaatgaaatctgtagtaaatgtaatttagatagcagtttcactcatatttctgtttcatagactttttaatttggggtttaagattttctgtatgtaagataaggattttacattatacacatgaatttggactaccatactattgttttttataggatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatggtagaatgttaaagttcttactatgtacatggatttatttcgtttgcaattttttttggagacaatattagaggaaaaaacagaaactagaactgctgaccagtattattaattgaagagatactccttttaacttaaaacaattatagaaacctttattaatagggacttttttaaatgttttgatttcaggctggggtaatcctagtacttcaggggaccaaggcaggaggattgcttgagtccaggagttcaagaccaacctgggcactgcagtgagaccttgtctctacaaaaaattagccgggcatagtgaggtgcacctgcagtcccagcaactcaggaagttgtggtgggaggattgtttgagcctgggaagcagaggttgcagtgagccgaggtggtgccactgcgttccatcctgggtgacagagtgagaccctgtctcggaaaaaaaagaaagaaaaa

SEQ ID NO: 122058 - DNA, 1111 bp, Homo sapiens
taacttactagcaaatcacttaattttttcgagtctcagtttcctcacctgtggaaaaaagtggagtaatagtagtgatctctgagggcttttgtaaggattaaattagatgatggtttaacatgctttcattgtgtcctggcagattgtaagcactagagcagtggtccctgctgttactaaaagtgatggcattgaagaaaggcatgatatttaatgggatattttttaaatttactcacaagtttgtagaaatattttacttaactgacttgcgtatatttttcccacgtgaaacagacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgtaagtagaatccccaacatgaaactccatgtgaaaatcttggttgtgtgaaaactttactgaaatagatattttagcctataggaaagtattagagtgatgttcctaagattacgttcattaagtatattgaggattctgattttatatatgtgttactgaagatacagtaaggagaaaatgggacaacaagtttataaacacttcattccagagagctggctagatcttgataaacaatctgtattcattcattgtggtacagatgactccctggtgatagattataaaacaaagctacattaaaatagtaatagagaaataaaatctccctcttttgaacatttaaacatatacctgaggatgtaataattttgattgtttttgacgtgagcactggaagtataacaacattttaagtcttcaaatcttcctcagttagatggcttgagtggtttaggaacttttttattcagcaggtatgatagccacagcactggccagtatgcaactcaggaaatttgtctgtcttgcacggccattttctgctttagaaataagtctcaagaagagcaaaataactagattttggcaggtattagttttgcttcaattccata

SEQ ID NO: 122059 - DNA, 1999 bp, Homo sapiens
catttgaaaatgttttagttcctaagtttaagttcttaaatgactcccgcgggcatccctaccccttagttttactctactttgtgaccctgggcaagtgatttacctctgtgtgcctcgattttccctcccgaaattggcaaaaataatacctaatttctccctacctcacagggatgttgtgaggataaatgtgttcgtgtaagaaagaaattatataaaacctcaaggtattatttttgtggtgttgttactaaacaaatataaaaattcaacaaaaatagtgctttggattttgttacatttgttaaaaataactttgggcatttggttaggatatgaattagagtggagttagctcattttgaattatatatgacagtttagttcattgcttatttttaagataaacaaaaggaatttgaccaagaagtcataagttgttttttaaatctgtatgtttactgaaaaatctttcttgagatcttaaaattctgtgttgattttgttataaccgcctgttgaatgtttttatgcctaaatcttaaatagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcaggtgaaagatattttgttgctttaatattgtagatgtgcacgtaatccattctttggaagtgtctcatcaagaatacctaagatacgtgtttcacttttcagacttgtataaataagcacattctgtctcagttatcaatttttgagtattaaaataattagaatttgttttctgatttttttatttcattaggaaaatggtataaaagatcattacggaaaacttttgaaaaaattaaaaatgtataagtgcaatagctatatgatgttttattttctaatttatatttcaaaatggtatatttaaatgttaaagactagagaatgcacagtaattgaatatagctcatggttaagacatgaataaaaaatatagatcattttcctaagtgtaattccttgtgctatgtagaattatgactgtttttctagtgtcattttttttccattctgacatgacatgttaatggaattgtatataatttcctctgtagcatccaattcattcctagggacatagaactctgtggggaatagtgttgtatgttgggctttatttacttcattccctctgccagggtctacccttaaattatagtgctaggtgtcattttgaaataactgattgcaattattaacttataaactgctatcataatttaaaattttgaaagaattatttcatgaattctagggtagatttgataatggacatctagtattcaccttgagatggtaatcctctcattaataaatattcagatacttgtatacttggtatacagatacaacagtttttatgttgtttgaagaaatataatggcagggagcatctgcttaccctacttttgcatggtagatcccatgtaaacaagacaaagagctgtattggcagctggcctagaaaagcctctgaaaatagcaaaattgcagaaaatatttaatgattcattaacttctatctttgcttataaatgaatatatctgcaagattatagaaacagcttaagttgtttagttcactttttgttcactgtaagtaggatgttgaaattgacaaaaatgtctagttaaagagaaattagtatctatttgatgtcttagtgttggtaggattagcttgtaaatggattcagaatgaaaaatttcatatacttcttgaaagtagcttatcagctggcttttagaagcctctttgcatttacatagccggaaaatcttaag

SEQ ID NO: 122060 - DNA, 1666 bp, Homo sapiens
attttgagtaaagactggctaagaagttgtagccagactacactagtcatgttttggctagagaagggagccttatttaaagaagggcaaccataaggaaaaacagagttaggtagctgctctcatcaaaggcctataggctcgaatgcaggcctggaaagataaataggacatgttgaaggaagaaatgatagcgtttgattatttttgtggtgattttttttttgtaaaggtgatgacatttaaaaattcagtaaactaagatgcaggggataaattttatatgaattaatattagaaatgggttaagagtgttttttgtggagttctttcctgaaagtgtaagtagtttatattattttttagcctgaatatgggttatttgctaagtaccctttcagacacagtatgctttaatatttaagatctcattcaaaaaaaatttttctaatttccctcataccctctctgtctgaaatatttaagatctaaggaatagttgagctgcttattttacatagaggcactattcttttaactcctacattctgaatgctgaagtcagtgttaatttacgttaggccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggtttgttgtttatgttttcacaattttaagacttttaaaaaacagaatgaagattattattaaattttttaatttgcttagttgtatgacttctggaaattaatgcttcttaaagaataggcagttttcaatttgatttgactttgacattttgtggttaaaattattctgtactcattctgctagctttgtggcactcagtttgattcttttcttggttcttcattcctaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaaaaccttaaaacttagtcaggcatagaggcgcatgcctgtagtcccagctacttgggaggctgaggtgggaggattgcttgagcctaggggattgagactgcaatgagctgtgatcacgccactgcactccagcctggg

SEQ ID NO: 122061 - DNA, 1099 bp, Homo sapiens
gtaaggtttcctgaattaatattttattacttttggcaatatgatagttttctaattctgttctacattcttcatttttttagctgtaattatttataaggaaaaatttttcttcatctgctgaagctatttggttactatcttaaaggaatcttgattggggagaaatgaaatcacttttttcctacaatcttcaaaataattacatatccagaaatttatattgtacaaaaaatagagttttttttaaagtcttttttgagctaaattcattgtgttatgcttgccaccaaattctgagaccagcattaacataaaattttctacctcgtttggtaccctaaaaattctagttgcctctggcaagctattgacaagaattttagacctctgatgaaataaatgtatcatcatataataatttctgatgtgaggttttaagattaaataactcactataatttttaaactatgtttaatttattgaagatagaaaatcaagtatattttaaaagaagggatgtgggatcaaggaggacagccttggcagcagtggcccttgaaccagcaacaatggatgcagtcattccagcaccaacaggatccaagtaaggaaacaaattgaatttgaaagggcggggttggatatgtggaaatgggtagaagacacatgatgggattaagggatatggaattgagattggtgtactggatcattttatggtcagaatttaatcttctcataaatagccttgccatagcatatatagcaggaaatggacttccctttggaagactctcaaaatgtagaaagctttttgaagattttacattttttaaactgatttagtccttgtttttctaaagaaagagaaaagcctaaaatatgttgcttatggagaacacttctgtgaattctgactcttaaagttgtatattatattgaactggatggtgtgctatatcattttaaaatttctttttgctgtggactatttcaggcacacatacaaaggtagaagagtatagggagcccttgtttattatttagctttaacaattgttaactagtggccaattttgtttcatccgtaagacc

SEQ ID NO: 122062 - DNA, 1052 bp, Homo sapiens
gcttccagcgcactaagtaacttgaactgcgctaagcaactggccagaattggtttggtttggtttgaccctggggttcctccgtagtctgtaagtggagttgcgaactcaaccccttctccaaggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtgggtaagtgatggagaacaattatacgtgggcacttgccggaccattacaacgttcttggtttctgtggcgaaggtagcataacttaaaataggctgcgtacgctgcttggcgcgaccgctggaacctcattcctttaaagcgctgcggtccgccagacttggtaaatcagagcgctgctttcgctgaaaaggaaatgtccttgttaaagagagtgctcacggtcccatcttctcacagagtttcctctcggacgagaagggactaattgttgggttcctgaccggccgttaaacactgcgcgtgcgcagtgggaacccccttgtgggaagggggttcatgggggcggaggaggcgggggctcgcgacctggagcttataccctttgaggctctgactacgcaggcgcagttccttagtttgtgtttttcgtgtgttcttacccaatgatggatattatgtgttaagcttcgctaaaggtagtatc

SEQ ID NO: 122063 - DNA, 1018 bp, Homo sapiens
taccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatgcatttgcttatgtcttagtccactcaggctgctataataaaataccatcaactatgtggtgtattaacaaaaatttatttctcacagttctgggagctgggaacttcaagatca

SEQ ID NO: 122064 - DNA, 2400 bp, Homo sapiens
gcgctgggccagacagcattattaattatacctataatattaatgctttgaaagaatttgttctaatgagtacacatggacacagggaggggaacatcacacactgggcctgtcgggggaggggggctaggggagggatagcattaggagaaatacgtaatgtagatgacaggttgatgggtgcagcaaaccaccatggcacatgtatacctatgtaacaaaccacattctacacagatattccagaacttaaaaatataatttaaaaaaaaaaaagttctttttggaaaatgcttaacccaagaaaaaacaggcttctcaggtaaaatttggcattagatagagtttgtaatgaatatgttattgtttgtaatttagagtaagaacctaaagcatacttactttaaaattgtacttctttttgttttgctaggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatca

SEQ ID NO: 122065 - DNA, 1453 bp, Homo sapiens
tgtttgttttaatgaatgaatataattgaattttagaactgaaaaggacctaatctcatccttttatatatggaatcaagttgacaaccagtcactgagttaggcctagaacaccaatctgtttactctttagttgaatatattttcatgatagcatatgtgtcagtagcttagcttttatattgaatttatttttccataagtgttgaaaagccataatgaaagtaactattccccctattgtttgtggtaaaaatccccatgtaaatgaataatctttgcagtaacaatttatgaaacctaatttttaatttattcatattaattttagactatacattagtcacattttttatctatgaaaaaactaagtcctacaatttctcttttggttttagttaacaaagacaatgctttatttctaattgttgcatttcaaaaatgttttggtctttttaaggctggcttgagtcttcgtaaagtaaacagacatgtagattttccacttatgctcgatttagcaccattctgctctgctacttgtaaggtacagtatattaagatatttaattgatttataaattaatatgcttgaaagtatcctatatattattagacaatgctttttctaaaaaaataacttctcttctgaaagggaattttaatagccagtgattaagtcagtaatatgtggaacacttaatacattgaatatgatttttgtcctttgggagacaaaggaaaattgaaaaggtaaggcatgaggcatgatggttatgaaggtctaagctgtttgtaagtgctactggaagctgatggttgctgagagaaggaggttttgtgtcctcgattgttccttgtgaactgtttaatcagtagtagttttaccatttgcggagttctgtatcttttgcaaatcagtgtagaagtgaattgtctttcgtgccacttcatgtgtactactgagagtggtgtacttgtcagcggagtgtgatacttcaaaactgctgctactttaataattaggtacagaaagcagactggcttatcattgcttattttacatgtaagaattgtgtagatgaagtagatgacttggtcttccttgaaggaagcagttatggggtaacatactgtcctgttcatgattactggctagaagtctagattttgtagtatgtaatagaatgcttattgaacttaatactttcagcacattgataatcaaaacaaaatcatcttaaatgcaatttttggttgaattacagtgtatctgctgtggaataccagcactatctgtcaattgttaatactcagtattcctagaatttaataatgtggtaaataataatgaaatttaacaatctttgtgttaaacttatgaaaacatatttttaaaaagtacctattacggagaatttccaataaacacaaaagcaaatagaacagtacc

SEQ ID NO: 122066 - DNA, 1676 bp, Homo sapiens
agccaaggtgggaggattgcttgaggtcaggagttcaagaccagcctaagcaacatggcgagactttatctctacaaaaaattaaaaaattagccaggtatggtggtacatacttgtagtagtaactacatgggaggctgaggtgggaggatcacttgagtccgagagtttgaggctgcggtgagctgtgattgtgccactgcactctagcctgggcaacagagcaagatgctgtctctaaaagagatttttcttttaaagaaaaaagtctccctcatagccctgttctacaaaagtcctatttccttccccacaaatagcctctgttacactgttgttagtttcttgtgtgaagatttacttttaaaatagaactattttttagtatatcttctagtgatcttagtttcagtaggcttaggaaatggatctgagagaaatggtatttaataactatgatatgtttaagaattattggcatttattttcaatgaggttacaagactcttttctttgaaaacactgtcaacttacagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcaggtaattatttttttaattacataattattgatctcctgatagtgtctagtgagttacaaatttcactgagaattttactgagaatcttgtccctatacttgtgttacttaggcagagattgtttcattcatatttgtacctgagcgcttacaatactgggcagaacagattttcaagtttttttatttaaataaagagcaggaagtatacaactctgccttgaaaatgcaaacccatataatcttatttgagggaactacctatctgaaatctatccagaagaaatatccctacaacttttttttttttttttggagatggagtctcactctgttgcccaggctggagtacagtggcgcgatctcggctcactgcaacctccacctcctgagttcaagcgattattctgcctcagcctcctgagtagctgagattacaggcgcccaccaccatgcccagctaatttttgtatt

SEQ ID NO: 122067 - DNA, 1002 bp, Homo sapiens
cctactggagggtgcacagggtgggaggagggagaggatcagaaaaaataatattggatactaggcttagtacctgggtgaagaaataatctgtataacaaacccctgtgacacaagtttacctttataacaaacctgcacatgtaccctgaacctaaaataaaagttgaaaaaataaatctcattgctgttcaaaacaaaaacaagtctgtgacttatatgcatctggttaatttttgtgtgtccttctcacctccccacacttgtactctattttctagctagacttccctaatttcttgttctttgtcttacctgtgggcctttgaactgtctcttctgccacgaacagtcccattctcctcctgtagcctctgctcaatttctgcatatttctctgatccactcaattctggattagttcttttcctctggctttctatagcactgtatttctcctatcataacataagttgtacctaacatttgagttcttaattatgttatgatcactgttttcagttatttacaccaattatattgagccaagaggtggattaaataacatgcctaagatcatacaagtagtctggcagaaatggggattcagacaggttaaacaaggaccatgttcttaaccacgtatactgccccctgctgacttgaacttatgtctcaccatacttttattgggatggattgcaggatctgcaaacaggaactgagtctgtccttcttgccactatgtctcaggtgcctagttcagtgcttgtacatggatggtgtttagggagaccactgagctcattctcatgattgctgccaatcgtaatagctgatactggctgggtgcggtggctcacgcctgtaatcccagcactttgggaggccgaggcaggcagatcccaaggtccggagatggagaccatcctggctaacacagtgaaaccttatctctactaaaaatgcaaaaaattagccggtcatggtggcacacgcctg

SEQ ID NO: 122068 - DNA, 2283 bp, Homo sapiens
gaggcagttttagcctatcttaatatactgaaattcattagctatctgtttgaagtgagagaaaaacttctgtgaagagagtaactgtgctacgttgcagtgccctaaaatgtaattccaggctgggtgcagtggctcatgcctataatcccagtactttgggaggccaaggccggcggatcacttgaggtcaggaattcaagactagcctggccaacatggtgaaaccccatctctactaaaaaaatacaaaacaattagccaggcatggtggtgggtgcctatagtcccaatgactcgggaggctgaggcaggagaatcacttgaacccagcaggcagggttgcagtgagccgagatcgcactactgcactatagcctgggtgacagagcgagactcagtttcaaaaaaaaaaaactaattccaatagaaataacttaatgtattaacataatttagggtggttatatcacctttgatttaaagtttatatgacgtattaaagatttttgtgtagacttcactcactttgaacttaataatttttattttgaatgccatctttaacaacttaaagcatgtatgaattttttgtagattttcaattgcttggcaaggaatatttctgtaagtgtatgacttagagtatgataggtttaaatttctgttagattttaatagtaaaaggagcctttattcattttcctgtcccagattatgagtatttttctgtgttctctagccttaaagaagcaggattataaaatatatctcattctagcctgtcacattgaaacacagaatgcatgaccatgattatttaagtttctagactattcaacacagaagttgttttctctctcacaagatagagagtatcttttaaaacaaaattatcttaaagaatctataaaacacagccaagctctctgctttttttcatggctttttcttaacatttcatagtttacttatgttacagccctaagctaaccaaaaatgtctagtctctttagttaatctgttttattaaacagtttttttaagttattttaaatattacaggccagtcatattgacagtaatataaaattcaattggatcaccattcactgatgtttgagaatatcttgttttgattaacaatgtgctgcaatacccaattaaattgctatttttttcaggaacagtttttaacgtaaaattttaggttgcccgggaagtttgatttctttgtactttacaaaactgtatgtttatattagaattctaactgaagttttcaatgtgttttccttttaagatctccacggtgaaagatccattcattgatatttcacttcctataatagaagaaagggtaaggagaagaaaactaatgatgaagctttggtgaagaacatttaatcatttatttaaacatttgttgagtatattaccagatatctgagagtcattattttttatatataattgagtttgtattcataattgagtctgatttgggggtttgtgtaagtatgcataaagtatgatggtttttattctcaaggaatttaaactcttaaacactttttattttgataatttgttaattttttgtatttcaagtcagtcaaaaattttaagatgaggacatccagaatttatttactaaagaggttttggtttctgtatgtggcatttacataggtttcaaaacctttactttggggaagaatgaataaatatagaagtttacgggagacagatcatgatcgatacagtggcaatgttactatagaaaatattcatcaacctagagctgccaagaagcattcttcatctaaagataaggtaagaccataagcatctgttagacgtctgttttttaacagtttattaacaaaagtttcaagcacatctaaaagtagagaacatagtgtaataaactctcatgtacccattttttggcttcataattatcaacttggctacttgtatactaactatatatatcccacatcctccccttcctcccatcccagactatttttggataatcccagattatttttgaaataaatcccaaatatatcatatacttcaatgtgtatctctacaagagagtttttgtttgtttgtttgttttttaagacggagttttgctcttgttgcctaggctggagtgcaatggtgcaatctcagctaactgcagcctccgcctcctgggttcaagcgattctcctgcctcagcctcctgagtagctgggattacaggcatgtgccaccacgcctggctaa

SEQ ID NO: 122069 - DNA, 1049 bp, Homo sapiens
aaatgtactccttagtaaaatttaagacttacacttttattttaagtaaaacacttaaatagctcttagaaatgttattctggccaagtgcggggcctcactcctataatcccagtgctttgggaggccaaggcgtgcagatcacttgaggtcaggagtttgagaccagcctggccaacttgatgaaaccccatctctactaaaaatacaaaaagttaggcatggtggcgcatgcctgtaatcccaactacttaggagactgaggcacgagaatcacttgtacctgggaggcggaggttgcagtggagctgagatcacaccactgcactccagcctgggagacagagcaagactctatctcaaaaaaaaaaaaaaattctattttctagttaaattatctgtttgatagcgtagttaatttttaatattttctcacagacttacatgtaaaagtcaacaaacagacccttggccacttgtgtgaagtggctatttaaccatgaaataaactctttttattgccactgccctgtgggtatgttctttctggcagtgctgtccatatttggtggctatgcatggagagccaggtggtgctgaaaagcatcacacagtgaagcgtggatatatcttggtttgacatttgtcgtcccttactgctgaagggagggggaaaatctgtttttccatatgtttatgctttattttgcctgcagttttgtccagatggtcttatgaacattgtttactttgggatgccatcccagatgttttgaaaactgttggataaatgtggcacacagatacatttgcatattatggtttttaaaatgttatgtgtctttgcaagattaaaatataatttatttctaggagtattttcccaagtgaataatgtgtctgtgtatatatgtattttttaatgttttttaaaacaggcccaataggcgtcgtgtatatatatttcataagtatataaaacatatatagttattatctataggttatttcttccagccattctgttttcatgttaataagctaaaaaa

SEQ ID NO: 122070 - DNA, 1051 bp, Homo sapiens
ttgacgagagctcgataggttcaggcaagtctagacagctgaaaagttgagttttgtggtgtagaagatggtgagaggtgagacttgaggtaagtaagaacagatatttaagggccttgtacagatagaatttgttctgagggcagtgaggaaccactgttaagttttaagcagagaagtggctgatcagtgattttgtagatctcagtttgacttgtatggagacagataggaatgcctatatatgtataactgcccatttattatgttaatatcaatttatcatatgactaagtaaagatttctaaggcataatggttaactggaagttagtcgattttgagagtaaactggcaagctaattattatttggttccaagctaggggaattgtggggcaccaagttgtctctttttactcactctttaaatattaaacttcttttcagctgtagaaatgggcagattacattaatactacatgactggtttaggtaattgcattaagcagttgagatgaaccccagctcaggttcccagaagaatgcttacagctgtgtagatttcacatctgatgttaggatttgcttatagaaacaaaactccctctacctcccccttccccatacatggaataaaaaggtcatatataatgcaagactgaaaatgggcaaataagcatttttgtgagtcccacccagaaataggtattgttaaaaagtagaccagaaaactggagacagtaaaaaaaaaatcagtggttgaaaggggttgaggggaagaaggggtgaataggcaaagcacagagaattttttagggcaataaaactactctgtatgatactataatgctggatccatgtcattctgcatctgtccaaatccatagaatgtacactgccaagagtgaaccctgatgtaaactaggaactttaggtgataatgatgtgtcagtgcaggttcatcagttacaataaatgaagcattctggtgggggatgttgataatggaggctatgcatgtgttggggtaggggggatatggaaaatccc

SEQ ID NO: 122071 - DNA, 1027 bp, Homo sapiens
gtagatggctttgagtcagggggtctggtgttcagatttgactctgtcactaggtgtgtgaccccaggcagtaatctgtttatgcaagcctcatttttccttagtactttatatttccaaggtgcttcagggaatagagattgataagacagtcactaaatctttaagaggctaaagatctgaaagaaggtgtaagattaaacagtaatgatatgcaagtagagtaagatttctgttttaggtaacaaccaaagtccttcaaatatccaaagagggatataatgttcagttgtaggaactaaaaaggaatcatggatgagccggctttcaagctgacccttaaaggatgaactttgggcaggtgaagatgagagaagaaatcatttcaggtggtgggaagcactaatataagccttaattgtgtttatggaaccgtgaatagcacctggagtggtggggcacgggcttttgaggtagtttgagagggagtggagctttcaaagtttgagagatacatagttgttagtttaaggcttttggcagttctagggcaagatgtcattatccctgtgggtcaagctacaggatctctcaggcaagtttgatttaaaataatattccttggcattctagaataagtttttggatataatagtttgccatattgtgccttgtatgcggcttccgtatatttttataaaatatttggaaaatcaaatatgaaagtttttattgaggtttgtaagaatgccggatatgattttgcactaaatggtaatcgtgaaacattgtgaaaacacctatttatgataaaaggaatatgaaactgtattattgtgtttgggtgagaggataagtatgattttaaaaggttatttttatatttttgtactaagtaaaaatagttattgagaagaaagcctgtgcctgtatgttaaacacattttgaagttatgcatgaccagaaattttctttctctttaaagcatgtcattaattcttttgtttctttattcctttactttta

SEQ ID NO: 122072 - DNA, 1975 bp, Homo sapiens
tatcacccaggaaattccaagggatttgggagctctgtgtcaggaagtggagtaaaaaatgaaattcattaaaacaaaagatgctcctagcaccccccccacccccatcactcaggaaattataagggttttaggagcttttgtatcaggaaccaggagcagagaccaaatgtgtatttattatgtcactgtgcaaaatacatacctagaatacatagtttattaaagcaaaaaaattaactatagttaactgactggaaccagggggaaattcttttaacctattctttccagctgttaatagtgatatcactttgaagttgcctaaattgtttattttttccaggtttgacgtcaataaagggaaactgccacaatttttatactgctatttctaaagatgtcacttataaggaacttaaaaacctgttgaattctaaaaatattatgttaattgatgttagagagatatgggaaattctggagtatcaaaaaatccctgagtctatcaatgtaccatgtaagtgacatgtgtcttaaattaatttattaaaaaacatataaataatttactatatctaaaatctaactgaaattcttaacattttctttcagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacaggtgtgtagatgaatgaaaaaatggattgataaatgtataatccaatgtttcatatatattacatttttatatgtctatttaagaatttcttgtaattactgtcagtaaaggcaggatagcaaaactaagagcctcttttcatcttactcaatttagagataatagcggccaggcgtggtggctcacgcctgtaatcccagcactttgggaggccgaggcaggtggatcacgaggtcaggagatcaagaccaccctggccaacatggtgaaaccctgtcactactaaaaatacaaaaattagctgggcatggtggcacactcctgtagtcccagctacttggaaggctaaggcaggagaatcgcttgaacctgggaagcggaggttgcagtgagccgagatcgcaccactgcactccgatctggcaacagagtgagactccatctcaaaaaaaaaatgtttatagcactatttgatgtatgttttcagtgcttaacactatgccagaggatggaaagaatgggtaacctgtgaattttcagagaagaaacaaggaaattgaatttttggaatacaagttggctctttccttgtgtacatgcagcctaggatagtggaatgagcaaaatattaaaaatctagtcctggcaccactggttatggtaaggggatttttgtataagtcaattagttgttgaatcattttctcatctgtaaattgaaaatggcactctcccctgagataatgcatgttacttgccatggaaatataagggtcaggattctatgaattaatttttaagtagcttagtatcattcaatagtattctaaaataccaggttacttatactacctactcatgtatgacatttgtgttagtataccttctattcatcaaaggggctatgagctagacctgcagattaacacgcagatgtggccttaaaaaaaaatcagttaatctgggatccagagaagtaggtgaaatttgaacaatgaaaatacattaacagcttctaaagatttatagcagtattatgaccagcatggtagtgatgaaatttgcaatttaaaaaattaaaattgggccagttgtggtggctcatgcctataatcccagcactttgggaggccgaggagggtggatcatgaggtcaggagatcaagaccatcctggccaacatggtgaaaccaccccccgt

SEQ ID NO: 122073 - DNA, 1029 bp, Homo sapiens
ttgcagtgagccaagattgcattactgcactccagcctggtgacagtgtgagactccgtctcacacacacacacacacacacacaaaataaataaataaaataaaaattattagtatggggataatcagaacagtggttgctgttctagagggaagaagattaactggaaaaggcaaggagggtggctcaggcctataatcccagaactttgggatgcctaggcaggcagatcgcttgagctcaggagttcaagaccaacccgggcaacatggtgaaacccagtctctacaaaaaaaatacaaaaaattagccaggcatggtggcacgtgcctgtggtcccagccacttggggggctaaagcaggaggatcccttaaacactggaagatcacaccactgcactccagcctgggtgacagagtgagaccctgtctcagaacaacaacaacaacaaaattgaaaaacaaaaaaacaaacaaaaaaggcaaggagagaactttctagggtgatggaaatgttctgtatcttgactgaggtattggtacataggtatatacatttgtcaaaacacattaaacacttaaatgtacatttttggtaagtgattatacctcagtttaaaaataatgaaaacagaaatgcctaaatgtaaatgactcccactagcatgggtatattcctttggaatgttaagtcctacacttaattagtgtgctaatgcactggtggcaaaataaacctgttttctcttgtctgtgcctctttagacccatgtagtgtatttttagactcactcatgcagtcattcttgtagtacctataaggacaatgtcagaaatatatatatttctgtcagtgtgtgtgtgtgtatatatacacatatatgtgtgtgtatatatacacatatatacatatgtatacatatacatatacatatatacacacacacatatatgaaggcaaggagagaactttctagggtgatggaaatgttctgtatcttgactgaggtcaagatatatatatata

SEQ ID NO: 122074 - DNA, 1524 bp, Homo sapiens
tattccctcatgattagaacctttattcttagtatgtttcagtttaaaagataccatcagatggaaggaaatcagctgcagagatagataagaatggacaatgcacacatgctgaaaaatgagatgctagaaggaaaatcctaaacagcactgtggtgaaaaatactgctttcaaatttatcaggatttaaggacagagactatttactgttttctgagggttgtgtagtgatgtatgctctttatataaaaaatgttgcttgtttttgccactgagaacttttcaaatattttcttctagattttggaaataatcagggttattttaaaactatatgagcagtggaagaatttcgatgagagaaaagagatggcaaccattcttagtaagatgccaaaaccaaaaccacctccaaacaggtactttgtagactttaattattgatgtcatttaatcatatatcatacttactatatttttcttagattatgttgttttgtagtttttaaaacatttcttccaaaacttcatgatccatgttaattttattttttaaatttgtgatttgattgagaatgtctcatttaaaaaaatcactaatctgattagtaacttttcctaatgcagtggaggtatattacaggtatctctcaacatatggtcatataccataaatttaaagctgacagaattaggtaagttcatctgaaattcagggcagaattcagaactatagtagtttcatgtcagtttgattctgtgccatcttttttttttttttttttcactgctggctattgtcctgttttataaatttcagtagcaattttcaaaaatttcaatgaatgatctgatattgtaaagataaagaattttggtttttaagtgaccctaaggtccatggcacataagaatatatttttgctaaaaatgaatcacctgtgctaagagggttttttttgttgttattggggtgtatgtgtgtgttttaagtaagatgtgttcatttagttcagtggttctcagccctcactgtgtatcagttcatttggggcagggagaaaaagtcagaagggaaataaagaaatgccatccatcttaattgtttctttagaaaaatgattgttatataacaagatagatttatggattgctactcataagttaatgttacaatttggaaaaagttaatactttattcaaggagctgtttaaggcagtcattcaaacagctacctttggatgcattttttgcagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggtttttttttttttttgaagaac

SEQ ID NO: 122075 - DNA, 1001 bp, Homo sapiens
catttggttttttttaacctcttcttgacctaagccctactcatagctttgcttgacttagggcaaccagtgtgtcagttcacatttgagttgctatttgcctagaatgtcatccttagcaaagacatggataaccagaccacggagtataacttaagctggagtgggttaagggtatacaggctgctcagtagaaattgttttaggcaaaattatgatgtagattcctctcttttgttagtttatattgtatataacatatataactaatattgtatacagtatattacatttattttctaacctttatttgattacaacactgaattctgtaaggatgtgcccagctttcacataacttgatcatgtgctaataatgaaaaggaagaaaaaaggccaggcaacactgcttttaactgaaatgtggaaacacagtcaacattgttaaaacctagtatattaattaacatttttgtttgttttgttttgtcacactgacttctgggtgcagtttaacggctactttgtacactactcagggataacttcccttttctgctctcctcattggatgtttttcctctttaacgtgcctgactctcaaggcaactgcaccatgactagcacgcagtgaggaccagatgtcaagaacttgatgtaatctagtaattttttctgtctcggattacattgatgagatggtcagtggtaactctcatatgtagctgtttaatgttttttaaagagtgttggaaaatacacaggaaatagtgaaaaatctttgttagatcatatattctgtgtttgcagttaaacatggacagttgtctctcattttcatttcagcttgcctacatgtagcctgtgttgtacagcagaaagatgccaggcaatggtttgctgagctttctgtggatatggaaaaggtattcccttagttgtatgtaaacttggatgtttaaaaattaatgtcatatttacttatcatgagcctaaaatct

SEQ ID NO: 122076 - DNA, 1840 bp, Homo sapiens
tgtgtgcaaagatgggaaatctggccctctctggaggaaatatacaatcagatgaggtagttctgctttcagtaataatatgatttacatttctataggaggatagtgaatgatacctacagaacggatctttgcctactgtatcctcctttcatgatagctttaggtatgtaagcatggtgtgcctttatgagttaaattgttataaacttatttaggtcatcctaaactaaatttcaccctattgtactttatgtttttatgttccatgaagtaatagactaatccttgcatgtgagctttcaataatatgaactgcaactgtcataaatcaggattattattcccccaccccctttttggtaagttttttttttttttttttgaaaccattcaaaatagttttaatcggtgtctgaatagaacatatttgtttgtttagagggaaaagttcagaattaagccagctaatattagttgtagcatgtaaaataattggggctttcatatcctgagcccaaacaaatactcagaggttgagtaaaggagcatctgtggtccataatgcttggctggaggaagacgttaagtacattcattctacagtctgtggaaagcagtgctgtaatgggtggagtcagatagtcctaggcttaaactttacctcctttacaattgtgggaaaattatctgacctttccgtgtttgtttccttaattgtaaaatggagagaatactaataattccactgagccgtttgaagaattaaatgagataggttgtagagcaccaaataatgcctgttatatattgggcacttgttaatttttgttccttttccttctattgatttttttttttttttttttttgagatggagtctcactctgtctcccaggctggagtgcagtggtgtgatcttggctcactgcaacctctgcctcctgggttcaagcgattctcctgcctacaggaggattataggtgtccaccaccatacctggctaatttttgtatttttagtagagacagggtttcgccatgttggccaggctggtcttgaactcctgacctcaggtgatccaccctccttggcctctcagagtgctgggattacaggcgtgagccactgcaccccagccccttctattgatttttataactccatcctcttgattttcccctcttattttccattggtttgtctttgttcagttgttcaattattccttaaatgttgatgtttcttggccttcttacatcagggctgacaaataggttatacttacacttctgtattactggcagttccctgaaaggactggatttgaaaggattttgagtggtgtcctacccagtgggtaggaatactgggatctgcataggtaggaaggaagggataacagaacatgtgtcacatctttgccatccctgctgtcttcttcttgggtactttaactgagattcatggcttctactatcacttacatgccgaaacatttaaatctctttatttagccaagatcttgccacttggcagttctttatatccatcttccttttacatagctccgcttggcatcccaccagcacctcagactcatgatgaggattgagcttatcactttgccccaaaatatgttcctccttttaatgtctttgccagtttggtgaatagcactagttatataccttagttggaaacccagcagttaggccctttcatctccctcaatacccacatgtagttgtttaccagtacattttgtgccttcctctcgattgttccttctgtaatctcatagtcatcttctcatttctatccatgttaccacagcag

SEQ ID NO: 122077 - DNA, 1062 bp, Homo sapiens
atttttaaaactttttagtaaaaatttttgataaattactataatgtctgtaatttatgttagattaagtggacttatctaatttggtttcatattgacatttcattgataatctttgttttaaacagatattagaatgtgaattctatctgttagaactaatggtaagtaaatcttctgtgattaatagattaaaacatttttaaattaaatgaagttggaaattatttaaagaaatgattttagagaggtacattttaaaaccatccacctaatatgtgatggtgaaatcatggtagcctatttatattagcacctagagtctctctgaagcctgtaaaataatttgtatatcctacttaggatgggaaaatttttctgttctatagtaagtaactataatgaaaggattacaaacagacaagtcaggacattaaaccaccataaattatgtgcacaatttgtgtgtgcgtgcagtgttatttaaagatagattatgtctttggcagaattctgctcctccagttgggaattatgaatttataggctaataagaggtttcagtgtgttgcagatgtgacactttgagtctctaagggaatgaatggatgctgactgactgccaaccgatttatcaaggtatattccagagagagcactgccttcactattacggtagagtttagggctgtcatactgctagcttaagagaataaaagggaagcaagcatgagttagtgaaattcactttgaaatacacaattacaaatcagttgggtaatgataacatttttgtgttgtaataaatctgttttttatacatacacattttttaaactgtttctaggattgttgcttgatagtgtatcatccttatagacctttgctccagtatgtgcaggacatgggccaagaagacatgttgcttccccttgcatggtaattagaacagaagttattaatagtgtaacatgttattagataggaaggttgacaattaaatatgaagttaagtatttttaaagtcattaaactattgccccaagatattttatgttgagc

SEQ ID NO: 122078 - DNA, 1068 bp, Homo sapiens
tacagtttagttaataataacatttcaatattgggtcagtaattgtaacaaatgcgccatactaatgtaagatgttaatagtaggggaagctgggtgaaggcatgtcttagtccacttgggctaatataagaaagtaccatagactgggtggctttcacaacagacatttatttctcacagttctggaggctgggaagtcaataacggtgggtataagagaactgtgcatgatctcagtgtttgagtctacaaaaataaaaggcagaggaatataattaggtagagtttgttttgcttttttcaagggaaatttgagcatattagtatgtgatggaagatttactgaaggaggaaggttaaagatgaaaaaaatagcaggagttatcaattgaatagatgataataagtgtataagtggtaagacaaacaatagagaggagggatgtatttttctccaagttggaggaaaaggattaaaagacagaaaaaaatgcagagcagttttagcatggagtaacagacatgtgacagtatcaggtaaatatattctcaatagaggtgttaggtgtcaaggtccaggggatggggatgtagatttgttttatatacagagataattttactttgttgattgtctaccattatataagaacctgttgtgctggtatactttacatcacaaggatttgtaaaactcagaaaccttaataggtacgtcttaaatttaaataaaggagagaagaaaggaaagattataaatttactaatgtcaagtttaaattattctaggtttcaaatcctggcagatattacacatctaaattagctgtagggcactgaatttgcaaaacaaatctttttgaaaacatagtgcatagaagaaatggaatttctttctttttttttttttgagatggagtctcactgtcacccagactggagtgcagtggtgtgttctcagctcactgcaccctctgcctcccgggttcaagggattctcctgcctcggcctcccgagtagccgggactacaggtgcatgccactacactcgcctaatttttgtatt

SEQ ID NO: 122079 - DNA, 1034 bp, Homo sapiens
gattcttggtttagctaggccgcggggggtcggatagagtgggcacaggtacgggaagtgtgactcagctcaagactgtgaggctacctgttcaggacagttgtggcgtgcttttacctggggtttcttcgggtgatcggcgtcgtggtcttttgtcattcactgtatatcttgagtggatttaatattatgaggagaggagagagtctggcttgtttctgcctactaaccgcttcttgcgcgtactttatgtctagatggagttttatattgataaggtatagggcaggtgccctctaaatttatccatttcattagcctgtgctttatattttgttttaaaggcctatttttccagtgactttgtttacctgtttctttaacctttttcatgaataagttcttgtttctgtcagtgaccatgtgagagctagaataatattaaaaacatttatccctaaatacatttgtttaagcaggcaggaaggtgcgttatggggtaaattgaacatttgagtaggctttccactgtatagttgaaagatgaacagaatttgacaaggtatcttggtataattttttatgctaagaaagcattagtaagtaatttaaatttcgattctgtgaataggatctgttcctgatgttcattttttagccctttgcaaagagaaaaaaagaaacaatgaactcagtaacctatttaaggaaaagcaggttttcctcttgctataaagtgattctgtggagatgacatgttaaagaagctttaccactgatcatatgtgtgtgtgtgtatatatatgtgtgtgtgtgtatgtatatatatatgtgtgtgtatatatgttgcattgttttcacacactgaaatattgcttgggcaaaattaaagtatcgaaagtttaggtattggagttagagctcctgaaaaaaaaagtttaggtagtggagaagagatattctgataaactctgaaagaagctgagagaattgacaagtagctgactgttgatttttcagtttttcaacttaaa

SEQ ID NO: 122080 - DNA, 1055 bp, Homo sapiens
ggacaaacttccgcgtgctcttctgcgtactggaaggcctggaccagccgcagagcctcatccacggagcgtcccacaggcaaatcattaacagtgatctggaaaggacacccttgccatcactgataaagcggcccctgtaggcaatgcccgcatctgttttcagcacggcgtaatcctcagacaagccactggccacctcagcaagcagggggatgttcagggggcccaagtctccctccctctgggggttgttgatccaagccaggtgggtgaactgagagtccactgagatgcccagcacttcgcagcccagcttgcggaagtcctcggcatggtcgctgaacgcgatgatctccgtggggcacacaaaagtgaagtgcagagggtagaaaaagaggaccacgtatttctctttgtagtcctacagcttcacttctttgaaagcgctatccatccaccacggcggtggccttgaagtcaggggcgggctatgccatgcgcgcgattacggaggccatgactgaaagctgcgtgggctaaggctggactcacgggcaaccagacgcgtggactcacgttctcaggaccaaaactgaccatcttaaccaactttacacgtaaagttcagtggtattaagtacattcatattgttctgtaattatcactactatccatcttcagaacttttttcattctgcaaaactgaaactctatacccattaaacaataactccccattcccctttcctcccagcccctgggaaccataattctaatatcaaattctatgaatctgactattataagcaccacatataagtgaaatcatacagtatttgtctttttgtgctggcttatttcacttagcataatgacttcaaggttcattaatattataacatgtgtcaggatttccttctttttaaaggctgaatagtgattatatagagagaatattttgtatatatattatatatgtaatattccatctctctctctcacacacacacacacacacacatatcacgttttagttatccatttatccata

SEQ ID NO: 122081 - DNA, 1043 bp, Homo sapiens
tgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttcttctgcttcctttaaataatatccccttactcatctgttcttcttttctttcccttctacttcaaggctttatttctattatctttctgacatatttatttacagaagtagagaagtataatctaattcatgttgtagcacttacagatcatatagtacaattatttgtctttatgctctccaggaaaaatctgagacagaaaatttttcacccctatggataggttttcacctgtaataaagaaaatttctctatgtccaaacaaattccttcttgaaaaatactttttcaaactaaaaacttgttaaaattcaatgttcatataatatgcattctagtggaatgaaattctacctttgtgaaataatttcagttttcttagccctaaaatgaattattttaaaacattttccaatgtcattgttacaaatactagaatttaagtgt

SEQ ID NO: 122082 - DNA, 1052 bp, Homo sapiens
ttttttttaattcctaaggggtagtttggttcatcaggactacttcatttcaattaggtatactcagcagcactaagcaaaatcaaagcctataaggaaatctatagtatatattaaaggaataaaagaaaaaccaaaattaaagtaccatgtacttttaaaaactaactgagaaggtaacaactgattaaaaaaaaaaaagccaatgtattgagaagttttcttgactgatggtgatattgccatataagtgtatatgttagaaaaagatgacctcaagttttttgttacatcttttctgtagacctaggtattctcattcattcattcattattgttgagcacttgctatttgaatactgattttttacaaatgtctttccacttcaagagcaagtataaagttaggtaaaatatcttttaatgtgtcattttaattggtattctcagtatgatgatgccaaaaattcatatttgtttctagaaggaaccctagacttatagaattccttatgatataaaatataaagaatttttttctgaataaatagggcaaatttgaaatatgggccaaaaaatgtacaataagtggtcagtggaggattctaacatcaataattgaattacaaaaatattttcacattgcccttttatccccaagtaatgctctccttcttagaagccatgtgaatgtctgaatagatgcttctctaaaacaaaccagttcgataacagacattttttaacttgttttattttaatatagtcaacagctgctcagtatcaggaaggatttacaataaaggaatcacaagtttaaataatgataagccctcttttagttatttttacaaagacattaaaaagactaaaagcacaatattcttacacatacatgcatatagacacaaatacaagaaaaattggggaaatctgaacaaaatcactggattatgttaatgtcaatatcctagtagtaataagtaccgtagttttgaaaaatgctacctttggaggaaactgggtaaatggtccacagaatgtctctgtat

SEQ ID NO: 122083 - DNA, 1035 bp, Homo sapiens
agattaaatgtatagactaatatgaatagcttctcatcattccacatgtaccactagcagttgccccctttgctagtgtgtggtgtggtgtattattgtcattgaaaaccaggcctctatctttaggctgttctttggagaaaataaatttttggcaagaaaaactatctccttaccattattgattttaaatttgaaagactacatgagattcactctttaaattcagctgctaatgttcttaatacagtgaattatatgagtatttgctctcatagtaagtatactgagtttttatctttgttttaatgctagctaccaattttatgtagctagccctgctgccctaacaaaactgattatttggccctttttaggaagtaatgtacagtaaatgctatgatcagatttgttccctgcaatccaactgtgatttattttctggtttctatgttgatgaatagtaatttagagatacaatgcttggtttctttgttttttgttaaagctaacatcagaatcccagtggagggggcaagtaccatgatataattcttgtaacatgtgcattttccctgttcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagtaattgttttacttttcaatgtaattgttttgttttgatttcaaaaaaatattttttatatatgtagtcactgaaattttatgttatggagaatactgattattgacatggaaaatactcctgtttcccagagtgagacatggccaagtgacgtaacattcttgtttggaatttgatcatcagtcccaagctgaactacagtttaaacttctcctatctaaatcattttccatttgaagcattggaaacatttttatgttaatgtgtttattcttttataatatcaatcttcatttaag

SEQ ID NO: 122084 - DNA, 1055 bp, Homo sapiens
agatatgtatgggccaagtgcagtatctcatgccagtgatcccaacaggggggagctgaggcaggaggatcacttgaggccaggaattcgagaacagcctgggcaacaacaaagtgagaccccatatctaccaaaaaaaaaaaaattagctgggcatggtggcactcacctgtagacccagctgcttgggaggctaaggaggatcattagagcccaggagtttgaggctgtggtgagccatgattcatgctgcagcactccagcctgggtgacagagcgagatgccatcttaaaaaaaacaacaaaaaaaaaaacaaagaagatgtgtgtgtatatctatggatacacacagtagagtctgagaataggaaagaataagggaagaaaaagaagatataacgatgtgggtatttttcattaaaaattattttaagtgaaagatattatgactgtaagctggttctatattttcattaacaaatgattctcatttgtagtagattaaaaagcataggaatattttatgatgccaggaggtagaattgccatggagcagagtgtttacgtatagatgcactaagctcaggctcagtgggttggtgatgtattaaagaatgtcagtgtcatttaagagttttagaattgcagagtttaaatacatttagcagtgaaaatagtccaggtattgctgagcttaacaatagaagtacttggtgaaacccttaatgcaatacctgtacgaaatgttttgatatagcaaatggtagataaagtcttgtgtattactgtagaatcttttcaaatttttaaatgcttataattagaccaagaaaacgttctctttaaatagacagtactgcgcaagaagcttcagaaagcttcttctaatcattttgagaaaaagatgggtagattataagtaaataatttatggatatgtttcaaggaactatgagcattaatactataagcatacattggggtcttttgtatcatctaaagtatgctggaaacttatcaactataacaacaccgactgttaaggtgacttgagt

SEQ ID NO: 122085 - DNA, 1114 bp, Homo sapiens
gtctcaaccctcagtctgaattgtgagaattgatctttagttcagtccagccagcagaaattgtgcaattttctgttgtatttattgtacagactatgtacgttctagaagattcctttagtgctacactgttgtactttttgtcccagcagtttgagggcgtgcaaattccacaaagtcatcaataagaacaggccatgctccttcatcataattagacacgtgatttgcaatcactgtactgaagtctaaaagaagattccaagtgtcttttggtattgattgtttgtgatgttccacaaaaatttattccataagtctaagaatttaaatcttctattaagcactaagttccagtaggcaatggccatttctagatctaatcctttttgtcttggattctttgcaaaattaaaagtaaactggtaaaaatccttaaattgtcctggttctttcaattcttgttacatcttgggtatctgggcctttagtttttctatgctgtcacatcctaattctgtcatgccatccatgaactcctgtttggagaactcacactgtattgctgctctgaacatccatgcaataatcaacacactaatgctggctggattgagtgccaggccatcacagaactgctatataccatctattccaattttattctcattttgaggatctttgtctctattgtacagttgttctaacttcttcctttccagtgatccttttacactctctcatatataaagttcaggattttggaaaaaattatctgttgcaacatctaacttccagtcattttgagatagacaacttactgcggtttttttcactagattgtgtgaagatcataaactgacaaactttatccttctgcgatgatttcaacttgttcatgttggtgtcctccaggcctctcccctcctcctgtggctctgagcgaatgagcagcaatattcttaaagactacaagaaaaatgatgttaattcatgaaaggaaaacacatctcacacacatgcacatagagaaatgtgacagtgtacactgattagaaagatttctagaaacctatgcttgcaaatttaaattggaattaatgtatgttaaata

SEQ ID NO: 122086 - DNA, 1345 bp, Homo sapiens
gagatgtgttttcctttcatgaattaacatcatttttcttgtagtctttaagaatattgctgctcattcgctcagagccacaggaggaggggagaggcctggaggacaccaacatgaacaagttgaaatcatcgcagaaggataaagtttgtcagtttatgatcttcacacaatctagtgaaaaaaaccgcagtaagttgtctatctcaaaatgactggaagttagatgttgcaacagataattttttccaaaatcctgaactttatatatgagagagtgtaaaaggatcactggaaaggaagaagttagaacaactgtacaatagagacaaagatcctcaaaatgagaataaaattggaatagatggtatatagcagttctgtgatggcctggcactcaatccagccagcattagtgtgttgattattgcatggatgttcagagcagcaatacagtgtgagttctccaaacaggagttcatggatggcatgacagaattaggatgtgacagcatagaaaaactaaaggcccagatacccaagatgtaacaagaattgaaagaaccaggacaatttaaggatttttaccagtttacttttaattttgcaaagaatccaagacaaaaaggattagatctagaaatggccattgcctactggaacttagtgcttaatagaagatttaaattcttagacttatggaataaatttttgtggaacatcacaaacaatcaataccaaaagacacttggaatcttcttttagacttcagtacagtgattgcaaatcacgtgtctaattatgatgaaggagcatggcctgttcttattgatgactttgtggaatttgcacgccctcaaactgctgggacaaaaagtacaacagtgtagcactaaaggaatcttctagaacgtacatagtctgtacaataaatacaacagaaaattgcacaatttctgctggctggactgaactaaagatcaattctcacaattcagactgagggttgagacaaaactttaaggatacatcttggaccatattgtatttcattcttctaatggtggtttgggcttgtcttctagtctgggctgctctaaacatttataattccaacattgtggatttcatcttacatctgtggaccatcctactttattctcccataagtcctagaagctttatggtgattattttgaggtttccattcttgcataaagcacaatgctgtcttcatcagaaaacagttggcataagaattaaacatatgaacatcacaaagccatttataagaacttcttaaactacgctttgggctagttgcaaagactatgttaacagcact

SEQ ID NO: 122087 - DNA, 1890 bp, Homo sapiens
ctcatactatgttttctgaaaacttttgttgttactaccaaataaaatacatggaaatggtctttattacagtagtattattcacacatctgtattttattttaacattatattctcctgaaaaaggattccacttatttcacaatgttttccaactgacagtccaatggaatataagcttatctcagaaatttgattatttcagaaagttagagctcattgtgctttaaaaagaaattgaggtgtaagaaggacttcacaaatatcatcctccttggatacataaaatgttatgctttcttatgttctattcgttgttttgtgtgtaactcagaaaaataatgcaatttgccagaagcactgtaatctcagttttcaagtatttctgttggtaagagagaattattcttctatgtacacttgcttcaacttttagatttaggtcttttatatcatctttttaagtattttctgttatttattaaacagtataataaatttgtaagatgaatgccaaacaggtgtcatcttttttctgatagatcaacaaatgaacagctcagaatcagtgactgagctgacagtattactttgctgaactaaaagcatagaaagtgttgtgacctggaactacttttacttttttaaccagtgaagaaggaaggaatgagagagaaagaatcaattaagacctcaaaataacctgtgaatgcagctaaaatcagggaaaaaacaaaggataaataaattgtcatttgagacccgcaccaaagtgacgtgggtgataccagactgaaacttaaaagcagggttttgtttttttttataaatcatggactgggaatatgatgtgatagttatttaaaatatttttgttaatgaagtttctacgtatatatggatttcagaattcaaggaattttaacacaatacatttagaacagtgttaaaatatatatgtatgtgcatttatgtatttctttgatgaatcagaagacccctaaggctctttaaaagtcctgaggctatcattataaacatcagcacattatggatatattaacgtgctagagagcttattaatatggagctgatagagtcctgttaaatacaattttgctatttgtagaccaagcaatggttttttttttttttctttttggagaagacaaaaatctacagatatccaccacatcaatgtatcagtaaagttaagccactgagtcttattttataaaacaagtggttggttgctatatttgagaatttggaaatgcatatatacctgatgtatcctcatatcacaccctagaagtttaatgtctggtgaatcagccccatatatgcataccaaacttaagagctgtactttataccccctcaacatatatgtactttgttttccaatgttaaaagcaccaaggaaatgcaaactaaattgaggaactgggttaatttagcctacagtatgtgcttgcctgttatgtgtgcgtgtgtgtgtgtgtgtgtgtgtgtgtgtgtgtgtgtgtgtgtgttcctctaagatgtttggggtttgactatgactttagccataagaatgcatgtttgctttctcttgattcacacagagcagatggatgcttgactgcctcctaatccacagctggaatggtttcagcagttgccacgttgccaggttagagtggcttttctagtggactgagagggcagcaaaagagggatatcattattcatcagtatcccagtgggagtgctgccagcagagattaattttttctgttatgcttgtaaaacaagctcaggtggagtctctaatcctcagggcacgggtggcagatcaaggaagatgctacaaagctagttaattttctgattctgggggaaaca

SEQ ID NO: 122088 - DNA, 1093 bp, Homo sapiens
ttgaaatcatgaatagaggccctctttggatcttgaaaacagtaactttttcacagttagtaggaggttccatctgatttattacttcagttgacagatataatataggccaaaaatttatagattcaaaaagagatgggataaatttattaaaagttactaaagaactaaaatagaaaatggaattgtgcttgtcatatttggtgtgataggtgattttttttacaacgtagggatcaggattggacctgcctggcatttgcatgaatttttttctgttggagctctggatactttaggaatatttttattcttcagagtattgtgggcttttttttttttaatgtggcagtctgttaatacttgcagatactaattcctgttgattattattccattatatgaaactactccagtcaacagtgagaaggaaaatacacttccactcattttttttttctcctgtgacatctcttttgagactgctatttttatttattcttctttccttgaagctgagctgtttctggcttatgtttttagatattgtcatccttaaatgatagtaaaatactctagtctgggtggaaagcaaagattctatcgaaactttctcttcactaatctccttctacaatagaaacccatttattttaatcccatcttttccatacagcgattaaaaaataataattactttttactgagaacccactacatgctaggcagtttatatacattatttataagcatcaaataacccttcaagttaagtgttaatatataaataacgaaattgaattttaatctcattaagttgttacaggttctatagaaggtagctccttagaacttttttttataccctatttccttttcgacatattctatctttatcctattatttcattccagctgtaaaaaaattttaaagcattgacatgtaagaaatatacttttaaaaaataaagaaccagagttacttttaaaattatgtatgaccttgtaactagaattataagtattaaatacagagcttaagtactaacaaaataattatttcagcatttttttattgaagacattattttaa

SEQ ID NO: 122089 - DNA, 1015 bp, Homo sapiens
agataatgtggtacatatacaccatggaaaactatgcagccataaaaaaaagaatgaaatcatattctttgcagaaacatggatggagttggaggccataatcctacgtgaaacacagggatagaaaaccaaataccacatattctcacttataaatgggagctaaacattgagaatacatggacacgaagaagggaacaacagacacaagggcctacttgaatgtgtaggctgggaggagggagaggatcaaaaaactacctattgagtactatgattactacctgggtgacaaaataatctgtaccccaaaccaccacaacacacaatttacctgtgtaacagacttggtcatgtacccctgaacctaaaattaaagtttaattaattacttaattgattagcagaagattgtcagaattggtaaaaattctatatgttatgcctgtttataccttatcctctgaattctcgccttttatgttctttttctttatatgtggaatgattggggtcagcctggtagttttcagaatgatattatattgacaatatcaccctttgaccaaagaatggagacaacagacagtttctgagtttgcagatgaaactgaattcttccaaatagtatagagctaagctaaaggaaattgtctaaagaaatattttaagaatatattgcagtgtgcctgtcttggatagcttatctttaagtattactctccattttttcatactcaatttcgttgctcactattctacccacagactatatactgattcatcaaaaaatatatttattgtgtgtctacaatgtgtaaggcactttctaagggcaagatacagaagaatgaacattagtgacaaacttcctatgtgtatgtgtgagagagtgtgtgtgtgtgtgtgggtgggtgggtgtgtgtgtgttcacacacagataaattatgggcaatggtagtaaaccatgaaagacacttgcactttggtgttgctgctgacggaagtcatcagc

SEQ ID NO: 122090 - DNA, 1055 bp, Homo sapiens
attgagaagtccctgattgaattggaactttcctactgtattgaaattggagaggtatgacttagtcatatgcattctaattgaaaagattgcccagctttttgacaggtcttttgcttttaatactatcaaaattttttaaaaaattgtttcaaaagcacctgtctgaattattaattttataaagatatgtactttcatcgtactcttcatttgttattcttttgaaataggataatcgcagcattgaacctctaacttatggccgaattgcctcctattactatttgaagcatcaaacagttaaaatgttcaaggaccgcttgaagcctgaatgcagtactgaagaactgctttcaattctaagtgtgagtttttcatatatttcatatcttctcttttaatttagggcttaaagttttgccacctagtttgtcttgaaatttaacagaaaccatttgtaaagccctttcctctgtcaaacaaggtcactacaaagcaacacatctagactaagatacccatagataaggtgaccacataatttatgatccaaacttggatccttctgagtgtggaatgaggtcctattaatatttaagccaggatagtagatgtaaactggactgtcctgagcaaggcaagtcatcaccctatccttaaatataatagcctctttgaattatgattgaaagcttttcttattacttttttggatagttcctgttgaatacttagctgtgatgctactgaagtttctttcataagcatccacacaattaagttcttagaattaatgtcaggacagctgtttatcccccatccccacaaacacccttaccaaaaaaatgaccacagatatatcacatggtaaaaaactatactgtgttcatttttcctttttttgccaaatagctaagaaattaatattagaagcatcttgtccacctttccttctacataatgtccccttctggctttttttccctttgttgattttaagtgtaataatttaccacaaaactttgttaacacattagttaggatattcatat

SEQ ID NO: 122091 - DNA, 1479 bp, Homo sapiens
aaatgaaatagcatgctgacaaaaaggtaggctgtccgtttatggcaaagagaagataatgacttgatgattcaatgcagtgaacataaaactacgttttatcctttacccataattaaacagttgtgaaatgtttgtgtttaaataaccagtaaattacaaattttgtactgtggagagtgcaacatgaaaacagacctttttacttagctgttgcatgctttttcaagttagtaaagtgattattaaaattaatgatatgtaatgttttaagctaaatgcttataattgttcaggctagaagatgcacagtaactaaaaaaagttcacctcatagaagtaaaggctgtattatgctactaatcgagagcatataaatctgtactctattccttattcacagaaaaattcaaaatatattaactcccaaaattttatgtaacctaaaaaacttcatttacatttaaattattttatagtgtctcacaaattgtatatctaattaagatgtaacaatatcttacttttataaggatttgaaaatattttaaatgactttagaatctcagtccaaatattgaccaagaatagtatttggtaaagatcagtgaagttcaatttacttgaattgaattttgtatttcttctgttatgcaagtcaataagaatgttggtgaccacatttagaaaaaaaaactgtgttaagaaaaaataacagtgaaacatttatgttttctgcatgaagaaatgtgaacttttagcaagttagattatgaataatattttagtggtgtcatcatataatttattgtaatctcagaaacatcatttaggttgatttttttttttttttggtgacttactttaaatgtttaagatatatttaccctgactatattttatctggatgaaaaccacagatttgtctttaaaaagtcccaataggcttaaataaacagactttagaagggatattaatccattgaaatataccttgtaaatacagtaaacaaaataaagcaaatacagtaaataaaataagataaatatttaaaagaacctgtaattttttcaaggaaagttttttttcattgatagttttaaatattatttgtaagtgtaccaaatttattcattaaagcataaaaatggtaaagttgacatcccagttatatataggacaacggctgatggtaatccgtaacaggatccattagttttcaaacgacctagtaaatggatagataaaaatagtattttaatttttttgtatttcacagtaatattttcaaaatatcttctttctgtaatgtcagttgcataaagaattgtttgttccaagatcaaggcagacagatttggtttaaaaaaagaatagtttgattcttactctacaaatcctactacttagtatcctgggcacattttgactagtgttttgaatttagaaataactttatcagctatgtattagtcctg

SEQ ID NO: 122092 - DNA, 1049 bp, Homo sapiens
ctgcatgtgtgtataacaaagagactgaggtttacttaacaatagaaaagaaagaccatttttataatatagttatatataggtaaagaaatacaacctcatattccagctcccttcagctaatcatactactatgaagtcctcgccacagcacaccaaaagtaaaacttgtgttgacaaagatttcaaccactgttcctgagttggtcactatatgtctatttatattcttgtgtgtgtctgtgtgtgtatattatgtatatatgcatataaagataattatgtttagatatgtaaacacatatatatacatataacatacacacacacattaacttgtgcaaatgaatataaacacatgtactggtgctttcataaaatataatatattccaaattgagttctggattcaatttgtatgttcagttttactctgttttcccctgagaaagcttttaaatatatctgaggcaaaaatgtggtagtttcagctgttcctgcaaccactttcgctatttgtgtcattgttattgctgcataatctgaacataaaaaaaatggtgctgtaacaaatgacttcccactactgacagttatagcagcagcatttcaatactgatgaaaaatttcccagcaagatatctgaacaggtttacataaaccaaacaggaaatggctgccactattcacattaaatccaaaccgtttggtgtaactttatctatgttttacattaatataaaacctctttcattctcaactggtgaaatttcatcagtattaagatttgaaaaagtaacttgagatttcatatgtagtattcttgtttgtcctttgataagatcttttaaagataatttttgaaaaactttttagtttttgattctttaaattttacgaactttgtaaatttttatgatagggagaggtttgttatgactttttcccaatggactgctaatagaagttagcttgtgtagcccatgtgctggatgctgtcagtatcaaactgcctttgactttcacacctctcaggggactagtaattg

SEQ ID NO: 122093 - DNA, 1417 bp, Homo sapiens
aataaatataaaaagtgtttagctgtactattgatcgaagataagaagtaaacaaaaatacaccagtttgattttttaaataatattcagagttttgagaacatagtaacattgagatgctaatatgtttatagctgtgtgcctctctggaaaacaatttttgaataggtatatgtatccttttatcattactaaatttacatataggatgaataatagtatttactattacagggctttagggaaaattaaatgcatatataagattactgttattatttcaaatttacagttaaagaaacaggcttagtgaggttgtgtgacttgttcagggccaataagttctgtaagaaagcataaattggaacaatttctttctgtctgcaaggattatggctgattttttttttccactattttttggtctgtatttttaaaatttttggcactgaacttcaaaaacagtgttttttataacaagagatgaacagagacactgaaatattgcatcctttttaatggttgttactcattaaagaacatatcatttatctacagattttttttcttgatgcataaaaataagatggataacatttaaactttagtgtgtttagagtatatattctcaccaagtagatattcttttcagttagttgaactttaatcataactgtatataggacttatattttatgtccatataataacataaagacaaaattaatgttttttgaaacatgaaaaattaatgaaaattttaaagttatgcatctacatcttgtaattttgtttttacttgcagatggagaacatcattgcaacagtaagagattccaacctcaagctgacccttgctttcgggataggaatgcatcatgctggactacatgagagggaccgaaaaacagtagaggaactatttgtaaactgtaaagttcaggtacttttttttctccagtgaacacatatttaaatgtaacttaaaagttatattttacttagatataagatattttattttgctttttaggttcttattgctacaagcacattagcctggggtgtaaactttccagctcatttagtaattattaagggaacagaatactatgatggaaaaacaagacgttatgtggattttcccattacaggtaattttcttaaattcacagaaatacatgaagctctattttaccctgagtaaatttgaatttgaataattaatttgaatttccaccaattaaacttctgagaattggtcacatttaaacagatgataagcaattatagactttttgttttcagttaaaatattatacaaaatattgctgctgtatttacttttacttacacaaaagtaagaaaataataagtggcttaaagtacttgttattaagccatccaaagttggttt

SEQ ID NO: 122094 - DNA, 1109 bp, Homo sapiens
gatttagctgttattgtttgtatttcatttgtacatttaatttatatttcacttatatatttacttcacatgtaatttaatcacatataaatatatttatattttgaaagtatgataaatcattttgaggtgtgcttgtctttgagcgtcagaaagagcaacgaagtataaattttgggagtattgatacagtttagaaactattctttttaattcatttatttcttgaattcttttttattagtgtatcagtagaatgctgtaaaatgtttcattgtttttcttccttcagtgtatggggtttatcatacagacttgtattaaaagaaattaacatttggtgattataaggaaatgttttagtgtcatttaatatctgtaccagatatgatagatttaattatttttatttaaaaataaaacttcagaacttttatgattcttctgtggtacatcttttattgagcatttcagacaattgataagcattattcagtggcatatggtctgagtctgacatgctttgaaaagagtatagagttctgataatgaggattctgtgaaaatgagaaaaccagcacaacagatatgctttgagaaagtatgggtttttagcatcttgaaacaatatatcacattcaaaaggacagaattgggctgcacaatctgttagctcattcttgttcaatctggtctcctccttttggtgccaacgttgtcatcaactcactgaattatattcgactggaatgtatttcaggcacagagtaatgtatctacttaaatggaatctatatttctacaaaagctttttgagtataataaatataaaatgtaaaaaagttctattaagttaaagtaaatggttcaacagtttacatatgtgcctcctccccccaaccttaagaaaaagatcactacctagaataacatagatctgtttttctgttacgtataatattgaataatttttttaacaatcaggtggtcagacatatttcaaaggctatttattggaaagacacctatacattacaacaaataatttgttgaacaaaaatgaactatggaagtaaaacttcttctatcagtgtttcatttatcatggt

SEQ ID NO: 122095 - DNA, 1848 bp, Homo sapiens
ctttcgcttcctacttccccaaaatatccataaaaatagcagtcctctaattcaaagccataggcagcccttctcagaatctgtaaagtattcatttttaaaagaagaagttatattttggacatgttagtttgtatatctaagactttcaagtggagatttcaaggcaattagatacaagtctgtaaaacccacagagactgtgaaatgaacatatgaacatggatgcatcagcatggcggcaacccttaaaccaaggtaagcacatgagactctcagacagagtgtggagaaacagagggcaggccctgagggattctcttagtgcgagctgagatagaaaatgaggaactggcacaggtcactgagaatgtgatgccagtatagtaagacagtgtcctaaaacactgtagaagagagggttctgtgaaggaaggagtgcttggctatatcaaatgtaaatgggagttgagtggaggagagcacaggaaacacccatggggtttatcatttgaaggtcctggatgaacttggcagtcagtgacatgtgaacagaagcagtttggaatagactgaggagcaaatgaggggggcaaggaggtgaaaatagaagcaaatagcatatacaacttctagaagttttactgtgtaatttaattaatattataatttaacatctagcaagtatgatctgtcagcttccacccaatattctgcagtctggtcccatatttcaaggaaaatagtgctacgatctggatagttgccaaccagcactaacagataaaagaacagagggaaggccttttcttctgagtgagtctatggattgaaagctcagaatactgggccaggcacggtggctcacgcctgtaatcccagcactttgggaggccgaggcaggcagatcatttgaggtcaggagttcaaggtcagcctggccaacatggtgaaaccccatctctactaaaaaaaatacaaaaattagctgagcatggtggcatgtgcctgtaatcccagctactcgggaggctgaggcatgataattgtttgaacccaggaggcagagattgcagtgagccaagatcgcgccactgcactccagcctgggtgacagagcaagactctgtctcaacaacaacaacaacaacaacaacaacaacgacaacaacaaaaagttcagaatactgcccttagatgagattccttttctggggtgggaaagcaggatgctggctgaagattagacttcattctttagtattgcttacattatttccctcaacacctctgtgtttcttgccagttaacagcagggcggcccctttcttctgccacactgttaaataagatccaggtagctaaaagaagaatacaacaacaagaactcgctattcacttttgtccttacaagtagaaattaattaggattctgcaaggccttttgccatgaatgttttaagttgtgctctaaagtctacaacatcatccaaaggtaggtgggggaaaaaatctgaagcaggaaaggtaagagccttctgactggagcaaaccatggaaaaattccaggtagaggtaatacgaaattagaagggtatgggagataagagttccctggaacaaggaacagcagtatagttaatccttgttaattcaaattaattggctggaagtctcttctaaattatacagaacattattttttgaatgtgccaattataattttacatggtgcttcaaagtgaatttatgaaaactgtaatgcaggtgcataggaagaatactttcatgaaaagtaagattgatagtgttttcacatgcttaatactaaagtgtttttagatgcta

SEQ ID NO: 122096 - DNA, 1032 bp, Homo sapiens
caagcgattctcctgcctcagcctcccgagtagctgggattacaggcgcccaccaccacgcccagttaatttttgtatttttagtagagatggggttttgccatgttggccaggctgttctcgaactcctgacctcaggtgatccatccgcttcggcctcccaaagtgctaggattacaggcttgagccaccgctcccggcctcaattttcagtgcttcagaaaatttaagaaacctacagtctggtgtagaaagtatgtcgttagccctcagttacctatgtaattaactgaatagagcagtggggaaaggataattttttaaattaattttttgacttttaaagacattttttaagaagaaaatttgccatactttcattttgaaacagtaccatgaacatctaactcaaggtacagaatactatgttaccttatggattatttcttcttgttcaaatttcaaatgactggatttatctttcatgaaataatcttgagagtaaagtggccttctggttttctaactgatacctttctggattatggaaaatataaggtctgttgaattcaagggtgtataactgtttctctaaattattttgtttctaattccctaggcctcccatccacataataagaaacaactaaatctagtttctttctaggttttctcagggcaggttttgtttactcagtcatgctttgctttaaaactcccacccaattttctacctggaattaccctaaattcattttactttccattgacaacaatagttaactcaactgctcttgcttggtcagtgtctaacagaacaaaagtaattcgttgttagtaatcatttcagtgttgaagtctgcaaatggttttaatttttttaccacttgagacagatttaggttttgttctataacatgcatatacttgttattcaaatgactttcctgattggaaaaagaaggatatggcattatagttggcttatagggcactcccccagaaaagcatccagtatgtcaatatggtaaa

SEQ ID NO: 122097 - DNA, 1034 bp, Homo sapiens
aaagaaggtattgtgaatttccacattaatcaaaataaaaattttaccgtatttataaatctttttcatttatctaaaatcaagcgaaaatctctttatattcaagtgagtctgtttatagtagtttaaacactatcaagtctcagtaattttaagcaccctattaatagctaaagaaaccttgatactgactttaaaaactgtgaattgctaattcaagttaactattacaaaatattcaaacatgccaggtcaagaatgtcagctattctacatagcaaatcataaaacaagcaataaaatcaccttctctgaaatcccatttacaagtcagattatattgcttttttctgcctggacacatttcttctatgtgatatttttcttgcaggtcacattttacatcatgtgaatattggactgaaggtcaaacaatgtgttcatcagattccttctgttatgatggaagcatccattcagcctatcacaaggactgtcctccgagtgacactcagcatctatgctgatttcacttggaatgatcaggtagaagtggaaaacggctatatctgtgttaaacaaaaatatctgtactacagactcaactacatctgttcctaaggcatatagaaaatcctctaaaaagaatatatattgaggatttattttaaaaattatagcaattagccgggcatggtggtgggcacctgtagtcccagctactcgggaggctgaggcaggagaatggcatgaacccgggaggcctgagcttgcagtgagccaagactgtgccactgcactccagcctgggcgacagagcgagactctgtctcaaaaaaataataataataatagtaaaaaattatagcaatatttattctcatcctcaagaaaaccatggtatattagtaatatgtcaacgagtgagattccttcaaaacatttaggaaacctaaatttcaacaatgaacaacagtttagtggatttaactccatagagattttgctatattagttctatcttcttttatttt

SEQ ID NO: 122098 - DNA, 1850 bp, Homo sapiens
attatgtaaaaatcaaaacaaattccatcatgctaacttaaataatgaaactttccattggccctttgcctataaagtttatattctccagatataataagcatctctaattctcagtactagtgtttctgctatatcaaatttgcctcgcatgacttttatttgtgaattatttgagtgcttctttctttactccgcttcccactttcaactgagatgtaattccaaaggaatataaaagctagagtcgaaggagacattttaattaggagcacaagaattaaagatatttctccttcatctttaccactaaagatagtactactaaagaaatatttcaggtgttttttaagtacaagaaaatctaaaggaatcattttctaaacgtctacttttaaaaaagtgaaaagctctgttgagtcttctgtcaaattgaaattcccctatccatattgcacaggcaaaaaaaaaaaatacttcttggtaatgttgagttttctattttacttttaagttaatattacaagtatttgcttagaattttaaaactttcctatatataagataaaaatttcattaatatatttgtatataactaatatataaaaacaatagttgatacttgatgtactttttcattaacagtggcccttttatagagagaagaggataagacattgaggttatacatttatccatttattcattcctttgttaacagtcatttgttatagacattctatgggtaaggtgtttggaagagttggaagtgcattatcatcctatatgggccaaatgccagatagttgaaagttaacatcaacatttggttaaagtaaaggccagaagaaaatatcaccatcatagaaggaatttctagtagaatataatgaaaatttatcaaagagaatttaattataattataaatttagtagttagattttaaaaattggacattgtaattcaaaagcaataatttcttagcaccgtaagctgctagagtaatcttgtcattaatatactgcatattggggatactaataaatgctcattttcagctgagaccagtagaagagcaagacttattttactgtcaccaaattattaagctattctttctctctgataataagttacttaagtaagtatttgtctcttctctcctaatcttgaagatttggtcattgctaaatggtactgttttatttaagcaaacttacaaactgaagctttgtacagtgtttaaatatagtgttttccaaatatttttagaaaggggttgaaaattattgtcctcttacgtttttaaatttctattatttttgtgtttactttttattctacacaattatttgaaaaagcagctgctcttgaacagttcatttagaagtatcagtggagaatggaactgattttcaagatgacagaaaacatttatgatatttagaaaaaaaaatccagatggcatgtcttgtttatattatgctattagactggtcaaaaactatggtaataaacattatcacatgatcattggtcatgcctaattcaagaacaggaaaaatcatgttgacctaggcattctgctgttcacacttccaaaaccaaagccaaaggtgattagcacatttttaactaaatatcaaggaaaattcaaagcttgatacaccctcaataaaaggttgtttttacaaaaagataaaattccctgataataagagctcacaattgtgaataaaataatcaatagattaggtggaggttgtagaagtggaaatacttgcaaaatgctgattttaccttttacctatctccttactctttttgacacaaaactctgtttttcttt

SEQ ID NO: 122099 - DNA, 1010 bp, Homo sapiens
aatacagtgtacagcagtaagaaatatgcagtctattctaatctaagtaaactaattgaatttttcctgctactacctcatgctgcctgccccttcttccccacaatcagttaaaaaaaagtgaatactcttcggaatttgcttttttcttgccttcaagttgttcagtatcttggatttctccctggtttggtttccttaagtactttggttttatcagagaagctacgtttcaaaccattagtgagaagactgaaatacatgtccattcgaaaacaaaagaactatgactctcaggcaactaaacactttttaggcaaaaaattaacagttttatcttaaataaacaaatgaattcaatttgtttctccttatttggattaaaacaaatttcttgttcaaaaaccatgctgatgttctctgatcatactattccatgggttttagtgatctaaacttgcgtgctcgtgtacttaatagattttatgtgcaactttgccttaaaagtgttaaaaacagtaggaggcagttgtgttccactcaggcatgtgtgatgacagatggagaaaatcttttcatgttgacttttcaacagtcctactctgcaagacttcaagctcttcttggctattgggaaatcaaaagttggcgattcagcctttaattttgatccatctgctcaaactaatgagacgtctcatttgtaagcttctctttgtgttaccaaatgcaagtacagctttatcattccggctaataattcccctcctcctgtgtaacttgcagaatgggaaaataattaatgccttaactctattgagatttttcttgttatacaaactttgttacagttataggaaaagaaattagaaacttcctcagagattatggcatatttagtaagttaatttaggttcttttccatattgtcaaaaaagttaaattctttgcagcttcttactgaaaatctaccttcagttttaaggaataaaaggccttgtgatactaaa

SEQ ID NO: 122100 - DNA, 1050 bp, Homo sapiens
cagtttctgtttttgaatgattagtgatgacattcgttttccgtaagagtgggacttcaggttttgtagaaatacctacatatctcctatactgtttgttagctataaaaataaaatgacaatattaaaattgtttatagttttctattattttaccattttaacattgtaattgcagttttatacattttccattagtcttttatccattcacacatgtgccttttaattttgctccttcaaacttaatattaattattagttatactgcattactaaattataattataccatatatacagttttatattcactttttcttaatgaataataaacattttttaatgtttctacatggtcttcacaattttaatgtttgcaagagagaaaaaggaatctttattcaggttctaattttcagataccatataagtctctttggacttttaaccttcccagtcctctgacataacatgattatttctctttgttaaagggagaaatgaacctaaggcatgttaagcagcttcccaaggtcacagagctagttaagagaggcaccagtacttaaatgcaggtgtttgtgttgataaaacccataatgtcttcagaacttgacactgtccctttgaaattaagctgatattggttattattggttattcctccattattaagtacgttaaatgtttgcagttttctgttattaaagattatgctactgtagtgattatctttctacctgttatttttgtttaaatatttactttaaataaatttcctaaaatggacttttggcagaaatggccacattgtgtggtcttgccgtatgaccataatgtatacccaatgaattaaaacattttgttgtcacaggagacctacataggattttataaacataggccatttcttctgaatactgttatcaatctagtgctatgtaaggttatgatctaatgtatgtttgccattttggattttttttttttttcggtcttaaggcatagaaaacagagtgatgtcataccagtgaagttttttcttaa

SEQ ID NO: 122101 - DNA, 1987 bp, Homo sapiens
aagacataacattccagattatttctatttcaaataaagtatttctcacatagatttaactatattaaataactgtattataattatacttttagatttaaaaatgttgttttaaagtggatttttagcagaaaaatgtctggtgtttgccagagtattgtgtctttaacatcaaacaaccttaaaaatatattctgtaactattgtgtcttaaaaaatgattttaaaaccaaatatcactttcatttctttccaaatcaccactagtactacatagaactgtgggataattaatcgttctaattactgtatgttgtgaaagagatttctttaaaaataggtctggtgattatttccccttatttagggttccttgcttttgatgggatttggtttggggttttgccaatatctataagatttcttcagtgaaaacaaatttataataagatactatatatgtattggtactttaatttttacccatctctacttttttgatccctcccttgttatgtttctgcaagtagtctctgcatgtgtggatctatgtcttattcagcactgcatccctagtgcctacagattaggtcctaacccagtgttgatggatggatgactctgaaagtattaatattattcacattgaactactttgcttatacctattgagtctcctagactgagtaaaattattaacagcttactcagaaaatcatactgatatattttaattaacaaatgaatggaagtttttggccatcccttggttttatctttttaggtatgttacatcataatcagataatatggcctatatgatttttagtttttggaatttactgagttttttgtgacctaaaaatacatttagttgtcacaaagttcttaattcacatttttatttttatttttattcatgtatttatttttgaaacagagttttactctgtcaccgatgttggagctcagtgacatgatcatatgggctcaagtgatcctcccacctcagcctcctgagtcgttgggactacaaatgtgtgccaccacaccagttaatatttttttttcttttggtagagatggggttttgccatgttgcctaggcttgtctcaaactcctgggctcaagcaagccgcccaccttgcctcccaaagtgctgggattacaggtgtgagccaacacactcacccctcatgtgtatttttaattatagtgggtatggaattctactatgtatctgttaaatcaagcttgtgaattatgggctacaatgtctgacatgataggaccctcaattgacctctacactcatctctgtctagagtttttagaagtcctattaataggacaaattataatgttttttggttaaattaatttaaataacccatatttaattaaaataatccatataggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataaggtaaatactcattttaattcttatctaaaaatatttttgttgacttattattgaatacttgtttggagttagagactccaaaagaccatttcagccttttgtggtgtccactgaaatggccttttgcagaacattgaatcacattacagatgtgatatcctagacaaaatcaagcatacttcctcaactatttgtagtagagtaagtcctcctatagaaagtagcttgtcatagtttgcattggtgttttccatgtatgttacgtattttcagctattaaaagttttacgttattttgacgtgaaatgattgaagggcattgtggaataataaaaactccaattaaacaagtaatatatattgtgatgatattcatttaatagaaataata

SEQ ID NO: 122102 - DNA, 1053 bp, Homo sapiens
aatatataattttttatttaaaatataaattaattgtaaatagtatagtttctatataaaatctataaatgttataaactatatcaaactatatattataggtttattatgtattatatgcaatatattattatataaatatatagtgtatcaatatataagtgtatatcatatatattatatatgtataataatttcatcttcacattgtcatctgtatattgtaatcaaattctaattatatcgttttgtactactttgcccataaacctttgctgacttgctgtttgttatcttaagaaaaatggtcaaattgtttagctggacgttaaagactactaatattaaagcgctgtctgtctaattttaacttctacatcttcatcagctaccagaggttccagccacacaaaactatttgatctttcccctacctccttttaaatatcattgaccctctttcaaaaacgaaactaatctaacttgaggcagaatgtgttgttggttgtgagataaggattgtaaatgccaaattatgtaatgccttctttttttgtaactccacccatccatctatggaaaatttactgttcttttgaatccatcaaatgccacttctatgatgtgtttcctagttactgaatcagaatgaattacaccttttctgtgttttctttgcactccctttttttacatagttttaacgcttatgatgatcttccttataatttcacaacttactatagtgaattctgtcttcatctaaatgcctcactagaattcagcttccttgacagatgtgtctgtgtgaatcttttcatattttcgaagtattagtacagtgctcatagttatttttattacaaaacaaagctcttatttttatttgttccttgtgattaccaaatgttcccagtagatggcacatcacatcacacttcaacatttgtaactaatgtagaagtgccttccaaagctattggaaggcaatgtagattttgttcaggttctgaacttacatgatgatattaggcactaaattcataatacact

SEQ ID NO: 122103 - DNA, 1015 bp, Homo sapiens
ataaagagggttgtctgagtgtctagttgttgagagaagctacggtagttccttaaatcttctaaaatatgctgaagcacaaagaagtaaagataacaattgtttagggaattggagagaaccagaaattgcttttgagcttaaacttgaatggtaatgaagagtcaatgagaagtcttggaacattttgtaagctggaatgtgacatgatcagatttgtagtttaggaatagtatactctgtttcttgtcataagtctataaaaactggaaatagctgcattcattcatagcactattttaggaaacctcgtataaaaatgaaatgatatatgatagtaataataatagctaccattaatttatttcaacatatttaacaagtaccatctctgtgtatggtttatagtatatgatttataaatattatctaattaaagactcagcttttgaagttatatgacttcaaatactagctctaccatttatagttgtgtgaacttaaacaagctttctcaagtttcagtttcctcatctataaaatattctggtatggctatagaaataattaggatattttatgtaaaggactcctgtgcttagcccatagtaagcactccataattgttagctattttaaaattaatttttgtaacttccttgtgttaaaaagataacacctttaccttgcaatattaccttgcagatgaggaaattgaatttagagatcttaagttacctgcgggtcatacttgcagtattaccttgcagaggagaaaataaaatttagagatcttaggtttcttaaaagttatattgcaagtagtggcaaagccagtattttaacttgggtctctgactgtaagcccagtatcctgaaaaatgtgctgtactgtccttccgaggctaagtgatcaggagaaattggtgaagaaagtatcagtggtactctcagatgtttaattggcctgcctaagagcttctaggcctaagagatactactgtgatctcttctg

SEQ ID NO: 122104 - DNA, 1033 bp, Homo sapiens
actaccctaaagaaaatcttttggattaagtttttgaagtgagttctgatattaatagttcttgttaagatggaaaagatgttaataaaaacacacttgagaaatatgtaaagtgggatctgaaaggctagcatattggagatgtattgaagtatacatatctcagtattatttcaatattacatgctatttgcaaagctattaatgctgatgtagatactgatagagttattgtataatcagtttttagaaaaagagagttttgagttttattgatacaaccgtagtttgcttttgtgcagatgggctgcttctttatagcatttgtgatttgacatttgccgttagtattatctcttgactctatgcagatggcgttacttgacccatgcaagttcatttctgaacctccagatatgtgtctgatgtcaagcagtgtgagttatttggttagattgtcttctgagggaagactgtgtattttttggaacttatttgcattggaaatgattctatcatcctttgaaaatttggtggagaataattagcttgctttaatacagtgattctcgttttttgttctcaaaactcttttgcacttttaaaaattactcagaacctcataatttttctttatgttattgaactctattgatatttgtcatatttgaaattaaaattgaatttttactatattaatttaataaatgtctattaaatcatttgttttttagtctttcttattattctttcagagacagagtctcattctgtcacccaggctggagtgtagtggcatgatcatagtttactataacctgtaactcctgggctcaagcaatcctcttgcctcagactccctagtagctaggactacaaggatgcctcaccacacacaactaattttttaaagaatgttttgtagagacagggttctgtgatgttgtcctgactggtcatgaattcctggcctcaagtgatcctctcaccacggcctcctgaagtgcagggattgcaggcatgagccactgca

SEQ ID NO: 122105 - DNA, 1866 bp, Homo sapiens
tgcaggagagttagtaattagggtagagtattaacatttatgaaacaccacaacccagcaaggtttaaatttttttaagtatttgtgatttttgaaattatagatttaagttaatggttattaaaaatttgacactccaaaaaagttgatctttgttgatgtttctgtgagtctacaattattttctcttcaaacatgggcttatagcttttttacccactattaatggactttttaaaggcaagatatataaatctgctgcactatatttagtgaatgtatatggctatatcagaattcaaccagtaacctaataatggatatttaagttaattacacttttacattagataataaggctgttcttccactatttgatttcttaaggtgacctatttatttttaaaatttattttgtaaacaagaattagaaataagtctactgtctaggaatttacagggaatcagtgtgacataggggaaataacttgtttaggagttagaagactaatgttaatcttgtttaatgatgtaatagctgtttgatctttccctaattactcaaattctgtttccatttaacatctataaaatggagatacttttgttaggacaaagtgagataattatgtgaaagtttttagtaaattattatttttaaaaaaatcccaagatgcaaagtgttagcaatactatctttacaaaaaatgtgtatttacaatggtagataatgtttgtaaatgtgaattccatttttgctcagactttagtatcagttctatcaacccctttaaattatctgtagaagtaccataatccccaaattatccaaatcctgttttacaagttataagtaaaatgtatagaatgaataaataaatgtatataaatgctattgaattaatttaaaagcactatttatagattttcatatattttcttaaatactaaaagaataattgtatgtcagataattgtgtaaattataacagtaaaagtagacttcatacttgaacaaattggaaatatacattgtaaaattgcttattttcctacctataaactgttaatcttctacacatgattgaatagcagataaagtaaaaagtgactcaggcagtttgatgtagtataaaaatactaatctggtgtcagtgaggcctgggtctagtttaaatcaactaatctttgtggagctacctatttggggctaagtacagtgaggaatactacagtggtattgtcatcaataccattgtatttgtacaatgtactcaacgttgtactcatcttgaaagaggtagttgagctatattctgaaacatgggtaggatttgaacaatcagaggccttgaagaagaatcagtatgatatagaaataggcatagagtggggtagaacgtggtttttggtgaagaaattctttttggctggagcaggaaatatataatagccaataagactggaaaataaaatgctggggtcagcttctggcagtgtaggagcttggatcaagctatagtaagctgtggaagatttgtgaataatgatactggagtcatgtttccttcttttttttttttttttttttttgatagagtctcaattctgtcacccaggctggagtacagcgatgctatctctgctcactgcaacctccgcctcctaggttcaagcggtcctcctgcctcagcctctcgagtagctgggattacaggtgtgtggcaccacacccagctaatttttgtatttttagtaaagacgggatttcaccatgttggccaggctgttctcgaactgctgacctcaggtgatccacccacctcggcctcccaaagtgctgggattacaggcgggagcaactgc

SEQ ID NO: 122106 - DNA, 1206 bp, Homo sapiens
aaaatgaggaatcaaaatctagggtggaaagccatttataaagcaatgactggaataggaagtataaaaagatagtagcagaatctggcaattttgtgtgtggacataatggtagatatttagaattctaaaggcctgttaaagggatatagcagtatttgtgacagttattttgaaaattgcagattgcaaaagagttcaaagagttttacttcccacaaagtggcagacagggtaatgtggaacaaccctctacagagaatacctagaaaaactgcaaaatacaaaatttgtttgactatatcagagaagttatcaaagcagtgaagatttttggggccaagatgtggaagcagaaattaacccagaaaatgtgatcctggcatttgggctactttttcctagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtttaaaaattacatgattcagtagagaaaaagcattttatgaatatctaacattacttatgataaaaaatctcagcaaactaggaatagaaggggattttgttaatctgataagctgtagctataaaaaacttggagaaaacatacttaatgctacaaagttagaagcttccctga

SEQ ID NO: 122107 - DNA, 1100 bp, Homo sapiens
tagtttcactcaaagattgataccgggaaggagttttgtaacaggtttgtgatagatttttttttctctaatgatacaaaatttggttagatacaaaacagttaaccttcttttcaatagtagctgttttacattgttcacagcagttaaaacaagagtatattaatattgctatcttaaacctgaattatttcctctcttcacctccccaaggccctttgcaagttactctgtattagagatataacagaagattttaaaatttaaaagtgtgtaagtactacaagcttatcccatcttattaattcctataaacttttaaacatttttttcttccctgaggaaggaaagtggtataatgatgagcttcattttaatataactttttatgtcagaagctgttcaacatatacaaaagtaaagagacaaataagataaaccttaatatgcttacgactccattgtaacaacttaattcattttatggccaatcttatttcatctctacctttgcccattctcctccccctaaactcagattgactagtcacatttgaaattaaaaaatggaggcagggaagtaatggtgaattatgtattttcatcattctaaccaatagcaaaattactgctttctacctgacccactactttttcatttggtttgaaagcttcatgagttttctctatggatcaaagccagaggtctgaaataaaatttttattgtgttctgtggtcagttcttgagagtggaaagatttgtagtctcaaatatacaaaagcctcagaagaacccaaacctgccaacaccttgatcttgaacttgtagctccagaactgtgagaaaataaatttctcttgtttaagccacctaatagaaaagagtgtgtatagaaaagaatcttccaaatgcctcacctggtctaggatcatggttaagaaagtaatgctgacttgaatatatttgaacctgtcatgggagtctaattttccataaatgcgtttcattaaaaagcatgacataaagctcttatttatatacactatagtctaagctatattaaaaacaagcagttagaaaaatggcaagatgtgtgat

SEQ ID NO: 122108 - DNA, 1046 bp, Homo sapiens
ctcttgggctctatatttgggagaagccttcatcattggaaggagttacatcttggcctgctcagaaaaaaggaagtagtttcaatgttagtgcagcaaaaatgcctaaaggtgactgtgctagtctgttctcatgctgctaataaagacatacctaagactgggtaatttataaaggaaagcggtttaattgactcacagttccacatggctagggaggcctcacaatcatggcggaagttgaaggaggagcaaagctactggcagcaggcacgagaatgtgtgcaggggaactgccctttatgaaatcatcagatctcatgagacttattcactatcatgagaattgcatgggaaaaacatgccaccatgattcaatcacctcccaccaggtccctcccacaacatgtggggattaggggagctacaattcaagatgagatttggttggggacacagccaaaccatatcagtgacttacatgtatgtaagaaggtgaagttccatgtggcttgtgggcatcattcccatcttctaatggagcctatacaacctcagcacaaatgttttcagtcccatttgaataagatagagattctagaaattctaggtgttgctgctctgtgccctcctaaacatgcctcctctagtcaatcagatttgtctttaacacatttaggctgcctttaagttctgcattttctactttgcctgcacacagatataatcacagtggaatcctaaatcttaatcactccacctccccctaaaaggatgtgggcgtagaattacttaaatattgccgtatgttagcctttgagaggcttttgcaagttatgagaacccaaccagttgctaataacctactattgcttctggcaatagtaggatctgatctagaaaaggcacggaaaatgtggtcagaaagattgggattctaggagaaattccaccacttacaaagtgtgtaaccttagtcaagttactcaacatttgaatgtcacttttcttatttgagaaataaagtccttgcatgtagaaaacat

SEQ ID NO: 122109 - DNA, 1013 bp, Homo sapiens
aacagacttaaataaacgctagtatagtttctgtcagctcagggcagtgttcctaggatgacaacttcagcccctgaaaatccctgcctgagaaagcttgatgctacaaaagaatttatgctttgttccagccaaaacctgactatagttctctgactacccttttcttggaagctttacttttttttttatgtgcaaatgtgcaaatgtaaatctgttctctgtcccttttagaagtatcttctacaactcagcaatgtccttctcaagaacttgggagccatccttttgaaaagtactcagcaagaaagataagtcccttatctcctagtttccttggttggataggagtctaactttaaaagttagcaaatgtagatgacctaatgacattaatcaacctctctccccttcccactcttaatgtgctcatggactctacttttagcacactctgcatttaaaaagtctctttcattttgtttccatggaattgaattcagtttatacaaaaatctgtctctgctattctgaagtctgaataaaatctgtcttaccatttttaatgtgtctagtgaataatctttcacaatggcagcaccattctttcagccactggaccaaaacccctggaatcatctttgattcctctctatctcagcattacatagattcaccagaaaatcctgtcagttttaccactcttgatcattctttactttcttgggctaagccacctttcactattatctggactactgggctagcctctcagtctttctccttgcacaatgcctccctcagtgggttaagaaaataatagccagagtgattctaataagacatagtcacactatgtctctattttgcttaaagcccactggtgacttcccatcttattacaagtgaaattgaaagcccttagactgaaatagaaagtcctgtaatacctgcccctctcttacccacaataattatcttgctgatttcatctgcttgcctctgttacagct

SEQ ID NO: 122110 - DNA, 1071 bp, Homo sapiens
ctatctggtatagtgtcaacaggtttgcctacttcttttgttgttttaaaaatggtgttaatggggaaaatattgaattaaaataccttgaaacaatgacttgccttctagtacccacagccctcaatatgcagaagattcacaaatttcttttattagtttcagaaatcatttcaatttggtctcttctttagtataattttactatatagttttaagtaaatctaccattttaccaaatatttttaaatgctcacaaatagttcaggcatagagaaagtaaataaccttatcttaatacacttttttcaatgtcttgggtttctaactgtatgttctggctgtgttttatgagtcaactttcatttagaacttggcatagctatgttactgaaagttctttaataataagaatattcttagttataagaattatattacactacatattatattttatattacattatattcttagtaataagaatataaatactaacagaagataccactatggaactactataatggccaaaatccaaaacactgacaacactaaatgctggcaaggatatggagcaacaggaattctcattcaatgctgggaatgcaaaatggtacagccattttggaagaaaatgtggaagtttcttacaaaactaaacatattcttactacacaacccagaaatcttactttctggtatttattcaaaggtgttgaaaacttattttcatgtaaaaatgtggtgtttatagaaactttattcataattgccaaaacttagaaataaccaagatgcccttttgtaggtaaatggataaataaatggtggtatatccagacaatgtaatattattcagtgctaaaaatacacgagctatcaagccatggaggaatcttaagtgcccattactaaatgaaagaagccaatctgaaaagccaacatacagtatgattccaattatatgacatttctgaagaagcaaaacttgagagagaagaaagatcagtggttgtcacagcttgaaaaaataaaggaataaataggccatgcctagaagattttta

SEQ ID NO: 122111 - DNA, 1040 bp, Homo sapiens
tcagtaccttgggaatgagaattccaaacattaattataccgtaaaaatagaacacgctgttcctattcatttctgaaaatataaaatagcaacttaaaaatcacattttaatatgtttgtgcgtgtgctgtttttcatttcggttttattgggaacataatgatagaaatattttcccttaatctgggaattgctactctctttagcccatctacgagtttatacaagagtgctgtgatatttttagttctcttcccctcctaccactattgatgtatagtggggtatggatctggttcaaacttggctaaacaaagcttttttctctctcttttttttaactttggacactggaagcacacacaccagtaagttcctcttattttgtattgagaattgcaaaaattgaaacacgcaggatgttgacaacaatattttttggttgatagagtaatacactttgtaaccataaaatatagccaacatacaggcaggaaaaagcatagatggttagctggggtttgggttgagatggggggcgtgaaagagagagattatgagaaacaaaccttgtattggaaatccattgaatcttggctctccacatgactttatcattcctagtattaaatgagacaacttagtatcatcccacgtttctcattttgcccaaggtatttagaccttaatttcttgtatctttaataaccaagagctctaattaatactgatgatttttgtagctttttggattttctttataatcattatcactttgaattttaagtgattttaaacttgatgattttaagtttgattgcagcataattaacatgagaatgtttcttctcttctcgttatttttctcattcttcctctttgccactcagtaacccagttatttgtgataggaaataagaattatttagagacaggaagaaggtaggagatttgaccagtgtcattggttaaatccacctaatgacaacctaacaatggagacatgtgaggagcatacaaagatactcttggctgaagt

SEQ ID NO: 122112 - DNA, 1085 bp, Homo sapiens
atttcagaaaggtaaactccaaagattaaaaaaggcaaattttcatattattggaagtaatggttcattgtaattgtagctgtctgccagagtagcactgcatctcaggggtcgaaaagatgagctccatattcaaccctatagccatgagaaaaccccacgagagccacaggcatcttcaaattcccaggaggctgttttccttgtcacttcagctaaggagtcctatatccatgtgagttcatttttccatttgaagtctttacagctgtttctctttctctctccttagacgctaaaagatggagtgctttatggagaaccctactggcaatgtgctaagtaagccctgaggaaggaatttctaggaaggagaaatgaggtaggtcttacaaagacaagagtgctggttgtctttgtcccatgttagcaaagcctcagaacccatgagtgctgctgatgggctgcagtacctgcactgtagttgtgtaagtatagggagggtgggaggaagttttctgtccagttcggggtccatcacagaatgatggcttccaggtgcctctgcactgttaagtgatatactccaattatgtctgcactgcagacagcaaggtagggggtcaggtgagacttatcactattcccaaacagacaaaccacaatagcaacaacaacaaaatcacactcacaatttgttgaagaagtttacatagcagaaattaaaatatgaaacaatctctaacctccattctattctcgaaagggtaaaaattacctttcaaagggctaagtaacttctcctttaaatgaatcataaaactttcttatgttctttgaaaattctctatttaacccatctgtgaccttctcagaggagacatagcacagaatacatgttattttacctggaacctcacagcaaaggacattatctaaagcaaaagctgaagacatgatgaagcacctaaataaacctttaaatgtgtgcccattcactcatggctcctctaatattgcaaaatttttgaagtatttttctcaccgagttttaataattccatctcaaaagacgttttacatta

SEQ ID NO: 122113 - DNA, 1049 bp, Homo sapiens
tagaatgattttagaagtctatgaaagagaagaaagtaacaaattatcttgaagagtgggagattaattgacatgggaaatatgagtgccagacctcatactgatcatgaatctaagattagacaatcagtatgtatctgtgtttgttttgtttttcagccatgttcagttacaagaatgtatgcctgccataggagaaaatttgattttaaccgaggttgtgttttagtcaagagaagagcttgaagcaagggaagtgggaatataatcaaagaagtaaatgtagtactaaattatgaaatttatgattaataataggaaagagagaaagtaatgtctaaagtcataagatcagtgaattttgcatttacttggtcagaggtttattggatttgggctaggagagggaaggaactggaaagacagaacagggtggtcagaagaacgggatgcttcactgtgagattttagaggggatatagttatttttaatgacaaggtctagaacatggcatgaaagtgagcagctgatgacaggattgcagaagcagagaagtttaaggaacaagaggctaggggattggaataagaatctacattgattttgaaatctccaaaaataaagatctagcctgtgttagagttgtgctaagtcatgaaccaaaatcattaagaaacgaagacaagtgactaaaatgggaaaggaggcaggtcaggataagtagatgacttatgacaaggcaggatagtaataacgtttcatgacaagagcatcatgcagctggcttttagagataagacagggagaattactggaagttggaaagaggaacaagaaaaagaccttcccatctccaagcccaaaggtccaagagatgcagcaaagaacatacaccacttagaagtgatgcaaagaagccaggcgtggtggctcacgcctgtaatcccagcactttgggaggctgaggcgggtggattatgaagtcaggagttcaagaccagcctggccgagatgatgaaaccccgtctctactaaaaatacaagaaaa

SEQ ID NO: 122114 - DNA, 1003 bp, Homo sapiens
ctttgtaatgctttttatttctgtaagattgatagtgatctttctttttttcctgattttggtaatttgagtctttttctttgtcagtctacacaaaattacagtagtaatttatctataggacttttatgtgtagagtttgctttaatacaggaattaaacaaaaattcctgaaggcatttcttctcatttcttggtcttcccaggatgtaacctccccgttttctctctaccatgctcataaggattgcttactccttccttttatcccccagttatgccatcctcttctttgtccttcaggacacaattttgatctcatattccaacatctaatcaaatcaaggggtccagtgaagtacatttcaatgtctgtgtgtgtttctttggtgtctttgcccaatctcgtgtagcactactgactccagcctttttattttaaattatcacaattcagaaattcactttacttcatagacgtattctaagtttcatgcttgggaagtctattttgttcatgccatttgaattcaaagtttaacaacaaacttgctgcatcatatttagacacccaggattttgtttctggaaggattttagagattatccaggattaagcagcagccactcagtaccagtcagttgttgccagatgggaatgagaacctactgtggctggatcttctcattaaaacaaacaaacaaacataaatctggatattcgtgggaaacctccaaatttttaaatgaaagcaatgaattaaaaactcttaaaactgtgctaacgtcaaggaccctgttcttttagtttatttgtatcctgttttgtcctcagcacgcaatggattggtaatgttcttgaagagtttagtttaaggaattctaggagattataggtcttgctgtatcttaagaatgacataaacaaaaaaaagttattatcttccgccctttaatataaatataggctatttggaaccagatgggtattaagaagctatgt

SEQ ID NO: 122115 - DNA, 1028 bp, Homo sapiens
cataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaa

SEQ ID NO: 122116 - DNA, 1044 bp, Homo sapiens
gactgtttaggctatttgaggttcaactttttttttcagtgacctaaactatgctttatgttataaatcatatttttaagaaagtattttaaattttattcagatgtttgcaagtatgtatttagtaacctatacattaaacgttcctttgtcatttttctaatttatccaaaaagcactacagcacctcattttaaaagcaatagaattttttttttgtatcagtttaatcatgatatgatacacgggcaaactttagaagaaatattaattttctttttgatgtgtatagaacttgagaagttgtaattacatcctctacagccatgtacccaagattaaattttctactgatgtgttatgcattatatgttagccttcctgtggcctcattatgttagatgatgtttgaaaaatatatttgatattctgaatatcaaatcaaagaggaacataaagaatttttcagtttttccactataaaaaacaaaacaaatctttagggcctagatatttttcacaaacaaggaaatcatttggattacatgtcagagcatttattgcttgaattagtcaatcgaatattaatctattcaacaaacatttaatgaatgtctactccaggcattttgctagccccagggatatagatgtaaatatgacttgtttgggccctcaaatcagccccacttcaatagagagccacatgaaagcaaataattgtaaatgtagcatactaaatgcaatattgaggtatgtgctgtggccagttgcaagcatagtatagcttatggaaatgtggaggggtgtctccatggaagcttgctaactaatcacaaagcaacttacagtaatgaattggagttttgtagactaaaaagtgtcgtgttgtcattgtcctagagttggatatattcctaccctaacttagaacttgaaatttatctgtcacaaatatctttctttcatgattacaatgtattaagatataaactcttagttccagggtcccacatggtgggtttgctaatatcatgggtggaa

SEQ ID NO: 122117 - DNA, 1028 bp, Homo sapiens
atatgtaagccattcggggtttgaaggagaaaaaaatgacctaccttttttttttccaaacacctctagttaagttagcctttttttttttttttcaatttttgtgtgtgtatttttatgctaagaatacatttcagtgtgagtatacttaagataattggcatttttgaagtttataataacttcctgaatagttatttcaaagaaagattacattgtaacaatgtgaaagaaacacagaattaatttaacagactttcaaattcaggaatccatttaaaatatgctgtgtgtaggattgtattatattttgcagtttttcagaatatctgtagagggcagtattttaccattaaatagataagggaaggcaaaaccagactataactgctgtatgtttgcattttttaggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagtgagtatttcagtttttaccttaaccattgtttgtaacttggccctgatagtttgctagttactctaaattcttctggcacttgtagaaaaacttttactattacagtatcatagcagataaaacgtttaagttaataaaacaatcaaatgttaaattttgaattagaaaggattattttgataattgtgctagctgtgctgagttggttcctaaaaaatcgagagcacttcagctgatagtataaattgggcatatgcattttgagaaatttgattagaaatataagcttaaatgaagatatttgcaaaaattgctctttcatgtttttaaagtgtaatattaaagaattctaatagagaaaagaaatgccagtgtttaagctttccacatacttttgggatccagtaagtttgttcg

SEQ ID NO: 122118 - DNA, 1225 bp, Homo sapiens
aggttattcccataggcttgcaaatttataccttatatctaaataaactagtcagcaggttaacctggtgtcagcaccgagaaatcaaagaccagtgaaacacagagtgaattattgtcaaaatgactaaagatttcactttccaatacatttctaccttttgtttttctttgatgctatttcattaggtttatccgttgtttcttttagcccaggcatttacaatagtagtatatagcatgagctcattatgtgtttgttgaatggatgagtaaatttgtaatatgaattagtgaccatcacagaaaaataggaaaaataggaaaagaaagttatttaaagttgaggttttggcattaggttttaacttttaactagtagtattttttttttgagactttttttttacggtggtgaaatacacatataaatttaccatttatattattgaaagtgtacaattcagtggcatttaagtacattcacagtgttgtgcaaccatcggccactatctattttcagagctttttcatcaccccaagcagaaattctgtacccgttaagcaatatctcccatatcccctttcctcagccttaggtaactactaatctactttacctatctataaatttgcctattctagatattttataaaagtggattcatattccattgcactggattttcatagtaattggtaacttattgcccttgccatttttactttcacctcagaggtaattgtttaaacttaattgtttgccattagaaagacttggttaccttgtggactgaggtgattttctaatcattgttaacaggcatcaagttcattgactaggcctgtcacttaagagcagttgtacatttacagtttttagttattctcatagtgttctactcctgaagcagcaaaaactagcaaatacttactgcactggcacatacagatgaatgggataatgtctgtcctagcgaacagcctattgccatactgcctaggaaactgtgtatatgtgcgtgtgtgtgtgtgtatgtgtatgtgtatatgatcctctgctgtattatttccagagtgtctctgatgatcttccaactaatttcagtcaaaagtactctaaaattttctctctgccatagattactgtgacaaatatgtatgaataaatgattatcatctatacttccaattctacttaccacttgttatattttccacaaaga

SEQ ID NO: 122119 - DNA, 1084 bp, Homo sapiens
agttttaaaatatattggttaggaaaacccaagtctagaaatcatgatataaaatttcaactcttaatctatttatgtatactaactttattttcagtcattttgagagatcaagacctggctactataaagctcttattgaaccatataaaacagataattaactctccttgttgaaatggtgcttgtgccctatagagtcgtaatttgctgttgtagactaaatggaattagttatcacctcatttgtgtgaggcatatttgagagctctctaacttaataaagacatattccaagtgaaggtgggatttcagttttcaaatgctttgcacagtcgcttgtttttcctaaaaatcttttctctccccaaatgtttacattcttttatcaggagagaatgcttcattaattgtagcttctgattgcttccaaccaaactagcagcaaatccctatttgatcagaaggatgattttaggggaggcaagtgggagtaggctgcagtagagctaggcagctgcaggcattcatccctgtgatgggtttcgtggatacactttgagtatttgaaattatgtaggaacatggaactgcctgctttaactctgtaacctttaattctttgctctgaggtgaatttggtgtctttgtgaatgacgagttcagtgaagtcatgagtttaattatttaggcctaatctttgaagctagatctagcattatattttagacttatttcttctctttatatcctttattctaagtctacttagcttaatatctgaaaaacagatttggtgtggaatcattagttgaggtacttccttaatgttacagatttatagcagagcaaatgttgaagtacatagacccataaagttttttgtttttttttttctttgagacagagtctcgctctgtcacccaggctagagggcagtggcgcaatcttggatcactgcagccttgacctcccgggctcaagggaccctccacctcagcctcccgagtagctggtatggctgaggtgggaggatcacttgagctgggagaccagccatggcgcctggctagtttttgtattt

SEQ ID NO: 122120 - DNA, 1057 bp, Homo sapiens
ttgtctcaaaatgacaacaacaactacaacaataaaccaaaataaataaataagattaggtgtaagagattattttcatgaaaaattaaatggaacacgcaacgtaatttttctgggtgtgaaaattcattgtaataaggcttggatttaaaagaattgagaataaatatattcaattacatgtctgatattaagttctgagacataaccaaatttatcaagtcttttgtgttgaaaatgtaggaatttaaaaaaatacatttctctaggtagtcaaactatttcagctaagttctgtctttttgtaaatagttattgaaatgttcaaacattatccagtaactccttattgtaaataaagatctaagaatgattatttgtagaaaaggcatttagcaagctagtaaatctgataattagatgactgatacactgctaacatattttactcttattttttgagctagccttttaaagatcgctgtgaatggttctatgaacatttgcattcaggacagccagattcagatatggtgcacaggccagtgaatgaaaatgatatcctgctggttcacagaggtatgcttaacaaagaaactgatatatgtgtgaagcacaaagtgctttttattataaattttaatatgtaaaattaaccaatgctacatatttagattctatttttaggagtagctgtgaagttgtgtcaaaagcaaattgtgcaaagctaaagcaagggattgctgtacggttccatggagaagaaggcatggtgggtataaaagaagatgatgtagaaatcactgtatgtaaagaaagattgaaatgccttttgaataaagtttaatatttagttgataaaggaagaaactttatatttaaattttgttatttagaaaaaaatttcccaatataacatatttctgttgatgcttaattttatttcttgaattcagggtcaaggtgttgtgcgtgagtggtttgatattctgtccaatgagatagtcaatcctgattatgcattgtttacccagtcagctgatggtaagttgtacag

SEQ ID NO: 122121 - DNA, 1037 bp, Homo sapiens
ttaagagatgtttatctagtgccttgggaaatttggagcatttgaaggagaagatcatttttatttttgaagcacagtgaacatggggaagacaatttaggcttcctgagtcttgctgtgttctttttttgtgaatagtaagctgtgactattaatggtttcatagacttacaatttggaaattttggtaaccaagaaagattgtgaaacttttaacttcaagatcttatcttgtgggttgtggcatttgacattaggttaagaatagtcagactaacaggatatcaatgtactatgaatgaacattaagttaataatacttttctgccaaattcattcctcatttcagcacttcttgaaattttaaaaaatcgttcagtaagctcgagattgtatattttgaaatatgacttaaaatgcttataaatcatgtatgattggcatatcattgttactatatgtagaatataattcttcagtaaggatcactcaataataatgaatgaagcagtattttcacagtaccaagaaacctgctaatattttcagtagtaattaactcattgttcggtaacaaatggtatgtatggtgtttcttatttaatgtattttattatttatgaatatagaaagtatcagatatagtatgcaatggtttatttttaattttaaaatttatttgaatcctttttgttggtggctgctaccatagttagaaattaaagttattttcatagtattcttttttgtgattgaagaatgaattttctgaatagatcttcaaagagaaaacttcctaggtaaactcacctcaaggttgggatttagttttaatgtatgtatgattgaagaaataaaaggtaagaaaagagagaaaagtaaagaaaggtccaatgtggtttattacttatcttattttttttctcattcttctaattatttgctgtgttcctttattaaaaactctggcttttcgacatctttgttgtcacttttacacatatccatttttttctttggtgttatttctgcaccac

SEQ ID NO: 122122 - DNA, 1045 bp, Homo sapiens
atatacttctgaaagtaaaaatttaggagttgccttgaagttgttgccacaagaaaccaactattctaaaggagtgattttcttcatgttttatgctttgatcattggttatattctgggtgcttaagaaatagtaatttatttatatgcaagttaaataatgtaacttcctgttaaactgttctatctcctatcatgataggaaaggaattgtactccagttacattataatatgaaacagatggtcagtgggatgaaaatgttttaaaataagtattttaatatgtaatttgttttactctaatctcatattttaatttttattttcagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaaggtgagaaaagtatatggcattgttaggaagatagacgtaaaagagatgaatttgacaaagcatgcattcattaatcagaaagctcatgaacaggttgtaagtttggtttatacccatatcactttcaaaattaggcacacctttctcctctcaactctgtctaatcaacagcaagttggtgagctttctgtatttttcttacaaataaaattttttattccattggtgttttattctaagggtagagatatttagtgtttaaaattaattttattaaattataggtttttaatgtaatatgcagccaccatgcttttgaaagaaatgtatttcttattagtaaggaaataaaatgcacagtttttatttagattttaatatgatatgtgtgttagatgtgtgtctgtatgtgttttcaaagtaaggtactttcatttactgggtttgctgacagttaattcctgagataactgcaaggaagagttgttgagatattttcttaaaatattttgtattgcttcagctgcctttctaagcacatatggatgaagtccttggaagat

SEQ ID NO: 122123 - DNA, 1039 bp, Homo sapiens
tccctaaataaattaagctcaagttagttgcttttcacttggcctctatttttaggcgtgttaaagaatggaacagtgtaaatgaaacattaaccactgttagctattgtttataacatcttgaccaacactttgagcttaatgacaagtgatgcttgatgaggacttcttgcttgatgccggtaaagctgattattgttgctttcaaagggattgctaatttattttttgatttttctagaataaattagatattattcttaagttagggcttattggtattaaggaagataatcagtataataataaagtatcaagagagtgatagacctataataacgttgcagagttttctggcactagattcgtagtaggatactattaagttttttttaaaaaaactttaattccaattggttttaaattattcttcatacagtgccgttttgtgaaagagaatgaatagtgttttgttttttaagtttctgagaaatctgtgtagtgtttttctttgtgaaatgacatgcctctttaggtaatgttattgtggaaagagtataggtctagaagcccaggtacctgagttctagtttcacctgtgcttagattacttgcttttctcatctacagagttctttttggattcatgctcttccaaactgtacaacttatttgggcatttcttttcttctcttttctttctttctttcttttttttttttttcgagacggggttttgctcttgttacccaggctggagtgcagtggggcattcttggctcactgcaacttctgcctcccgggttcaagtgattctcctgccttagcctcccaagtagctgggattacaggcaccggctaccatgcccagctaattttgtatttttaatagagacagggtttcaccatgttggccaggctggtctggaactcctgacctcaggtgatccacctaccccggcctctcaaagtgctgggattacaggtgtgagccaccatgcctggccctgggcatttcttaagaatcagctgttaacat

SEQ ID NO: 122124 - DNA, 1369 bp, Homo sapiens
gagaccaattcagatcatctatttaacaaccctgtattagaattcaggggcttctgggtttctagacttccagatctttctgattccagccattttcttgcattatatttatgatttggttgcttggctagaaaaccagttctttccatagtgtcctgaatttatgaataatatcatcatttgattccctgtaatcatgttgtatcttgaagggttatctttagatcagaccttttttgaacctccagatttgaatgtccatctgcctgtttaacatcatcacttagaagtaccacagaatctcacatattaacatgtcaaaatacagcttcagattttcttcctcaaacctttcccccagtttttcctcatcttaatcaatagaaaccttattgtctcagttgtttaaattagaaataattaggttattttttatttctctctctctctctttgtgaacttggaatttattagtaagttctgtaaattctaccttcagaatatgttcggaatctgaacttctaactcaaccaaaaccaccttaatgttgttaccttttgcctagagtactgcagtaatctcttcactggtctccctgattcctatgttgtttccctccaatctcttctttcctcagcaaagtgatcttaaaaaaaaaaaaaaaaaagaatctgctcttgttactttgtgtttaagccttgtatataaaacttttcagtgcctcgttgttacattttaaatataattcaagttctaccttggcctgtgagacctccatgatttcactcctgtttagctcactgtacttgaaccacagtgattctctttgcgttccttaaatgcaaccaactctttcagcaggcttttctacatggtatttgttttgcctgaaatgttcttccttaggctttttacagggctatttcttattcatgttactgcttaattaagtaactttttaggaaggcagttcctgaccaatctaagcaggtcgttccccagatttttgatcgcagtatcacagtcatttccttcatagcacttcctattctgtagttgtttatttactttcttatagtctgtctcccctacatgcctaaaaattcagtgaaagcaagaatagtgtttattttaccactttatgtccaaagtgtagtacagtgttttgcacttagatgcatagtagatgtttttgaatgaatgcatcactatgaaaaatatcttataaaaaacaatgccatttataatagttaaaatagagacatgttagtgttgtgcagaactgggatatccctatggttagtctgagcttagggatatggcagaaggatttttaagaaatactttctcctagtactgtattcccatc

SEQ ID NO: 122125 - DNA, 1098 bp, Homo sapiens
gtcacgtgcccactcagttcctatgtaaagcttcaagttgtgggaagaacttcccttatatggattaaaattgtggtaattgtatcttttgtttgattcctctggctttacttttaattattttttccccctcagacagtgcagtgcttgctagacagtggtgctgatattaacaggccaaatgtatcaggagcaactccattgtactttgcttgcaggtatgatattttatatttccagatgctatatatgctcatatatatatatatatatatatatatgtataaataaagaaatatatatatttccagatgtatataatactctatttctagacacacacgtttctgtgtattttctaaagctctcttgttttcccacaaatatgctgtcttttaagaggaagtacaatctcttttttaagatgaagtgttatggttctattacttaactgtatgaggaaaagtattttctgttatatttaattgccattgcttttatgttacatgtggagcttttgatttgcttgattacttcaattttagactaagtacttattaacaaaagataaatcagtaatctggtaattcccatcgtttactgtgttatgtaaccaggtcatttccagtgggataagctgttggaatatatcttgatccagagccatgtcttttctttctctgtatctataaccaaaaaaaaatcttgagtcagtcttgttagatattgttatacattaagttatttttgtatttctttattggttcattttcttgacgtgtacattttgttcacttattcatgtattcggcaaatgtttagttaacgctcactgtgtcatgcattgttgtaggtgtgtaatacagtaataaataaactctattccctaaggagctatcagtataattatacacatgccgtcacacccacacccacacacatatgtaaaaatatatacacacctacatattatgtattatgtaaatgtagttatagaatactatagtaattcttctttttgatttaaattatatgaattgtaatatttatttaggccttcatattccgatatagagctctccagaaagctcctctctt

SEQ ID NO: 122126 - DNA, 1012 bp, Homo sapiens
tgtagaattcctgaacattttctttttaaacttctgttgaatttttatttattgcattgtatttttgatttctcatttcctaaatattttctacccaacatccttttatcattccatggtataatttcttttctgttcgaggttatcagttacttttctaatttttgttgttttctttggttccctttactgtctttgttattctgagtttcatttttcagttgtaatttttgtttttcaggttagaggcctgcttcagttgtatttttaatattgtctgttcattcatgtgtaatggtgaggcactcaaatgttggctggaagcgttgtgtacatgagttgagtttgttgactacttggtttgactgtacaccaatgtttcttggtctcaacactgttgatattttggatctgataattctttgttgtgggggctgtcatctgaattttaggatatttagctgcatccctgacctctacccactagctgccaatagcattttcccttccctggtcatgaaaataaaaaagttgcctcatgttcccaggggaaaatttaaccttggttggggatgactgctatagacccattgtcccgaattgggctgtttctttatttttaatttttgtttctttttagagatagggtcttgctttacagatagcgtcttgcatgcagcaccatgcatggctaattttaaaattttgttgtggaaatgggatctctctaaattgcctaggctggtcttgaactcctggccttaaatgatctttccaccttggttttccaaagtcttagaattacaggcatgagccaccatgtctggatgaactgagctgtttcactggggactttctaatgccaatatctgtaagattcttttctgatgcaagtcttgagaggaagcttttaattccttctacttgagatttttaagcctgcctgctggatttctgggagcctagttggaacatggaggctggaggttttcacttaatttgttgttttcac

SEQ ID NO: 122127 - DNA, 1060 bp, Homo sapiens
aatgatcagatgaaaggaatcataacaacttcttaataattttatttttatataacttttcttagatcaactgttaaactccattcttagctgtatcataccagaattctggtatgtctttggatactgatttcaaaaaatcatttcaaagtttggttattcaactggagatataattttactggtgatataattaaggaaaatgtgaacactttggaaggcatttaacagcaataatacctactgctattatgattgttattaatatgtgtgatgtgattctgtaaaagtacacagatcagtgtctagaccctttatttatttatgcttatacaagaagctgggcccagtgtgttgttttttaatttcagttttagcaagttgagtaaaacctaacactattctctgtaggtataatttattaacgctttttggaccataaattaaacctagtttttggtaactttttctttaagatttataaatgtgttgaattgccaaaaatgttaattacagtcttctcagaataacgtggatttagaaaccgtagagaactgtcaaatagttcagtctaaatttctgtaagttagattacatggcaggattagttagggactaatttgtaatttatttaaaaataaatttcacttttatcagaataaaccttattaagtttatgtaactaaatacaaagcttcacaaacaacataaaatgatagttgaacccttagtataatagactatattagacagaactgactgcatttttttactaaaatcatagacttgttaaggaacagtgctcaactatgttcagtcagctctcttggtatctttagccagcttccaagtttttcatccagttacggacagccatgtaaacttaattgaaaacattttccagacattaattagattcagccttgaggcacaaaggtaggtagactaacatttcagagtatattcctagggtcagagtaattgtatttattctaatgctagaattctcctttaatcatttctaagaagttgaaacaaatagtagaaagttctcttacca

SEQ ID NO: 122128 - DNA, 1009 bp, Homo sapiens
gctctgtcacccaggctggagtgcagtggcataatctcagcttactgcaacctctgcctcccaggtttaagtgatccttgtgcctcagcctcctaagtagctgggattacaggtgtgtgccaccacacccagctactttttgtatttttagtagagatggggttttgccatggtggccaggctgatcttgaattcctggtctcaagtgatctgcctgcctcagcctcccaaagtgctgggattacaggtgtgagccaccgtgcctggctattttctttcttactctaggtttctaaaatcatgcatttgttttatgacaatgctttcctgttattcctgtgtccagacatttggcttttgaaattgctatttctctctcattaagagactttactgccttatataaagatggagggcttaagattttagattgaatttctgctttgctgtaattttctaccttgtttatgtttttaagttttttctttttttaacatttaacattattggtaatagaatgtacaggtgtgtgccagtagtctcagctgtttgggaggctgaggtggagaggtcaagattaggtggagagatccctttgcccaggagttgtgggttgtagtgcactatgctgcttggatgtccacactaagtttggcatgaatatggtgacctctcaggatgccagatagcttaaggagaggtgaaccagaacaggtcagaaacagcaagtcacaacccccatgctggtctgtttgtgggatcatgctagtgaattaccactgcacctcgtctcttcaaaaaaaaaaaaaaaaagaatgtaatttattttcttgctgaccataataacaacaacaaaaccaactcaaagtcagtaccattaactacaaggatacaaagtttgtttatttttttggttacaaactttctgagtcttatctcttgttgggagaagggagaattcctagtggaatctggatttttatctcttcaaacactttttccttaacct

SEQ ID NO: 122129 - DNA, 1470 bp, Homo sapiens
ttagaaattaagataattgtagattcacatgcagtgctaagaaataatagagagagagagttgccctgcactttttgccgagtttcctccagtggtaacattttgcaaaactatactataatattacagtaaggacatggacattgatacaatctgtcttactgagatttcctcagttttattttattttatttttttgagacagagtctcgctctgttgcccaggctagagtgcagtagtgcaatctcagctcactgcaacctccgcctcctgggttcaagcaattctcctgcctcagtctcccgagtagctgggaccacaggtgtgcgtcaccatgcccagctaatttttgcatttttagtagagatggggtttcacgatgttggccaggctggtcttgagctcctgacctcaggtgatctacccgccttggccttccaaaatgctgggattacaggtgtgagccaccatgcctggccttcctcagttttaattgtatgtgtgtgtgtatgtttatgtattttaagttctattcatttttattacttgtgtaggttacctgtgtagttttattacctgtgtacatggtaggttttcaccaccatagtcaatattctgaacatttctaacaccacagagatatgtcatgttgcccttttataaccatacctttccctttgtccttcacatcccatggctaacctatagcaaccattaatttgttctccattagtcatttcaagaatgttacagagatagaactatattgtatggaacctttggggattggctttttttgtttgtcacattccttggagacttatctaggttatacttatcaatagtttgttcctttataatgctgaatagtattccatccagtagtggatataccaccatttgttggactgttcacctgttaaaagacatttggttcacttctggtttgaggctattatgagtaaagctgttaaaaacagcagggtacacattgggataaatgtccaggaatgcagttgttttccgtagtggctatactaattcacattcccaccaacaacatatgatagttcctgtttcttgacatccttgccagcatttcttattgcttgtcttttggatataagccattttaataggggtgagatgatacctcattgtagttttggtttgcatttctttgatgatcagtgatgttgagcacctttttatatacctgttttccagttgtatgtctacttttgagaagtgtctactcagatctttcattctttttttaatcaaaattttttttttttttttttttttttttactatggagttgtttgagttccttatatattctggttattaatcccttgtcagatggatagtttgcagttattttctcccattctatgggttgtttctttactttgttgattttttcctttcctgtgcaaaagtgttttaacttgaagtgatcctat

SEQ ID NO: 122130 - DNA, 1034 bp, Homo sapiens
gtagaagtcatagtagagttcttcccattttgttggtcagtctgcgttttggggccagctttttgttttgttccctcagctgtcatcagatggctgctatatttctcttggcttgctttagcatttttctctttgccattagtgctgtattggattgtcctcctttccaaaagaagccccattaagcttccacagagcacttgggtgactggtccctgtgtaatttgggttgccataagctccctataattggtgcaatatctgagcaggaatatagttgcttccttgtacagggggattcagcattgctcatgcttatatgagaatgttaaaaggagaggctttaaaattattgtgtgttcttaggttgtgttttggtcagttttgaaagaagagtttttctttattttttaggtgattatgagctcataaagggtagggcccatgtgttacataatattttagttctgttagcaaaatagctacttatttattgggttgatttgacttattcagaccctggaaaatagtaataatggttgttcaatagaaagataggatatatttctctcctacattccctgtaccttttgcaattcatttttggaaggggaagcattatagattactgcttttcttcaacaacccctaccataaacacttttttgggcctatttccctggctcattcctacctaatgatttattttgccattattggcttaggccagtggtccataataggcttctgaaaggttttagaaatccacccatataggtatagacacacgatcacacatttaaacaatgtatttattttaatgggactatctggtttgtggtctcatgattattgaatatttatttcttaaggttttcctaacagtgtgttagataaaggaactttgtaaatgttttatcttaaaagtttacccagagttggctgggtgtggtggcttaagcctgtaatcccagcactttgggaggccgaggtgggcagattatgaggttaggagatcgagaccatcctggcta

SEQ ID NO: 122131 - DNA, 1052 bp, Homo sapiens
ctaacatactaagagaatagtgcagtattttgtggtgggtgtgggacaaaacctgaagaatcagaagaatagctaggccgggtggggtggctcacgcctgtaatcccagcacttcgggaggccgaggcaggcagatcacgaggtcaagagattgagatcatcttggccaacttggtgaaaccccctctctactaaaaatacaaaaattagccgggtgtagtggcatgcgcctgtagtcctggctactcgggaggctgaggcaggagaattgcttgaaccagggaggtggaggttgcagtgagccaagatctcgccactgtactccagcctggtgacagagcaagactcttgtctcaacaaacaaacaaacaaacagagcagctaaagagttgttaacttgatttattatgtttttaaaaactttttttacacttgattcctcatttttattttggcataggtctgtttctgaactactatcaaattcaaaatttgatgtcaattatgcattcggacgtgtgaaaagaagcttgcttcacattgcagcaaagtaagactaaagatattttgagttaaactctgatctagggcaaggatcagtaagctttgaacagcattatcacacaatatttctggggagagatgagaacagacagctgagtagttctttatcctgtttgagcgcgtggtgtgctatccgttctgtctctaaactgttaactttgggattgtatgtaaatctcatgtccctcttgtctttgttttatatcagatgagagtaggttagacatggagattgtctttcctggatgtacttactggtacagttcaccaaaattttctttttatcccagcaatatgagattttatatgctgtctgcagatgaagtcattggctttatattttttacataggtggagaatgatttttatctacagtctcctggtatgtaatcaatcagttaactaattggtacctatcctcttttcaggatttaggtagatgtgttgaaattaatttttcatgaataatttggcttacgaaaggccag

SEQ ID NO: 122132 - DNA, 1018 bp, Homo sapiens
ctaatttcttttgtaataatattgacaagaagccagtattgtgtatatttaaggttttaaaattattttagcatatatatatttaatatccatatatatttaaaattcccccaaactacatgtaagtatgataaaacatgatgcctataaatacctctttggaagtaaaagaaatttcaattgttaaagctacagaaaggtttttggatgatgatgcgcgggctaccatactacacttagagaattgttttttggtggataatgggacaaaaccttctgaagaatcagtctttaattgtccttttacatccagaagctaagctcttttgtaatgatgtaaaagggataagcagtggaggggatgaaagattcttcactatcgtaaattctgaaatacctctggtattctgcattattctttcctccttcttcctctccttttcgctttttgtatagagttaggaaaattctaaactaatcttaagtatcaccccttgcacaaagtaggggataaatgaactctttgtttttttttactcagataatgaaactgctgtttatacattaatgccaatggttatggctgatcaacacaggtgagtgcttgttccaaaaatttttgctttttaagaagcatacattgttctaaatgtgtactgcatgcccgtgcacgcgcacgcgcgcacacacacacacacacacacacacacacagacagtttggacatagatgttctggggcaagttatttaacttttctgttataattttgtgtgtgtgaaataaggaataagattttccaagatctatatgagctgtaacattttatgatagattttcttaatgaatattgaaatactaagtatttggttggtcactcacatagaaaaatacattgtcatgatttcttttagaggtcactactgatctttatagtaaaagattatggctgagggacaacttatttcccttatgtgctacttatttttgtgttccttttattgatgtagtgttgacat

SEQ ID NO: 122133 - DNA, 1629 bp, Homo sapiens
taaaaaagttttatttgacttttccattttacaagtaggatcagctaatctttgctttacaatataaggtcataaaaatttaaggaattggatcgggttgtaatgcatattggtttttggtaactttataggtgcttctcaatagatctggaactaaatgattcaataattatattctcattaatccttgtcagactgtatggtgtcttactatgtatgttctctgctagacttcagaaacaataaaaagtttgttgtgaaattagtcaagatttaaatttaaaaatcgctaggttgtgaggcgaggtatgtcaatcttatactttgtaagggaagcaaatcgagatttaaaatagtagtgctcaaagttagtcttcagaataacttgtttttaagtttattgcacatataaatcccaaaatacggtgaatttaagtttggctttttttttccggtttactctgaagaaagagaagattaaatagatcttacctgcctaaaagtttgataatgcttggtatctgatctggtaacatgattagggttttgtgacacactgctgtcataatttacaaatcatgattaaaggaagaaaataagttattaaataaaacatgtatgaataacagtcttcaggtgtgagtgatgtctctttaaaaataattgaagcgctaggcacagctaccaaatttggggactgtattagcaagttcaggtcaggaaatgatctataaacatttatcttaatccaaagttgcattgatttaaaaaatgaaacatgggcatacagggatgaatcaatttagaagtaattaaattattgattatgaaagtggcgttacaaatttttggacaactaaagcgttttcttattaggtattttttaatagaatttaattttcttttaaaattctcagatactcagttttttttgtttaaatacttttgaacctgtaccttatttccttgacttttaaagggactgtattttctttacaaataactactgtttttgatgaaccacaaagtaaagtatttctagcttgccaagaagaacaatggaaattctttacattcaaatacttcaggttgatttatatgaataagtcttcgaatatatgaaatacagaatctcattgttttgagaaacttgcccaccatgtacttgtatacatgtacattattgtgttggatttctctgacacaatgatgctcgacaaagtcgctggccacagtgctgaatcaagacagccatattggtccctgctaaatctgactgaaaactgtacagtacacagaaattgtgtagggattcaagtagcatcatgactataggaaatatatgcatatatatttcataaattttttttttgcttttcacctagttgaattggaatcatcagaaattgtgatagagaaatgttatccctgaagtatattaatttactgtgtaacattgattttgaataatgtcagtaaaatcaataggatcaatgctagaggttttctctttctttgaaagctgccacttgcagatgatgacaagattttaaaaacccgtttaagcaactagttatttaactcaaaaactgtacagttttagttgacactactggtaagatagagtat

SEQ ID NO: 122134 - DNA, 1054 bp, Homo sapiens
ttaactaaaatattctagactgtataggttaaaaaatagacattttgtggatttaacattttagaaaaaatctgtaaattatgtgttatcttttgtattagtctgttataatctcctctgttagttaaaatcctattatttttatttgctattacatttattacatcagtaagtcacccagtgttgtaaggatgagtaacttgtaaagtgtctctttatctttattaaaatgttaattgaaaatatttagaatacacaaagttctcatttacttgttaatctctggtgatgatataaattttgaaccattaataatgttgtatattaaaacttaaaatgtatgtcaataaaatttccttgttattattgtaattaaaagaagtgttcagttttacctagaatcatttttgtttactgtatcaaaaagccactttaaagttttgtcttaaagttatggtgggccttcaaagtatatgtgattaccttttttaaggcaggaattttgccattattttgatctttttgatttgaaaccactatcgctttcttttacttttcttcaacgtgatctaacagtgactgggctgtgagctcgattacataaagttattatttcatatgttggaaaatacaaacacattagcaaaactaactgtgctgtggctcaactgtgttatagcttacatttaagctaaagaattgtgtttgccagctgctatctgtgccataatattgcctttaaacaattttgaaaatatgccagtcatcttaaattattactcatttgtttttattttccaaaataaattcttcttattacagtatttgaagagaatgatagaggtgtccatatcttatatgaaacaaataaaatttctatttgtaatatggttgagaaaattaaatttatctctgtgattcagcagtgccaaaaatactaccctctgatttaaggttgagtgtttcatatgatatattctaaattaaattatatactttataaatataagaaataatgcaactttgagattttttcctaatataaaattttctg

SEQ ID NO: 122135 - DNA, 1012 bp, Homo sapiens
ggcaatttttgagtgaattacaatatataattcataatagcagtcattttcctttacatttagttacaacagtggattttaacaatgaacaatatataatgtatttgtgaagaatattgttatatattttagtagaaagtgtgaaatctaagaatgtttgtgatggatactctttataagttaggcactcctatagcagtaaatcatatatttaaattaaaataattggaattattttgtatatatgtattttatatttgtaatatatgtattttatatttataagagattaattgcctatccaattattttttatgaaaagatggtttaacaaaacattttgcgtactttttttttttttttttataaaagccaacctaggaataatcaacctcggtacaggaattcgttgtcattggttcaaaaaatataatgaatacaaaataatgccagaattataataatgagctaaatatacacagtctctctaatcacagagcatagagttcagttgggagagagaacattttcatggactgttataataaaccacagtacactattacatggtagagacattgtattcagtatggaacagtatgaaaaagagctctaagtagagatctaaatgatgaatggagattattctcgtgtaggggcaaagaagtgtattttgggatttcataggtttaggtttttgttttctaagaaaacgtaatgaactctgttaaataaaatattttaacaaaatgtattaaatacaaggcctggcacggtggctcatgcctgtaatcccagcactttgggaggccgaggcgggtggatcacaaggtcaggagttcgaggccagcctggccaacatagtgaaaccccatctctactaaaaatagaaaaattagccaggcatggtcgcacatgcctgtaatcccagctactcgggaggccgaggcaggagaatcgcttaaacccaggaggcagaggttgcagtgagcctagattgcaccattgcact

SEQ ID NO: 122136 - DNA, 1035 bp, Homo sapiens
attatttagctaactttcttacattatttgattttggctttattaaacctatttgtgatagtttgtccaaattatttgcaaagtttttttttttttaacaaaccctatctattgtatttacacatctttaaaatatgttggcttgaattcttctctaaatataagcagataggattaagaataggctgtggactattagaatagaaaggcagaagctacagttgtgctgaaatatttatgtacaataattaaatatactcacacataagccagatgtgcaaaataaaacttgatacaggatcaatgtaaaggaaagctctgtttcattaagtgtctgtaatgaattttgttaaagttaggatctgtcattatcttgtgtcttttggttgtaaacacaggctaagtgaaggatttaatgtacagaggttcacgtgccttttgttcacattcttcctctattcttttcaaatctaactcggtgggattgtcatcctttgtaaaaagaaccttgggtcaacattcagtagaaccctgcacttggaaaagtctccatttccttttgagaagaaaattagattgcaacttaaataatttgcacagaatggttttacttattttttgtgagttgatatagtaggtctagtgtgtaaaacttagttaaggaaagacaactctgggtgtagcaggtgagtgcatgcatgttcacaccaatctgttttgcaaaccttaataactgacccaaggataaaaacaataatttagtagtcaccaggagttcctcttccaatcactatacttgattactgtgtggcctctttattgcaagttttattgtgttgtggcatctgccaatggatgtattagaaacatcaatatttactcatatttaaaaaatgagaactgtttgctttttaaaaaacattaacccatttaaaaatataagttaaaatgcatattagatatttaaaaatatacttaatgattaaatgtattaccattaatgtaatttttcattcacttgactgcaacagcccc

SEQ ID NO: 122137 - DNA, 1106 bp, Homo sapiens
ggttttaaaatagcgatattttatattttaaaggaaataaagtctttttagttaatctataatatttattatagtattcgataagggcagaaatactgttgccagcatcttgtaatcaatcgtttgaaccagtttgaaaggtaaagggggtaggcattttgaaactgggggtcagttgaggaaggacagtaggagcttcatccgttgttacattttcgtttattcaactcttctagccattggtagtggacttttaaaatgtcagggtacaagtcaatatgatatgaatttaccttttttctcccacttgtccttctttctccaccccaccccctgcccgcgccggctttttttctctcccacctctttctttgactctgctgccgcctatcctggcggctcctcttcacctcccctgcctggcgatcccctccccctcctgccctatgtcctccagctcttggggaacaatcgccactgattgaggttcactctatgttaggctggaaaactgggctgttatttaggaagtcattaatcacatctcctcccccggaaagagatggcagagaaacctgtgaagtacaattccttaccaaccccctctaaaattttccaaaatggtttacctaaacacaatttgactatatgaaggtgaaaacgatttttctagtaggattttattttaaatttgaaaaaatttcgggcataatcaggtaatttatgtgcctctgccttttcctaggtgtatgttttcattatctaaagtttcatggggatgtaattaggtttaattagatcttttataaattatatattttcctctaagaattgaattaaatatgaaattagcgttccaagcaggtttactgccatggaatagctgaattcttaaggggaaaaaaagcgttaacatcggttgttttatttaaacgaccccctcccatgattttagtcaggcttgtgtgtaaggcacgcgtgtgcacatatatgactgcctttttttctaaatctatgattcacaaggtccctccattgtgtttaagtagaagcacgaaatcagcattctgatttatcctaaagaagcgttccaaattgtctttaag

SEQ ID NO: 122138 - DNA, 1047 bp, Homo sapiens
gaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatacaatatactttgtcgcctgtatctggtgaatgggtagaaaaatgaagaaacatgatcattttaaggttgaaaaaacaaagcgaaacagtttgctgtggaaagaaatgtatagattgccttattttagacacctctagtcacagtagctccctttattatttcatcgctgcctgtcctgtaatcattttgtagattcagatcaaaataatttgacttcatagtaaaataaaatagaacactgttggcctaatgtggttgtaaagaaatgcgtgcaatagagggatgcttgataaacattttagaaatgtgctccgtgta

SEQ ID NO: 122139 - DNA, 1040 bp, Homo sapiens
gataatctaagttaaaaagaattgaatgaaaggctgttaatactacagattgactgacagatacatgggtgaaatatttggtatatttgcttgaaaagtatatatttgatactgtgttgcatgttcctagtaatatttatacccccttccctaaggaatatcatcttcaaattaaatatataaacaatagaaacatatgaaaccattctgttttgatctgttgtcctgtggtgcttggtagcttcctgaccttgctgtgtggtgtgtgttttcctttcctgaaggcctggccatcattattggctgtttatatgtggaaggatcagcataatctgtgaattgaaacagggtttaagtacacaaatacaagtccacatacagactactggattttatgcttcctattttatagtgcaaaatgaagctacattttctgttttttcccctctaagactggatgacaaaaatcatagacaaatccattttctctcaggctctttcttccacctttgaaccttctttaggttgttaaattgttttttatgatctcataaatttgttttatagatgaatgaaaaaaataacccttctttgtctggtcacgcctttttataatttgattttctatgtttaccttctaaaatattcatcaaatgttaagatattttattaaccaatgttaatgtttagaacaacaagacatttgtgtttatactatttaatgattatatattgataaacattcctctattcactgaattaaaacatgtagctgctgaagttttttaaatatatagctgtttctatactataaacattgatttttaaatagttgacttaatattcagttacatacagtagtatatacatacagttcatgtatatattaaaaggacagtattaaatgatgcctagttaaagaggtttcttatattgtaatatacataaattgtatataaattgtatgaataattgttttgaagaaggcaggaatcctactgatgttagctaagcaactacaagtaacagatggttgtaaa

SEQ ID NO: 122140 - DNA, 1042 bp, Homo sapiens
gtttaagaaagtacattgcaggtcagtggggtacatttaaaaatgatcttttaatgagtagtttatcaaacaagtaatgaaagtaccatgttgcattttgatacatcaggatacatctaatcatttatctcaaattggaggacagtctgattattgcttcttcttttccaatatctaaatatttgacaatttggaaatattttctaaataagatttacaaataattgatagatttagtgttataattttttctataattttctgttacctggagtaatacctaacttttaaagttgttttgaagagtagaggtaatgttatataactgcctagtaagtgtctgttgagaaaataaactaatgtaaactggtctttgccaaaagaataatggataagttattttcagtggtgtatactcatggtggataattaagctggtcttttatgtgctttctttaaaattggccaaaatgtgttgtatattaatagtttaatttccattacagttgatgttaaggcttttcattatagttttgtggcattgaatattgtttttgttatttaaaataattcttttggctgagcatggtggctcatgcctgtaatcccagcactttgggaggctgaggctggcagattgagcccaggagttttagaccagcctgggtaacatggcaaaactccgtccctaccaaaaaaattagctaggcctgatggcatgcacctgtggtcccaaatatcagggagcctgaggtaaaaggatcacttcttgagcccaggagacagaggccacaatgagctgagatcactccattgcactccagtctggacgacagagcaagatggtctctaaaattattattttttttgagatctggtctcactctgttgcctaggctagagtgcagtggcaggatcatagcttactgaagccttgacttcctgggctcaagtgatcctcctgccttggcctcccaaagtcctgggattacaggcatgagcaacagtgccaggcctagaatattgtttaaagtatcagggt

SEQ ID NO: 122141 - DNA, 1045 bp, Homo sapiens
attgaattaatttgaatgagagctataaaaagccctaaagtattttattttgatgtgcttaatttctagcatttatgcagacatttaaagcttccctgaattaataacagcacaagtttatgagctgttccaataatggtgcaaagactacatctagacccaggtttaaacaaacacaaaacactttgttcttatcttagcatcctttaaaagtatacagctctggttcaggacctcaggaccacccatcacactggacattggatactcctatttattcaagaggcttgtgaagtatctgtgtgccagtgggggatggtgtgtgtatctgtataaggaatcacagttaggtgattttacctcagtaaaagcttcaatattgtttatatactgaattttgtccctgaagaattttctagttgtaaaacctaatttacactaaatgcttgttaatttatttaagttctggctgcagtcttcgcatttttgatgttttcagaaggctaaaatgggcccctattaagattaatcttaattcagtatagttttttggctttcaggccccacccattagctttggatagctaataccaagcttttgtttcttcctgtagaaaggaaaggaaagaaaactttctcttttattgcttaagtcatgtgacttcccttttagttagtcacagatgggattgcagtgaatctcagaatgaagcataaaactttgagaaaatatttatcgatatgtgtcttgtttaatttcatatgctttaccttacattacatccatgctgttgttttttaggaagctgaaaaaaattactactaaatagatttttaaaataatacggaccttttaatctaccgtggtagtttcttagttacttatttttctatcagttatcttttagcatcatttgaggtttctaaactgtaacttgtttctcagaactcatagtgtagagaaagtaggggtggtggttgggagacattagcaagaaataattgctggcagaataaaagaaagaaatacgttataggactacat

SEQ ID NO: 122142 - DNA, 1031 bp, Homo sapiens
caatacagagaatgaaaacagaggaagcagagacagcaagtttagacaatcttttgagaagtgtttctataataaatgggaggaaagaaacaaagcagtggctaaatggaagaaattatagcatgtttatatgttcataggaatggtctagtgcaaaggaaagattgaacatgcaggagagaggagaacgattactggagtgatttccttgagtgggtgacagtattgggatttaaagcacaactgggggagctgatcatgtgagtacagaaggttcattcttacaaacctggaggaaaggcgtagcttatgggcacagatgcaggtggtagatagatatgaaggtaggataaggcgagatttctcttttttatgctggttttttttttctttgaatttgaagcacggtcatcaactgagagtgatggtagaagagtaggtttggaaatttaacaagaaagacgtataaaatagaagaatgaacacattatagaaaagaggtagaatttcaggctgtgccaaagacccacataagaatagtgggtacgaatttaaagtcagttaatgtgattgtgttttttctccagccattgttgacttcatggctacagctgtaaaacagtcattaaaatgatttaactagagttgaggtttttcctagttgagaatgacaaagggcactggagatgtatgcagggcagcaaatgtaatgatggatgatagaatataaactgtataaagagtgaagacattgaaaaggtggtaagtaaacacatggggtgtgggttgcagtggagtcaaagaattatagttggggtactgatctggcaaggtacgaggtggtggtggtcagaagtgaataactgttccaactccttactcttactgtgtgtcttattgtaattaaagctttgacacacttaatatctaataatttccaactttctattaagctaagggtgtccataatttttgtcactaggattagcaattccagttttccatgtgctgcttgtttttacaaaatggtg

SEQ ID NO: 122143 - DNA, 1027 bp, Homo sapiens
acctttaacaccaacactttgggaggccgaggccagtgaattgcttgagcccagaagtttgaacctagcctgggcaacatggagaaaccctgtcattgcaaaaagtaaaaaaattagctgggcatggtggtgcatccctgttgtcccagctacttgtactgagatgggaggatcacttgagcctgagaggtcaaagatgcagtgggtcgtgatcagtctactgcaccctagccagggtgacagcaagaccctgcctcaaaaaaaaaaaaattttttttaaccattctgttaggcgtgtggtgatatctcatcatggttttaattttcatttccttaatagctactgatattaagcaactttatatgtatttttgtgtcaccctcatatactctttgacaaactgtttcttcatatcttttgcccattttttactgggttgtgtgttttcttattgcactttaagaactctttgtgtaagttttttttgccagatacatgatttgtagatattttctccctgactgtggcttgtcgtttcaatctcttaaatatcttttctagaacaaaagtttttaatttgaatgaagatgatttatcaatctttacattttctgtttacatcaatgatccatttagagttagtttttatataaagtgtaaggcctaggtagaggttcatttctgccatgtgtaatatgaattgttcaaacatcgtttattgaaaagaatatcctttttcttgaaatgtttttagattagaaagtttagtttctgtcatttttggttaaaaattgaaatttcaaagttttgattacatggtattaatatgtttaacaaattccaaatatgatttcatcacttgagaacttatttgttcaattctaatgtttgtatataaggtagaatcatattttgtgaagagttactccctgtggcaaaaaaaatgtaaaataattttgaagattccactttaattattagtagactgtttataaaagaaaatgggattattttattctctcttaa

SEQ ID NO: 122144 - DNA, 1029 bp, Homo sapiens
tttgcctttttgagactgctcttttaaattttgtctttcccctttaaaatgttccttatatcttttacttgtatgctttttttcattgtaactccgaactatagatcagttgatatcccttcttagtttctatattttggtccctgtaagaaattccccacaactctttattttacatttgtttgtatcctggacagctgtgaatttgcatcttgtacttcctactaatgactggcagaggctcgagttgaataactaaactattgcatccaaattttcagtcatccatatggtgactaaggaaattagtaaaaccagtagaatacccaagtcttcttaattcttctgtatttttaattctatcccaagtttctttattatagcctaattttaggatggttatccaagtcctttcttcttgtgattatttggccagggatctcttaatgaggcaattatagttgtttccttcattcacattatcttagcagatgctctccctgctgtgacctctgttcagactgggcagacaatgtgccattctcatcaccctctgccagacattgtgtggagctgagcttcatttggcgctgcataggtctcccaagatgccattggaatggtcagaagccaagtggcaaataatcagaattttaggttgattttctgattgctgattataataaataataaaataatgcctacagaaaaaaagttccagaagcaactctaataatagttcaagtagaaattatggatttaagaagtaacttagctttcttgctttagactgtggccttggtgaaattagatcatatatttattgtatgatttcggtacaagggtattgtgataatttggtagtattttagaaatttgatatcctttctaaaaaggaaattaatttagcctctaatattaagtatgtagatgtttaaatgaacattatgacattgttcagagtatcacttgtaaattttaacgtcacttaaattttaaaaattatgcttaaatgtcttaaacataaat

SEQ ID NO: 122145 - DNA, 3580 bp, Homo sapiens
cctcaccagaacattttggtgatgatagtctttgaaccaacagtgtaaccagtataaacaatgataaatgcttttaagaaggcacattaaaataagcttatctcattggtagtttgtgtgttttcacattttaaaatgtgtttttggatacatgctgcctacttctaagatgttttcatcttttttccttgtagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagac

SEQ ID NO: 122146 - DNA, 1355 bp, Homo sapiens
ttactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatg

SEQ ID NO: 122147 - DNA, 1035 bp, Homo sapiens
gctacagttctctttcccacctgaacatactgcgagtgtggcagacaccccagagcacaattgtgctccactggctgcaccttctcgatgccttggtccttatggaagtcctttgtgcagaggacttttttgccacttggtgtaatatgaaacatccctccagcaacagtaactcttgacgtaactgtttaacagtttcacacctgttaagtctgggtttcagttcagtatgatactgtttatatacttttataataaaatgtattaactggtaggtggaaggtgattatagctaacagaaaaaaaattactacagaagtcttttcctgatcacaataaatacaacaggatggagttaaccactctgcctcccaactgtaaaaatagttttaatagaaaactaagaatcaattttctgggaaatttatggatatgaaattatttgcccctctacaattggcaataaatgaaaagtaaagcattctacagagatcatgaaccttacagtaacctccttgaagaacaaaagtgatttgaaaaatcacttaactaaagataagctctatttcttcctctctcctctcatgttctcacatctctggaagatagttgggcctctgggcaaatttctgatatctatcagtacgtaaaattaatgaaaaaccaggcaaacctgtagaagttatttattaatgttcaacttgtgaaatgcaagagcattcccttgaaatataatattccctctttttcttgttcttactacaaattggttttggatgtattaggggttcaaagaaataatttccagctatatagggatggactctgaatctttccattgaaccagtaagtctcctgatgaggccagagagccccatgtctaggggccaggtgagcccctcactcctcaaagctgggctttctggtggccatgacagttgcagattccgaggcagggcaggtgatccttttgtcttcctggatgtgaatgttatacttggccctcaatggtacagaaggccaggctaactgggg

SEQ ID NO: 122148 - DNA, 1053 bp, Homo sapiens
gctaaaagccaactttagaactattatttctgtttcagaaattgaaattgttcactggttttgccatatactttgcttaaatagtggctcactggctgggcatggtggcttacgcctgtaatcccagcactttgggaggctgaggcgggcagatcagcactttgggaggctgaggcgggcggatcacgaggtcaggagatcaagaccatcctgactaatacggtgaaaccccgtctctactaaaaatacaaaaaaaattagccgggcttggtggcaggcgcctgtagtcctggctactcgggaggctgaggcaggagaatggcgtgaacctgggaggcggagcttgcagtgagttgagatcacgccactgcactccagcctgggcgacagagcgagactccgtctcaaaaataaaaaatagtggctcaccagaatactctaagagtccacatggtttgatttttttgctttggttttgtttgtttttgttgccatttggctttgttactttcatgactttagttagagtgaaagcctagacccagaaatgttttactaaatggtagacaaataaatgctgggtgttctgctgctggctggttatctcagtatgagtgccgtgagttaaaaagtgactgagaaatggattattcccaaagatgaaggagatcactcaacacccttgtgagctacctcattcacacgcctgccaagaggcacattttccggtattcttccatagtttagattgtttcaaaacattttaagtaacacaaataacccagatgttgaaaattagtaagtaaaatgagaaaaactaaattaagaattaaatactttaagaattattctaagaatgatggtataaaaactttgaacaaattcatatgaaatagcaaaaaggcagacattcttccattgcatgaattaaaaactattcatatttccaattgtattttaaaccaaattaacttttaaaaaatgcaaacacattcaacaattctttatgtaaatgatttgtaactttgtatgcctttagataaattatattag

SEQ ID NO: 122149 - DNA, 1101 bp, Homo sapiens
gtcttgaactcctgacctcaggtgatccacccacctcagcctcccaaaatgctgggattacaggcatgagccaccatgcccagccgaaacagctctcttactgctgttgtctgagtgtttatgtcctccccgaaatgtatatgttgaaatcgtaaatcccaaagtgatggaattaggaggcagggccttcaggaggcgatgggtcatgagagcggaatcctcatgaatgggactggtgcctttatattagagcccaaggagagacccccccgccccatcccttccaccatgtgaggacacaggagacggtgtcacctatgaaccaggaagcaaccctcattagacaccaaatctgccagtgccttgatcttagatgtcccagactctaggactgtgagagagcaatttctgttgttgacaacccaccagtttatggtattttcttatagcagcttaaacagactaagatacccacgagtctattaacaagataataaacaaagtataatttcaggaattaacaagaaacaggaataaaaagagctgtgaagaaacaaagtggggcaaatgaatagtccgtgagaaggaatgctatttgagtcgaggtcagggtgcctctttcaggaagcaacattcggacaaagacccgaacggaatgaggggacaaacaatgggcaacgttttgggggttggtgaggacagcagcaatgggcagagcctgaggcaggaaccagccaggcctttggaggaagagcaggaagccagtgtggggggaacagggagccaggcgaggcctggaggatacactagagatggcaggcagctcagtcaggtgaagccactgagagatgaaagccgacaacactgtgggaaactgacagcaggagagcctagggaaaagcggggtggttattcaaagagcaggttgcttagcacctttaaggaattttgggggtgggggcagcaggaacccaccatcacaaaaatcactgacatgccatatcatggatgaatctcaaaaacattataagtgaaagaagccagacacaaatgactgggtatagtctgattaagtgaaatatcctgaaaaggcagttctat

SEQ ID NO: 122150 - DNA, 1027 bp, Homo sapiens
tttatcagatgatatgataaaaattattattttatatagtatcttaaccttatataaaatagcttaaaagattacttcattattccaataatttgtacttttccaagtaagtcccatcttccaagttgtatatgtatgtgcttttaagagcactctctcattctctacgtttcaagttatggtcaaaaattagacataccattttctatcaagcatatcactgcataccaagcatattgaaagacagctatatggcttggtttttctctactggaatcatgttttccgttactatttagtacggtacataatacagttgtcattgagtataagattcaccataactcctctggaaacaaagtgtgccagtagctagtgttgcatgctgagactctgtcgtcatcaccatctactcagatactgatactagctagctttggtgtaactgctgaccagcatggcaggaaagaaagaaaatacatttgcatggtcaagccagaggcagcctctttcctagactagctgtgtggtgtgaagtacaaatagctgagttggacccactgagtccagagcattttcaaggttgcacagaatctaaccatactttctgaggtctgctttacagcagaaaatacagtgtgtagtgtgtgagcttcagatatcaggactgggttcaaatcccaaatgtcacttagcaactgatgaggaggaggaggaatacagtaatacgtttttaatgcctagcatgattggcctccagttacgagttctcttttccaacctaatttttgtgtctagattttcacaggacaactaatcccaccaactaaaggtattttggggagtagggggagctttaaacattagaaataagacttgagattgggctcctacccagaactctaagggattcttctctatttgatcccacttttctgtatcctgtgctctgccctttggctctttcttatgattactctcttctagctattttgaaatgcacagtagattattgtaaactatagac

SEQ ID NO: 122151 - DNA, 1058 bp, Homo sapiens
gccagtcatggcctaaatggtaacgcataggcacagtccatggtggtcactcacgtactagttaactgcagtcctcactgctaattaactacctaggtccctgtgccataaaactctactgttgctctccagcctcacaaaggtgtttttgccttccagatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgacaggcttttacttccggtttcttcatattgaggggcaactccagaagtggagttttctgtgagaataaagcatttcacctttctgcaacaagttagttttcaagcagttaagtcatagaatgtttgttagctttgaaaataagttgttcatccactctgtctcccttgtttgtttgttt

SEQ ID NO: 122152 - DNA, 1054 bp, Homo sapiens
ctgggtgacagagtgagactctgtctcaaaaaatatgtatatatattagctttgcagttaagtattaacaggaagttatgtgtttttcactttaatcaagcaataaaagaaatgtcaagctcctattgagatgatattactcagagtgttgttgggcatacacttttttgagatggagagagagggcatggtcttcactaggcagttaatggaaggttaactgtttttactgcttctcagtgtttccaggcttatttttgtgagacacatgggtggtatcctggcagtggccaacatcagaggaggtggcgaatatggagagacgtggcataaaggtgaggtgttttctctacagaaacacaagtctgacataatcaaagctaaggttgtgctgatccttcctgtttgaatgagctgaaggggtttggagcaggaaagctttttggctagacgaatgaaaaacaaggatattatcagacacaggcaccactccccccttaaaaacaactcacttttcacattttattttcctttgttataataaatagatgaagtacatatttttcagaagcattccttgttattttggggttttttaacaactcataggttgtgtttttaattatcactgtcaggagtgaatctcggagagctttttggtatttattctgtctcttgttagccttgtttttatagttcagcattagttgactgtcttgaaacagaagtcaaggcaggtcattttctcttaagagaaaggagcaatcttggagctttctgttcccagtgtgggcatcctcctgctggttttctcagatcttcccggcattgctgaggaatctcatcctcctagcattgctgctgtgactctgtcgtgcattagttttagacacaaaaacaatcatttttctagttttattccgtctccattctgtggcctcctgaagcatgtattctagctgattgactaatacccaactttataccccaaatggtcacaatttttttgaatgatcgtctgtattttaaagctgcatctcttccatttctttct

SEQ ID NO: 122153 - DNA, 1048 bp, Homo sapiens
tttttttgaaggagaattttaagtacagaaactcagcagtatatatttaacccagtttagtggcaagttctttgacctctgccttttgccacttggcaatgcaagcctcagatttatgaccccagacattgcctccccggtgacagtgatcttagcatacccattattgtaactggtcctggtagcttcctccagcttagccagagctcatttgtcttccaagttaacctgtgtgcaggcaacactggtgcaggtctccctgtggactagatgtcccagtctggccgttcctttgatgatgtagtagggaaccccctttcatgatacagggcagatgggaagacagcctgctggaaaggatccatgtcgtgcgcagtcaccaccagttgagccaccttgttctcccacaaggtagcaacagtgtcaacccctgcaccaaggacaggtggtctccagtggggacctcccctttgctggcagctttcttctcagcccgggccagcagccatcagttcttctcttgcactgtctctggtcagtacctgtgagccagcctaggcagctgagtgctgttttgctgcccaaggcctggacgaactggttgctcatgaaggcactttcagccatgtttagaggacagccctttgtcaccgcagctggatgtagcagggtcacttgacaaagcaggtgaggtctcttggggccagatgtcctgcaagtgccaacatttctgggtctctctcaggtgattcatcaccttggctgcttgcttcttcacaacagggactggggccaccgtctccagctgcccaagatgccaacagagtctaacgtttaaagaagaagaaaatgaaattaaggaaagaagctttcttaatttagcatgtaacttcggtcagccgcgggctggctcactaatgcttagaactaactgtgagtttgaatcactgtcgtaatgtttggttttatcttctgtgtccctcatgaaggcttcatatcgatgtactctaagatagtcccgcttatgagatcttaccgatgcttccaa

SEQ ID NO: 122154 - DNA, 1053 bp, Homo sapiens
gggcagtcagttctgagatcaaaactaaaacagtagggactcattgccattttttcataggataaagtggctacttaataaatagcctagccctcgtgatcacatttggctgccagtttgaccagccttgagcaatgcccttgagaccccaccagcctggcccctgccctctccctcactcatctcctgccactctccctcacccgcctgctgcagccgctctggcctccttgctttgcttggcatacatgcatgtactcacccactccacccctcccctctgcctggactgcccctactcctggccctccatcctctactatacagagtcacttactctgcatggatcagagactccttcgctctccatcctgtgtactatagcagcccttccccactcacttacccgtatctccattgcactcatcaccagctgacattagattttcattcatgtgtctgtctgtctcccctttagaatgtggttttccccactgctgtgtccccagagtccagaacacagagtagatatgtttaagtacttgacgattgaaagtggttgtgatagatagagtctgaaatgatctggttgttgccagaaacctataaaagtgaaactttttttttttttaatatttctgtgttggaccatcttcctctcctctggtagggtaatttgtccactagaaatggacaaatgttgccagaaaagtgaatgttgtactacgagttttacttctgtgaaattttttgtgtgatctagcctttaagagttattttaggccatagtttataaccaaaacagaaaattatactatgcctcccttatagagcatcaaagtaaatttgtctattttcctagcatgcttttattgtactggagccctccaactctaggttgttgcatgtgtacacatgtttggaaatcttttagacaagttgaccagtaaaaaggcaattctactgacatgtaaattcagttgacccattccgtattgtgttttatgagaatctaggatcattagtttgtatttatttttttttcagcctctg

SEQ ID NO: 122155 - DNA, 1074 bp, Homo sapiens
gaagctaggaaaagcacccacaagaatgtggaaaccatgcaagggccagaagccaggaagtgaccgttcgagaattcgacttcagggtgtcctgcacctccccccattccctcttccccctagaacctggagtacagcagcagccagtggacagatgaggaaaatcatttcttctagatagccattcttagcccactgctgcagggcccacagttaatttcctcaaatttacactgggtacagaagttttactttggaaaatttcgtatcttaaatagtttaaatggataaagggcaatgaggagggcagtgagggtgactcacctgctcttaaaaaaagctggagtccccaaaggcctgtaaacctccttcagtgaccgcatgtgaccatttatgtcaggaacaagctcatcattacctggggaagaaagggcttattgtccaagtgtaaaatgctgggttctgtgccaaacaatgaaatattacccgtgactgtggctgtgaaatttgaaaagagaagtgtgttcctcgttctgtactgccaggcattttctgaccaagctttaattttctgaccaagctttgtctgtctccttttactagttttgcctccatttttctcttttctctgccgaatgcaatttgatttctaaaaccagagaatggggcttccggattcagatcttgtgagaccaaatgcaaaaacagccatcagataattagattagatctcatgaaagcatggattgtcagtgtgggtatatacacataggctcacaagtagtcttgcactggtgtctgaaggctagctgttcactactacagtaaagagcagaggtactcaattatatgtaaagccccagggtcacaaataactgcagctccagcttcctgctgcagacatttgataactctggcaggtgcacaccagctgactttgttttccttggaggtacatggtgaaaacacatcttgagcccaagccatttatgacttactttggcaccttgagtcacatttggaaaaaaacaggcagccatagcagcttagagcacagtgcacttattctctgtg

SEQ ID NO: 122156 - DNA, 1050 bp, Homo sapiens
gccagtggtagccccaccctcaagttgtgacagccgaaaatgtctccagacattttcagatgttgcctgggggtgaaagtgtctgtggttggaagccactgctgtagaacacaaagacttgggagggagacgacgacgacttggaatggtgtgatggcaggagaggtggagagaagtgcccagatttgaggccggctcagttagaagaggatttaccagatcttgtgggggtgatgggccgggaagagaggtccttcattcccccgtccttgctgggtttttcaggggctccttagcatttttcaatttactcacaactggttcttgctccttttcatgccctagatcttccaaatatctctgctttatgttttgaggataagaaagatccaccctcccctccctacacacaaagcaacaccatttttaaacattagagagatgatgagaatgcttggtctcttgccaggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttaggtgagaacacatgtgacttgaaaattgtgctcttgtttttgatgagaacatcaacaagttagtgcgtctctcattctctagtgatctgttacaaggtaaaaaaccttcaacctgtaatcatcaggaatgaagtgtctaaatagttcatccaagttttcattgtgtgatatctttgtagcttagtactatatcatgtagaaatgcaaggtcttcataaaaattgtaaagataggatttcagacttccaaagtactgctttttaaacaaatatatcagttgtctttgtatacttaatatctggtaataatcatgaacatttaatttttaaaactgtttagatttagaatccttagctttaagcttttgagtaacctttggctatttgcatt

SEQ ID NO: 122157 - DNA, 1061 bp, Homo sapiens
aactgaggctggtgaggccaactagctttcctaatgccatttaaagatttggatccatgtcagcttaactcccaagcctgtgttctaactgttaatcatgtggcagactgagacagaaggaagtcattcaggacaacagcagcccatgcgccctgcagcctcagtgcctgaccactccttgcatttgttgtcgtgacatgtccagcccttagagtttttgtaaagtataaaagcactttagctgccattattagggagcttgcacagcattttctatgacatgtagttaatatagtttagttgatgatttttcaaagaaagtaataaaagtatgactttgctctaggaaaagcataagacaatttattttaaactaatcttcactcaataaatgaatcagtccccaccaagaagcaggtttataaaaagtaattttaacatttgaatgcagagaggtttgggaattgaaatttcttttggcttcagagtgaataatgccactttatagacaaaagaacctcagagaaggtaggcaaaaaatgaaatggttaaagagttaaatcatgtttctttttaaaaagtaattttcctgttttccatttaaatcaacagtgttctaacttgtgagtagcaaaaatgaatgagccccattgttgaactgaaataccttttctcttgatttatttctctaccaaagccctgtagaacaaggtttcaggagagcaaaagaatttcaagagctctcatttaaaacatccggccctgtgagggcctatactttggactatttttccaattttatagctagacttttgtgaatccagccacattccttattctgaatgagcttatgacttgtagtatgtatttatggctaaggttaatgcttcagaatttggtggcagacaataatgtacaccgttctgttgttttttgttcattggagcttgaatgatttttttttactttttattaaattatactttcagttttagggtacatgtgcacaacgtgcaggtttgttacatattcatacatgtgccatgttggtgtgctgcacc

SEQ ID NO: 122158 - DNA, 1114 bp, Homo sapiens
gaggggaaagactttgtgaacacccagggtattcacttagacctcagagaagctatgccttagcagtggggctgtataccttacccaacaaacctttgaaaacaagtcttgaatggatcaagctgatccgccaatgaattaactgccgcaaaatgttttgcaggcagaccagaaaataaaagaaatccagacaacattcaaaagcccagaatccagttaaaaaataaatagttattaaaaaagaagcaaaaaaaatgtgactgatagccaagaggaaaaatagtcaatagaaacagatccagaaataacagagagtagaattaacatataaggacttataaaaagctatcataaaaaaatactttttagagatctttactaagtgttaatataatgaacaaagaaatagaaaatataaaaatgaaccacatactcttctagagataaaaaataaaactctgagatgaaaaattatctgtttatagcagtttagatgctataaaagaaaatgcaaaagttgaagacaggacaatcaaaactaaaccacaaagagaaactaagacaaaaatggacacatttcattgacctgtggagcagtaccaagttatgtaacagtatgtatttgaagttctagaataggggtgagaggacaaaaaatatatacatgagacacaagtggccaaaaatgttacaaatttgataaaatacagaaatcaacagattcaggaagctcaattaatctcaagcagggtactacatcaaagcctgttacagaataatcaacgttcagaaagccaaagataacaaaatactaaaagcagccagaggagaaaacacatattgcatatagggaaacaaagataagaaatgacaccaaattcccagtggaaacagtgcaagtcagaaaacagtggaaagatgccttcttaatggggtttaccttgattgccatatttaaaactacagccttggctgggcgcagtggcactttgggaggccaagatgggtggatcaccttgaggtcagaagttcaagaccagactgaccaacatggtgaaactccgtctctactaaaaatacaaaaattagctgagcatggtggaaggcatctgta

SEQ ID NO: 122159 - DNA, 1064 bp, Homo sapiens
cagaagcattccctcgagattcagacttctctgcctttccttcctccaccctttttcatcagggacctttcaagatgtctcaaggccagctgtcttcctggtagcttcctgggtacctcttgctccaggggaaggcatatccatgggttactctgttctggaggtacaggatgtgttcactgccctcctcactttcagccagggacctcgggaagcctcccacattcagtccctcctgcacatgtccaaaatgctgggctcaggaacaagagctcccttgtgcccctggggtgtaacatgaaacagctgccattgggctttgatgggcagaggtgccagttatttaatatagactgtgaggctttacttgaaggacagtttcatggcaggagagaaattgtcaggttctattggaccaaaaaaacccaaaaacccacaaagctctgttttaaagtgaattgtgagcatctggggagaaaaaaaatcctaaagaaatcaaacactttgtggcactgttcccagcagagggtgctctagaatgaagattgtgaaaatgcatcatccctttagaaaggattaaggaaaaaatgcccagcttctttgtgattatctccctaaatcctatattgagaacctaattctgttatacctaattcttgaaaagtttttttttcaaaagtaatcctgaatcttagtatctgttgtgtctccataagccatttttatatgttcacctgtgaaccctagtaattaaaaacatatgtattacacatatattaacatataaagtgtgttgcctgatgcttgacttatagtaggcatgcagtgaatgttaatttccttactcttcccatgtcccctgtggaagttcatgcacatgaagaccagcagggtctcaccttccagaacagacacagaaaagtccagtggtgttcctggtggggggtccctgcctcctctgccccttgctggttggctgtttttgacttggaccagtaattgctcagtagccctcttcccagttggcacagtccatatttattccccaagtacttagcccttgc

SEQ ID NO: 122160 - DNA, 1050 bp, Homo sapiens
gtcaatccacaaaatatgtttctgggattttgtttgggatttcattaaatctgtagacaaaaatgggaagaactgatatcttgacaatgttgagtcttcctatccatgaacatggactagctcttcatttatttagttcttctacttctttcatcagaattttgcagttttccttagatagatcttacacatattttgttagatttatacctaaatatttcatttttggaggtgctaatgtattgtttctaatttcaaaatctacttgttcgttgctggtatataggaaagtaattgatttctgtatgttaaccttgtatcctgcagccagctacttgttaaatgtgtctagcattctgcaatatgggtggaattgattttcttaaaattatcaagtacatttcagtgtacatttttaactccttcaggcacagagacatctaccaatctccaccaaaagctctactaccatgtcttgggaaccgatcagtcagaagatattttgtgtgctgagtttcctgatgaacctaaatggatgggtggagctgaggtattgtacagctgtgaaattttacccccaaagactgtgtttcatggatgtgtgtataaatattcttattatgtggtgacctttatggatggcagaagtcccatgagtgaatattcttttgttaaaaatattggtattcagattgactcttaataatggaggtgataaacctttaactgcaatctcaacctattactcttaatattaaaagtaatactttgagggtaaaaaagtaattttacttctagtaaaaactataaaagtacctagtaaggtaaaacatgaacctttcaaaactcagaatcctgcctctcagaggtgagtgtggtagccttccacaaattttctttgtacatacaagtgagagtatgggggaaagagagtgtgtctttcccttttttatacaactgtgctcttttcatgcatattgttcacttgtttttacattaaaatgagtgtcttttatacattttctcatcaatattcatatattccttggg

SEQ ID NO: 122161 - DNA, 1072 bp, Homo sapiens
tttttgtagtatatgatttttaaacatacttttcaaatcaaaatgttttatttaaatttttctgaaaattttctgatatatatatatatatatatatatatatatatatatatatatatatatatatatatatataaacaattcaaacactccagtgctatgtagaataaaaggtgaatatgtttctttttcctatcactttctagactcttttctgcatttacatacatatgagcctagatactttataggacctacaatggttaatgagtaggttctgtgaaattttaaacaaatgaaattccacgtaaaagaataggaaacctctaataatagttgagcttcttaaaattttcattacccaataacgtttagcaaacagcctaagaggaaatctctggtgtcagagtctccaataggaggtgttgtattgaatgctttacatacttcataattaaaaaagctaatatgaaacacaagtatttgccaggaaacattccatagtgattagaacattctgccagggccctaaaggactgtacatggcacgacagtctatagacatgttgcttttcctttcacaatttcttgtggaatgtgcactccgggcgccttcactgcaaaccctcaggctttatttacctaggcttgtaatggtcagacagtgtggacattgcacaggtaatgcttcaaaaatgaggctgtaacaagggattttagataatttggaatcaatctcccaaattacctaatgactacaatttagttctattatatggtatgtgtcataattcagtcattactctaaaagcagtttcctttttctccttattccctttagagtataaatgaaatatgacagaagtcccagatgagctctgcttttaactgaactgcctattgcattataaaaatttcaaaatgaaagcattttagtaggcatataatctaatatttcattttatagacaaattaagacctggagaggttaggaagcttgtctaaggttataagggtaattcctgtaaaacttgggctgagcccccgggattcctcactaccagattcctat

SEQ ID NO: 122162 - DNA, 1663 bp, Homo sapiens
tattggcagtgtgtgatctgagctacagtatagtgtgtttgttaggagcgtggatctgggagccaactctgccatctgccacttcctagctgtatgatgtcgggcaactttttaaccactccaaacctcagtttcccaatctgtaaagttggcctaataaaaggaccttctccataggattattgtgagttctaaataagttaatacttgccctgtaagcattagctgagttagtaccatgtaagcattggttgttactacatattaatcagtcacttggcaggagctgggcaggtatgaagaagagtaaggaggtgagagaggctggtaatgagagagaagaggcactggctaagagacaaagtgtgctttttctgatacatattagtggataatatttcacatggaaaattttatatttaacttgctttgtccattttaatttctccacaggcctttgtggaggcccagaataagattactgtgccatttcttgagcagtgtcccatcagaggtttatacaaagagagaatgactgaactatatgattatcccaagtatagttgccacttcaagaaaggaaaacggtgagactgcttttactgaatttcctttttattttcaaagtaaatgctttcttaaattgtaaaatacaaattccagataacttgtccttgtataagattaattcattataaggaattaatttctatgcctgaatatgagagtaatatttttgatctattaggtattgtccaaattgttaaaataatagttaagaaatttagtagggataggtcatataaagaaatctagattataggaaatcgtcgtcttatcggtagtaattggtgagataggatgattcatagacagcagtggaggtttgtttgcctccgaagttaattatctttgatgtatactacttggaaacatttaattctgtgtttttcttctgtcaaagaatggtgaaatgggtgaattcacttctcttgttcctgtcccgttaacacccacttacagatgttttcttgatcttttattaaatctctttggagccactatcacacatttactttagactttcttcagccctctgccattcttacagagatcggcaacgtacagtctgcctaccaaaccctggctgcctacctatttttataaataaggtctgattgggacacagccatgcttatcggtttacgtattgtccatagctgcttttgtgctgcagctacaggcctgagtattatagtgacagactgtatggctcacagagcttgaaatatttgcagtcttgccctttacagagaaagtgtactgaccttccaccctagcagccttgctagggaaaagaaccagaattttattttagaaaagtctgctttcttcttcatttaaaagaaaaagttactgctttatttgaatatcaatttttattttaacacataaaatggtctttatttgcctctactcggctaatgtgcaggattacaatacaggatttgaatatggaagcaattctgttaacaagctctaggtagagagaaatgatggaacctttcacccatgtccccacgtccctgcgatggccagattacagtggtacctttttaggtctttggttttgttttggtttttgcttgtgtgtgtttggttt

SEQ ID NO: 122163 - DNA, 1485 bp, Homo sapiens
ccactgtcccagcctcctaactggcctgtctgtctccacttttgctcccctatagtctgttctctgtccaaagcacggtaatctttcaaaaagtaaatctccttacccaatcatggcttatttgcacttcgatgagagatcgaaacatcatatctgcctaccaggtgccgcctgctgtagctcatgtctggtcgtctggcctcagctcattcccagcctcactcacctccttactcttcttcacacctgccaagttattccccctgccaggactcccacacctgctgtttcctctgcccaaaacattctgccccaccttgcatggttgctccctctcagtcctcaatttgaaacctcctcagaagggcttttgtgaccaccctgcttaattaggtgccctctttcccagtgattttcaagatctgcaaggaatggctggtttgtaaatttccaaaccatttgtggattgaggtttttccaaactataatgaagatgccatagtaatgtcaaattgccataaaggttttcagcactcactcttgttttctgcactcttctcattgtgggctggtagcaaacagttcaggccaacactgatctgtagttgacactttgggtatcaagcagcattgctctgctgattaccctgtgtatgtccttagaaccaaccattctgcaaccctctggctttttgtgggtgtgtccccagtagcatgagctccgtgatgacagggattttagcttggacttgtcacttatccatccacaatgccacgatcagtgtaaacacacacacaagatttgtgtttagtccacgtggatgcttcagctccctgatgttcctacccagcacagcccagttcatgcagaagaaaatcataggaggcccaggttgcgtcttccttctttcctgggtggatctgcttcatctccacatcctttttcagtctctgagtgattttgctaactcactgcatgaccttaaccaggggactttaataccacttgcctccatctccatatctgtgaagtaggcatggtgttttcttccactgtaaaatgaagtagtgcttttggacacacttggtgatctccaaaatgctcccctgggtggtttctcagataggcattgattttataactaaaaagcaaaatccaatttcctccttgatgtttttaatgagggaaagtgcagtcagcaaacttcctgtaaagggccacatagtaaatattttaaatgttgcaagccacataagtctctgttggtttttcccctctagctctttgaaaatacaaaaaccattctgatctccagagccacaggaaagcgggccagggcgaagattgccaatccctagtgatagttggaattgtatttctgtgggactcagtaaattttattttctgtttaaatgaaatcagaaatgtgacctgtaacagttttatttttcttgaactggtcctcttgcaaaaatgttaattac

SEQ ID NO: 122164 - DNA, 1859 bp, Homo sapiens
aagttgagataacttctcccttcaaatactcatctctgtccctaaaaaaggattctgattgttttgcctgggtttactactattactattttgttgactattgcctgtgggttagaattgatggaaagactttgcttatgaaaatgaacagggtttacttatataaacaacgtggaagggagttagcatagttagaatacagacagaggtgtctgtcacattatctatgacagatggaggtacaagcgagcggtaccaagaatcctcactgagaatgctcaattgcagatgatacgatctgatggagaaagagggtaaacctcaaactttctgaaggtataactgtcaccgttccagccagatgttcctcatcagtcacagtgtgatcactgcccttcggtacctggcataaccaagcatgagcactcagtctcccaagcctgcttcctgtacactcctgaattcagtagtgcaggactggaagaggctggctccctgatgggtgagtcatgccagcaagccctgagatgagccgcagcctcacctgcttgaggtcctgcccagccgtggtctgggggagggacattctgattggccagcagcggtcacaccctttccccaactatcagtgggacttcatatggcaccagaaagaaatagatgtcaactccaacagtgtttgccacatcccatgaaacttaatgtgtgatagtcttgtttttcttatttcttcgtattttctaagtaatcttgttacagtttggatttcctcattgatacagaattattcaggagagggaggatatgagtgtgtttaatgtcctcacgatcagatatttagttaggtttggatttgaggtgcaaatcacctcttcaccaggtttttggtcaggaaagtatacaccaaagaatggagcctaatggggttaaaatttcagttttccctggtcatgacgagtattgagaacaaggcttgaatatcaggtcggagtgacggtttctgcttcctccctaattgatagtaactagtcccagtgagggaacgagttgatttacccacacggggacaagcagagaggtggaaagaggcctgacaggcttctagaaggctccgcctagtctgctgatcatgtgcagcaggaagcttactatgagcccttttcacccaagagcagatggtcccagagagaagagatgggcccactctgggttttttatgttaaagttgagcccaaaagattttgggctctcactgattgaactagaatatttctccaccttgagaatgagtagggggttgcttgtgggccaggaaaagaaagcacttcatgtggtgaggttaatggcattgtggtcaaaactgtgacctgaacaagcttttctttctggggcttaagattccccctttgttgtctgatgggctgctgatttttgtaaatattgagtaagtcctggaaaattacgagcactcttttttttttttttttaatggtagagattccttggcatagatattagccttggaaagtacattattccaatcttttattgtttccatttctggacgtgtttcctgaaaagcagctgcatctaattctcttttgtgcatgacctaccttgactgtcctgccctcctggccctaagtcctacagcctcagggtgagcgcctcttggctgctttttgatggggctgtccctgtacttggagagtcatttccaaattccaaattctgctaaagtgagaggggatccaagtgtgccgcccatgcctttcacttaggctgggattatggtttttgccactttctccagaagcccctgatagttgcttaaccaagtcctatatctgttatttgta

SEQ ID NO: 122165 - DNA, 1483 bp, Homo sapiens
aaaaactgattctgggcaagttaggcaaatggggcatttatggcaaggatatgaaggcagcttggaatggaccaagggccaggctctgagcaggcaggaatgtcacttttcacccagcattgctatggcttcactgatctccagtcattcagcctgccgtctctttttcaagtgatggtatcccaacagaaggagtcttgattggccaagctgtgggtgtgtgctcgccccttggctgtattgcagcagttaagagaagagatttggtagaagccccagggaccctctttggcttctgtagtggcagcacagctacctgctccacttagaagggagggcgctacggagggagcatggatgctggctaccccaatgccacatgcctgcaggtttcattctctctcttttctccatatgtgcttcatttcctcctacttcttcacctttcctcctctctccttagtttatctaggtgcccactgtgctgagtattgggttaaataagggggatgcggtgtcataagtaagacagatgcctataccagcatggaatttgccttgtagcttgggaggaccagagattgaagatgggcatgccacttgatctctgagctgctagagattggagcagaaaggaggccaagccacatcttgtagcacaagcttgtctagcctgcggcccaccggccacatgtggcccaggatggctttgaatgtggcccaacacaaattcatagactctgaaaacattatgagatttttttttgcgactttttctttttctttctttttctttttctttttttctttttttctttttttttttttagctcatcagctatcattagtattagtgtattttatgtgtggcctgtgacaattcttcttccagtgtggcccagggaagccaaaagactggacactgctgttgtagaggcgaagactccagccccattggttcactatcagggaaagctccattttagaaaagcacactgtaaatcattgatgaattgtttcaagtacttgtatacatttaatgttactgttttctctgtaagcagttactcagctttggtttcagtcatctgcagtttttcagtgaaaaatgctggcatcagatacggtatttttgggaaaacagcagttaaaaagtgaacatctaaagaactgcgataactgatttctctcaacttcttttttattttgttttttttttgagatggaggcttgctctgtcacccaggccgcagtgcagtggcagatctccactgcaacctccacccggcaagttcaagcaattctcatgtctcagcctcctgagtagcatgagtaggtgggactacaggcatccgcctccacacctggctaatttttgtatttttagtagagacggggtttcaccatgttggccaagctggtcttaaactcttgacctcaagtgatccgcccaccttggcctcccaaagtgttgggattacag

SEQ ID NO: 122166 - DNA, 1060 bp, Homo sapiens
tcttctctttacttttctggcttggttttgcaacccaggggtccaagtagaagtaatattcttgtaatctcagtctccccatcttactccatcttattgtgtcttcacccttttagctgaatgttctagaagttgttactgagttgctgaagaagaaatacacaaaagaaaaatttacacctttcaaggggtagctgccttaactgtaactgattgtcaggtctggctttcacagaactgtcctggagcttgggcacatgagttagctaaatgtagaatatcagtggcatttatctaataacttcttattctccctgagtgccgccctgggcaaaatgagagtaacaacaactccatttccttcacagaccttgagaagagaactctaacaggattggaaaaaagtatttttatttatattcgttccttctgaaaaataagataaaataacaatttgtttcagagaggatgaaaggaatataaatgtagatttcttttctgggacatgtgagttcccactttccattctctcactgactagctggaagtgaccccgttacacctgctgattaagaggctatggcaattagaacagaaatccttcaggattgcaggataagaatcctggaaatgtcaccaccttctccgcctgtctcagtactgtttctttccttggcaggaaagatttaaaccttaaaggacttctgatcatctctaggatatttaaatcctaggatttctatgtaggtattttagtgtcacagagatcagcggagaacaaagtttgtgtaggaaaacgtctgctttcccaggtgcccttcattgtctgtcctgaagtctttttgtttgtttgtttctttgcttgcttgcttttgtttttggtctctggggttaaccttaaaagtgtgtagcatgaggagtttctgttctttctggtgtcaatttcggtgtcggtctagcctaggactgcctggatcatgtgctttccctagcccggatccagaggcagcctctggaagaactggtgctgagctaggcaagcagggactgatctgtctga

SEQ ID NO: 122167 - DNA, 1048 bp, Homo sapiens
ctgtattgtgtcattctgtgcttggctgctgacagcacgttttcaagtttctttagcacagtggcaggtctttgttttgtgttgtagggacagagcggtttcctgttctgacctttcatctttctttcctctctagctgaaacattcttttcatgaagggtggcttgacacctttgagaacctgccaactttggttcatgtggtaatttgggcagacacgttgccagtgagccaattagcatttttgtccatccctttcctatttctccattacattaaaaaaataccagttttaattggggttagagagtaattatctaatacctcattttgttttttacaggtacaggattatcatggtcataaaatttgtgacccttacgcctggcttgaagaccccgacagtgaacagactaaggtaatttggtttctaattaaagataaggcagccttagtagctagcaccaaactctaaatgtcagtaactatagcttttcctttctggtgttctcctgtgttttctgccatgggatggtgagtatacctgttgttaccactactttttgtcaaataatttatgggaaaaagacaaaagcatggcttagtcccagagaagatcacctaagtgtttcagataatgtttatggttcatagtgacactgatgagctattttaaatgaaaatatcagaaagaaaactgatttttgccaaaagaaaaaatgaaaacctagatagaaatgatgttaaaggaaaaaattgcctaaatatttttttccaaagaaaaggaaatcttgtatatgaaatgaatattaggtcatgaaaactgaacactgtccttaaattgcttattgatgtcaacacaacaacagtgaaacaaaagctaagtagtgaaggggcaggggggagcattttctgccctaaaaacataaagctttcatattcttttggagaaacagtatttcaaggatcctgctgaagtccattcagtaatgaaggtggccctaagtcctatgtcccacagacatttttccctttttggagtgcctag

SEQ ID NO: 122168 - DNA, 1136 bp, Homo sapiens
taatagctacatttctcagattacttaaaatataatcagaataagtatgtatttgtgtgatacagttttaatgtttttctgtttactttcccaatttatgccagaaagtgtttactttaaagcacgtgctacattggggtaaagggtgctgacgcttcggagtaaaggacatactgttttaaattaagacttccaagtgacactgatgcattcattcatggtttctttgaccagtggccatctggtaaccatgttttctcagtctgctcagctgcttgcttattaaatttaccctaacagctcaagaagctctattcctgtggtttaaaggttgtttcctttgaatatgggagtaaagtgatcctgctggaatggagaaagaggctggactaaatgaaaagaccagagcgctagttctggttctgtcattcactagttaggtgacttttagcagctcttttacctgttatgggccttttttctcatatgagaaatatttggactgaccatagggcttacttgcttctgcagtaggaatgttgtcattcattcattcattcatgtgacagtctagctctgcagtgttccagactagtaatgggaagccaggtgactctcttggttctggttcttgaggatcagaatataaagaattacccattctgtggtttgataagtgcagttttaagtttgtttttagagttacttgttagtttttcaccactgtgggtgcctaaatcctacagtttgtttatttatgtttgatatttcatgaaaggtttaagtgaggattttatgaagacgtctaaaagattataaacaactcggaagggtatactgtggattttaatacactccagttccttctcattaagcaactcatgctaactctaagcctcgtggccaagggaatgtagctctggcccagtctggatcttgttgtgtggctccttgatagcttacggtggagtatctttttttttgcattaaggttttggttactaagccctaggcttgacttaggtatttgcttaaatggtagcctttgatttctaggatgggtttgtttctccccagcatcagctgggcattgcggtagctctctgtctctttcacttgagcaccttcagccatat

SEQ ID NO: 122169 - DNA, 1132 bp, Homo sapiens
agaaaaagaaaaaaaaaagaagattctgttgctagaagaaccaaagccattacaatctgcttattgatggtgtgctggcagaaacactaggcttatcgtcagaaaacctgtctccgctctgcctctattttgctattacctggggcaagacagttctctaagccctagactccttagctttccagtgaagacaagaataagcacatgatcatttcactgggaccgctgtgtgaaggatacagaaacaatgcaaatgtaaggggttattattaatattatgatctctttccggtccctggacctggcttttgccagatcatctgtttacttgttcctagggcaaatttaatttgcaaggttctaaaagggaaggtgattgctcaatgttcaaattaaagagctgccttcaacctacccaggtgtgcaggcaggacatctgcctcccacctgcttcacccaagtgatgcaaagaagagtgtgttggtttcggcttcctaatcatgatcatggagacactaagaagtgtctctgtcatgcagcttcactctgaaatgttgggcttctattcgtggactcttttgaaagctgtctttgactcctgaaaaccaaagcacttgaaacattcattttttttttatctctaaaaatggaataggacgactggcacttgtcctaaagccccagccacacctgctgtttatcctgcattcacgcagtgatgactctcccctagagttcatggcatttcctttgacacatcaaagtgaaactcctagaagacagaaacaacatgtctattgttagaggaggagtaaataccccatttcaaggtgaaaaccacaccaccatgttgatttttttttgaagtcctaataccttagttggctagatttcagggttaggaaccagtgaatggacattggtgaaagtgcaagctgtcattctggtaaagtcacccccttggaaaggagtgttataaaaatatttcaaagaggagaacagaccaactaaattcacaaaatctttcccaaaggaattacttgtctccacatccaactggtcactaggttccctgaaccctggattttccattaagcgtaacctcttcttttcctccctacaaccttaattc

SEQ ID NO: 122170 - DNA, 1050 bp, Homo sapiens
ggttggccgtagaaatccagaatttgctactgggactattccttacagccgtgtcaaatcactttcccccttccctaaggaacagtatttgaaggaatccgggagactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttgtttgggtatatgaggtttgactatggctttaaaaagtgtagtgtgttttttccccatatcaagtttgaccaaatattcgtctgttcccaagcttcgtttgtgctgtgttgccctgtccagtcctttgggactgaagtaaaaatctccattctgtgggtcatctttgccttttaattctataatgttcttatcgtcagttcagctcttagcttaagtttttcaatttccgtcattctcctttaaaatcatagctaagtcaagtaatgctcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagcgcttgaatagaggatagtat

SEQ ID NO: 122171 - DNA, 1059 bp, Homo sapiens
caaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatgaaaaaaaaaaaacacacacacacacacaaacctcatctggaatgaaaaaaacataatgcatttggtttctggttccttaggctgttatggaacaaccaaagaacattattttggtttctgaggtcagaactattttattcccctcaagcacactatgcttatggtttgagggagaatgagaaataggaaactaggaacaggctgaaatggtctaatcttgaccatctaattctgcagtgtcttattctcattctaaaagagaatggttatattcgctgttctagcataaaaagtaatgataaaaataaaagatcccgtattaccagacaataatcccctagactgttttaatgcttggttgagtatttgcttatgatctcagactttaaaagatggtctccccctatggtgaagcttgttaattatgtaggcatcattaatgtctgtttacttatcaaaattttatcattgttagttgtattactacttgacagtccaatttatttaattgaaaagattggttaacattttatagtcaaagtaattgtttcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccat

SEQ ID NO: 122172 - DNA, 1001 bp, Homo sapiens
ttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctactt

SEQ ID NO: 122173 - DNA, 1048 bp, Homo sapiens
tctactaaaaatacaaaattagctgggcgtggtggcgcacacctgtaatcccagctacttgggaggctgaggcagaagaatcgcttgaatctgggaggtggaggttgtggtgagccgagattgtgccattgcactccagactgggcaacaagagcaaaactctgtctcaaaaaagaaaaaaaaaaaaaaaacttccattttaatggagtggaaaaatactggggtggggaccctgtcataggttaataaaagtctttctgatgttcatggtttacctaaaggaaatcagcataccctgagaactaaatgtgaaagattaagactcatttcaagtaatacacagtcatcaattttcgcttctactcttgttgaatacgaatttgataaagccctgttcaaactgcctatgccaaggagcttagcgaagtgaataccaccttcctcgcgatgtgcagacagcctaagcacttcaccaaggctctgtctggtctagccaggatcccagcagtgctggcccctggagtcacaaggcgtgacagtcacctctgccaaaccacaataggtacttcctgagccagttcaattacttagcgcacccaagaaaacagaacaggctaagaggaaagcacttattcccaaagacggcacgttattacttggtaaagatactatttaggaacagcagcaatgaggacagttctagactatccctgccacagccagccctgtctcctcgctacacaataaatgatgccttcaggaaaaaacacccatctgggcagggaaaactgaaaattccctgctcagccttgcctggaaaccaaaagtaaaacatacgatgtttagtttgagctctgattattggaggacagtcactcaagccaggacacctgccctaggaacgcactgaaggcattggctgtcaatgtgtggagatgccttcagaggcagcaggtttgggggatcatgctgaagcctttgtgcaaatatccttcatcgtctaaaaaatgtctctgcttgaatttagttgagaaagaactccacactt

SEQ ID NO: 122174 - DNA, 1974 bp, Homo sapiens
ctttacaagtcagttaacctcctggcctcagtttccctgtctgcaaaacaagactcataatccaaacttagatgtctcagtgggccactgtgtacattaattattgtttatagcgcaagtggaagttgagctgtgttaattattattatcattcctgggtcttccagccaagtttaaaccaagccctcctcttgcttttagttcctgagatctgacagatacagccatgaggagggccatacatcaaggtgactcagcagagggtgcatgcctcacccggagaaggcaactggctccaaagccttggctctggggatgtggggcagcccaggtacctatggctttgttagaacctcatgctaacagagcaagagttctgaagctgctgccacactcctgtccctcacctctttgtgtacctgccatttaatttacccaagaagcctggagatcaataagaggaactcaccctgtcattagacagggccctaaattgcaagttgcagctggagaagcttcagaggcattgtgatcactcatgaagaaagatgactaatcgctttcttctggtcacttatttggcttatgactttggtttctctactctctaagtacaatagctatcagatttccatgtaactaggtagtgacaatcagtatgtccagtttcatttaatacacttgtttgtgggctctgctacctcacctaggccaaattgcttagttgtattgtatcctgccattttaaagcttgggagacaggcgaaggagggaaagctcacctcagttgaccaatcgccatctccatcagcatcagcatcagcatcaacatcactagtgagtgtccaggagacatcgtgtgtttaaccctttgcagtgaatttaatctctatgtatccagtgcaagttagacaaacagttccaacaggtttggatctcagccgtgtgcagaaccctatagtttagaaaaacagcaccaaaaatacaccagcattccaaagagcaggggaatttatcttctaccatggtttgaagccagctgttcagggcacagttgcaaccaatgtcctatattacttttctaggcagggaccagagcagtcagtttttacgggaatgctaagccccctgtaaggcagcatccttacccactcagaatggaagccagctctccaaaggttgaccaggtccctgcctgtgtgcctgacatcctttctcaaggaacatgcacacccatgtctattggcacggacttgtaactatctccttccgaatttggtccttgatgttaatactgactcccctccccacacaccccagccttcactttcccccagctctgcaatccccgggcagacaggcaggtcccaccgggctcttttgtctgctcagcacagcaggcagacgtcggggtggtggtgcatgctagttaactaattaatgattgtaaagcactttgaaaacataaagaaccagataaatgccaagtattattgttattaatgatgaggaggctgtttagtcatcctcagccctgaactcggctcactgctcccactgtggctgcaggctgatttgagaaccaggatgagaactcccctcctccctgcaggcgctgtttcacactgagtcagtgaccaaggtgaagggccaggaaaccttctctcctcatctcccacctgctgtcaaagcactgcctactttgtggctgtaaggctaacatttaccgaaagccagggtttgaaactgcctctctatttcccattcacctgtttagtaagttcactgatgtttacttgagtgctcgctgatggtgataagactgccatctctgtctgaggacagcatgcaacctgaaatgaagccccacttttcatttagtaaaattccatgaggatggattcacttctgcaaggatctcttttacatgttttgggggcttgatattttcttatagatgcctctatgtatatt

SEQ ID NO: 122175 - DNA, 1020 bp, Homo sapiens
aaaaatcaaaagaaggtggcttggcatggtggcttacgcctgtaatcctagcactttatgaggccaaggcaggcagattgcttgagcccaggagtttgagaccagcctgggcaacatagcaagactccttctctacaaaaattaaaacttacctcggcatggtggcacacacctgtagtcccagctacttgggagcctgaggtgggaggatcacttgagcctggaagccaaggctgcagtgagccgtgatagtaccactgcactccagcctggtgacaaagtgagaacttgtctcgaaaaaaaaaaaaaaatcagaagaaaggaaatcatatccaactggtgaaataaaaaacttcacggaagaattggtatttgacatataaagtctgagtagggttttactgagggatgaaagtaggaaaataagagcaagttaggcagtgtgctgctcgattgcacaggctgtgagacaatcgatacataagggatagtatgagttagggtgaaaacatcttctgggtccacagtgtgaaggctcttaaatcatagtgttatttggcaaggaatgaggggtcccagagagtttggaggctggggcaggatagaatcagggtgaactgaatgtgtaggatggattaaaggcaggtagaagaagaggattattcacagaccctgagagtagaataggcaaaaattaatcagcacctgcaccatggctctggcagtggggagaagaaaaggaggcaaatgttgcagtcactggggaatatagaattttgagcaacaggataaacacagcatctggcacaggcccattcattggtccagcctccccccaggcatcccattattgaagatgtgtattgtgtctgctatctccaataatctgtgccaggtactgtcaaaaaggcaaaagtcactgcattggcagaggtggaatgactgtgatacatggctaaaaactacaggatctggagggagagacatggcactgaacggcagctgcagggtcttcaggaa

SEQ ID NO: 122176 - DNA, 1069 bp, Homo sapiens
gaaaattctgttatttccacttctggccaatatgactaagcaccgaggtggaaacacagcctaaagagttgaaagagccctgttactaccctctgtagtctgatgtgagaaagaaaacataaataaatatggtggggctagatgtgtaaagggggtccctgtttccctctccatttcccccatattcaatctatcagcgaggccattttccaaatgtgtcttaactcatctatctatatgtttactagaatcgtgtaacttattcactccatcaatgtgtatgttgaaggtctacagtgttccccacattgttccagtggctgggagaaccagattgacaatgggatgtgagctgcacattctagggactcttcttgcttggaccaacataagtgccttcctactgaatgccccctgcttcctcttttcctgtctccccctattctccactttgtagcctaaagggtcttttcaaaccatcaccacttccttgttaaatggcttcccatcactccttaagcgaaatactctgcatcctcctagccctgctgggcagctgcgtgcctcctgcgtctttggcctcttttcacatcccatgttcatacctcacaagcgcctcctttcagatccttaagcatgtgcaaggttattttcttttcagagctttcaatctgcttttatttctgcctaaaacagtagatttcaaacttttgggggccataattcccattaagaaatatattttatataatgaaccagtaaatacatcaacacatacctatacataaaaggaaaaagtgttttataatacttctgatattttctattccttttttttagaaaaggtagtcatgacccactgactgcaatttggaaacactccttcctctgttctttaaaaggctggttctttctcatctttcagctttctacctaaatgtcagccacttacaggggctttctccaaccacctgatctaaaccaggcgcctgactggggttatttttattctcagccccttgtcccttctctttagggaatgtattagagttgtaatgaaatatttcat

SEQ ID NO: 122177 - DNA, 1029 bp, Homo sapiens
gtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattca

SEQ ID NO: 122178 - DNA, 1107 bp, Homo sapiens
ccttagttacttaaatttagttagtgatgcttttatgttaaaaattaaaagtggccccagcttctaaaccagagaatcagtgctacttattcagggtttgggtaaggggatttattaggcttgttacacagtgtttgaatagtgcttttgtcctccagcttctgttgtacaactcataaactccagcaatccttttgtaacatggttggtcttttgcctttcagatacactgtgcatcatcagtggattgtttaccatattgtatttgctcccatgtttaaatattgctttagatacagtactttggatattgagttgtgacttgtttcttctgctgtttcatagtatacaaaggtgactggcttaaggaaaaactttagagataaggaacttttactcttacaccactattctttcattttttgactcagtgctaagtaggaggaagattctgagaatattaaaatatttcaaagaaatataagaatatgaagagaattataccggaaatgttttcaaatattctaagaaagatttaatacagtaaagctttagcaaactggaacttataagcaatgaatcattccagatagctgagggtttctccatttcaataccaatgtttaaaaaatcttcccaaagtactggtactatgctttctatagtattctgtatatagcttaatatttcattatgaaaacaaatcattatattaacactatggtcacaactgtgtcaaattatgtataggtgcaacaaagaaaaaataaagcatttttttaggttagtagtattataaagtgataccttttttcaaaattgttttaagctatggcacagtgatttgggagtttggaatgttttatttggttatctttggaattgttagtatgttaaagtttttatttttcacattcttttatcaactgtagtattttgtgtcctctgttgactgtcacctgggactgtgctgcctctaacaggaagtctaaatatttctttaaaagggtctcttgtttcaggtgccagccaagtcattatcaccatacatcatcagctcattttgcccagaccttagagcacttacagattcaaaagtcattttga

SEQ ID NO: 122179 - DNA, 1044 bp, Homo sapiens
tgacaaatattaatggaccctattacacccaactagaattactgggtcattttatgaaagcagataaaataatattgttttcaaagtttatttatgtatttattaatgaacaaggtttaatttttaacttttaccacatttttatcttattgtcaggaagcttttaatcagttttaaaatggccttacaatcacttaatttaatacactttgctttttataattacaactgatcatatgggattttttatattatttaaattttagtttatgtcctccttactaagaaatacagagattataagcaaaagtcaatgaaagaattaatatggacatgtttttaaattgtttaaaatgttaagagtcaaagctctgaaaatataataaagatataaaatgtatacatggaaagagatatgtggtatatctggtatttggtatatactatgatattgcatgttcattaagacctgtactgctaagtgagtatgcatccggaagaagttaatgtaagtatttttaaatgggtttgtatttttctgataaacagcactctccttctgtttgtgatcataggataaaagccctgtaagcttgtatatgttcatttttactgctacatcatgtagtgtgctcttaagattgagatctcattccccaggaagcatttctgtccaagattaattgcccttttaaaatcagcgtttgatgtatttctttggctatatcctggcttggtttaaccctctttgacctgacctcgctgactattacctccgtggctgagacaaaatccttcagcatgatgtatgcacttcacatttcagcctgtggtttttcatgtcgatggattcaattagttggtgttttactaatgaacatatcagaggttaaagaatttgtcagacagaacaaaattgttcaggctagtggtaatcagaaagctcgtcgctctattttttaaaacttctaggcagtattaagtatttttcagaaattttaccttcagtattacacattccaagatagcaaatcaagtcatttt

SEQ ID NO: 122180 - DNA, 1031 bp, Homo sapiens
ggtcgggtgtggtggctcacgcgtaatcctagcactttgggaggccaaggcgggtggatcacgaggtcaggagatcgagaccatcctggctaacatggtgaaaccctgtctctactaaaaaacacacaaaaaaaatcagctgggcgtggtggcggggcgcctgtagttccagctacttgggaggctgaggtaggagaatgacgtgaacccacaaggcggagcttgcagtgagccaagatcatgccactgcactccagccttggtgacagagtgagactccgtctcaaaaaaaaaaaaaaattgcagagttgtatttattatataatagaaattttttttaaaaaactttaaatccatgaaggaaacaggtaatgcattagtatatatgaaggtaatactttaacagataatgcttgtttcttacgaatgtattctgaattggaggaatgcaggattacttgcatgacatataccacacagttcatgaagcattttgcatctaaggaaatagtttgcctaagtagtagaattaggaacagtgggtttggtggtaatgttgtggtattccagcctaaatgactaagcaaagaatatggagcccaaaatatgtgtcattcagcctgagaatattgcaattttccttagtcaagtatgcttgcttatactagcattcctacatgtatgtaatgctttaaaaatgaacagaggttcattaggaaggggaagggcacctacaataatactgtcagaaccaatgccagaaaggattgaaggaagagaccactgactacccaaattattaaaactgaacaggatttaagaggttataaatacattttataaagtcttccttgaactttactagcctttatagtaaggtttctgatgatgtcttacacacatccatgtatctctagtgctagggtaaatgtttgccaaacaatccagttactgaattctttctatcattaccatgaaacatattatttacgatcattaaatcttggagcaattaacattaagttgattat

SEQ ID NO: 122181 - DNA, 1047 bp, Homo sapiens
ataatgtagaaaaaaattaattttatatttgctttatgtttatggaaagataagtttaataaaaataagaaaatatatgtgatgtcctttcagaaacttctagagggatatttaaaactttcatctcttcatgtgaggtattccattataatgttgttcatttttaataacaaataatttatatcattacagacagatttgaccagttttgggccatcaatcggaaactcatggaatatcctgcagaagaaaatggatttcgttatatcccctttagaatatatcaggtaggaaataacattttaaaaaacatccatttatgaaagcctcagacatcttaattgaagcactctagtgtagaactctttgtctgcatagtaactaaacggtatttattaggggttttccaaactgtgtctttcagtggcaatcaagtcagataccgcactgaaatatttgactcatatgcatttggtactcattatttgtagatttcatattggcagattcacatgcttactaaaatttatgtgtaaccccaaagtcagtacttggagcacttttacggtcattcagagtggtgaaaaattgattcacctgatgctcatttcccagcagaggttgatcaaagcgaggctctaccttcttgtctcagctgtcatactataaacaagccttcttgtcacagtgtatgtagtgccatgcttttacatttttgtgctttttattagtgattttgctgtttaaaacagactccaaatgtagcactgaagtgctctttttaaacagaaacacacatagaacaaggttatgtattgatcagttaatgaacatgttgtgaccgagggctcacggaaacataaccttgtattcccccaggagcgatgatttcagtgtttgtggtaaccttatagaacagaactactgcaaatcacaagaatttactaagtctgtttgttttggatggtgagtcttcagtgttgtaccacaaagtaggcaataggctcttaagtctttctcacagcatatttgcatgaggtaaagaaa

SEQ ID NO: 122182 - DNA, 1824 bp, Homo sapiens
ctttttctttctttaactaattaatttataccatcttaatgtcattggtcagtggaagaggaaaaaaaagggaaataagctccttgaataattcagtgttaataatttatatttggctaaactcgtaagattatttagagtgttttcataggctacattgtgatagattatgaattagctgcctatcaaagatgagaaatattatttggataagtatattgaatcttagtatccaggtgccacatgttgagttactctaagtgtatattatcaacaatatttatttcagcatttactcatatcgtgtattgtgatgtgttattcagttgcagaatattagcattggaaggcacttggatattacagaggtcaaaagccatgtccttatgccatacctagaatattgttttgcagatctagtgctatatttgtggtatagagaatattctgagagatccaagtggaagcatttactgtttcactggggccagagggctgtgagcatggtttgcagagtagggatttgaataagtgagagaggagcatactaggtaggggaatagtaggatacagagaaaggtgttcagggggccacttttggtagagggtttacaaaaggaagtacagtaattaaaatggaagtattggtgggattaaattgtagagaggatgaaatttagaatggggaatgggtttatagaaagattttttccccaatgtgaaagagatattttctaagatgggagagtagttttgcaggaagagaggagaaactatctggagtaggaaaaggtgaatatattggacggggcaggggtaaatgcgagaatgatcctttggagttggactgtcaggattcacagggtataggtgaagctcctctttaggtaagcagtagactcttctgggcttgaaagactgatgcagatacagtttcattttgactgtggttcagtacttaaatatgcaatgaatattactggcatatgtaattttgatctgattcctttacataagtaataattttacatttagaatttgttgtactcttttctttgaatttatactaaagattggtgatcatcgttttttttttttgaagtggataatctttatggcatggattttttaaaataatcttttgttttctagcaggttcattcatcgttgcaaggatctgactaatgctcttcattttattttcagtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatgtaagtacattgattgtggcaaatgggatatttaaccttgtccatttttgtaagaaaaagctgtaagaacttggaggccattatgtaacgttttagatacagctaattcatgcttattttggaaaaaaaattaacacagataagcataaagaaggaaataatcacctctaatgctaccactcagaggacaaaaccactgtcagcatgttgtcatgatgcgttctggactttgttttccttacatgtatgtgggtatgttaatggaatcatcagctatggtgccttcttgactttctttttcttatgcatatattcatatataataaatgtatgataatggaataataagatgtgcttttttaataggaagagatattgaaaataataggttcagattgtattcttttgtagttaggagattctaagcaactgtttgttaaaagtgtttttat

SEQ ID NO: 122183 - DNA, 1118 bp, Homo sapiens
ttcaatgaaaggtcacgtgtatacatgagaatcatcaactctaccgaactaagtgcaatcacggcctttcagcttgtgatttttagcctaacactattataataaaataaatgtttgaagtcagcctatggccagattctggttcagcagttacagctgtgagattgtggccaaactggccaacccctttgagcttccggggttttgttgttgttgttgttgttgttttgtctgtaaaactggggagaaaagagggagaggggataatgtaggcctcatagggcggctgtgaagatgacgggacatggtgtactgaaagtggctagcacagcagctggcacacagtaggggctctcttactgttactactaataatacattcatcattttcaaaagttatgaatagatttttccttaactaaaagacatacacattacaataaagaaaataaaggaagtgacccttacctttaatgtctaaaactaaatttggcttcaacttgctgtaaatcctgccatcggacttcaagctccagaactggctgtcagcattctggtccagggccaggcctagcttggagccagatgttaccaggctgcccacaatcgtcaggcagcagtcttctgctatctgctcagtggaaaagaccagatatcttaaatatgtatccagctgtaagtctcatagcaattatttctctggttacattgggctttaaaattatcttagttcctagcttcatttaccccacatgaggcagttcagctcttagccaactagaatcggacaataaatatttatgccatttatttcagatgacacgaatgatgggaaaatctcaatgtttgtgcatcgtcagagacttctgccctttgcaagactatcttactagtagggaaagcctcataacattagaactgcccatcatatttttccctgtcataagtgaccatgatcccaggcaggttctgtagctatatctccctctgacatctccacctctgcttggcctgaccttccagtatatgactgcacctctaattttgtagcactgggtggctaaagggcattttatcattttaaaactcggaattgcatttattagcatttgtctttc

SEQ ID NO: 122184 - DNA, 1028 bp, Homo sapiens
cgcagtgggaagcatggtgttgagcctgcccgctttataacagggctccctgtgccaggtggactatagcagcgtcatcacataaacatccctacttcactgtgagtaacctttctttcccccctctgtattttaactctgatccctttgtccttaacaaacaagtattctaggcctgatgtgaggctgtacatagacactgtctcattatccagttaatctctgtttgctgtcacagattcagccagcagtggcatttgcctgccttcaatttgaaacctttttttccattgtcacttacgggaattgctgaatgactcattgtgccgtggtcagccctctcgggttatttgccacaataggcctgaccagccagattaaagtgggcagtaactgtaagctgcctgtgtcatcagttcaggatctgtgtccccggtcagagctctaaattgaacattcagttcagccggttttggtttagtgccttaggaggcaggcactttgtcagtctgtggaatggatgggtatgtgcatggtacaagttagggattccaggaataaggcaaagggctgggtgagtcccactttagggtgcatacagatcactggggaagcatttttctgccccaccccctacaggttctgatgtagttgttctaacaggaggccttggactctgcattttaggcatgcattcaggtgattccttttccaggtaaacagcatcctgaaaacagcatcccaggggctttggaggagtgataggttcaggtttcatgtgggacatacaggaaacaactggtttttttttttttggagacagagtctcgctctgttgcccaggctggagtgcagtggcgcgatctcagttcactgcaacctccacctcccgggttcaagtaattctcatgcctcagcctcccgagtagctgggattacagacacacaccaccacacccagctaatttttgtatttttagtggagataggtttcaccatgttggccaggctgtctcaaactcctgacc

SEQ ID NO: 122185 - DNA, 1060 bp, Homo sapiens
agagggctgccttgcctgatgtggcaagtatctcatggatcccatggcctcaatgcttctgaggtttttctgatgctactgaaattgtttctatgaggaaatttatatggggtttctcctctcaccttctggctgttggaagtgcattttttaggggtacctagggacaagtccttgatgctttcccaaatggcacacttactcccttggagagttcccccatctgccatccccctcctgtctcaccccatcttccagttttgagtttgccatctggggcaggaagtttccgagaaacagcaactgagagcaaaattcacctcttccttttgtcttctttttgtctaaaggtagactgagtttaagtccccttcttcccctttaccccaacccaggaaatactgaacctttcacagaggtcaggggcatacctgtccaggaggtagtgctggaactgcggtcctggtgcctgtccacaggtgtgtggatttggactcagaccaggagcccttaggtcttccttggtgtttgtcacctgtcagtgtcccctcacacacctcaccctctgagatctgcagcctctgtgcctggtggaagaagaggccaagggtctaggaaaagaagtggaatagactgtgacttcccagattacatccattccatgcagtaatgacattaggagtcctgggtccttgttttggctctgctattgacagctctgaccttgcacttaccactcaatcatttgcacttcagtttcctaatctatcaaaagaggcccactcggatatgttaactctactgttttgtgattctcactgggaaaacgggaattgagggaaaacctctgcctgctgccatggctgcctagacagtgtccttctccaccagcagcttcatgctcttgcagtagtgagaggttttctgtaccgtcttccgaagcctcaagtgttagagagggtttttgcctcagcaggaaggaggacttgcctagcgtcttgtaagcagcaatattccaaggccacatccagagaggttaaggttcccgtcgtccctacgt

SEQ ID NO: 122186 - DNA, 1029 bp, Homo sapiens
atgccagtgaacttgtaaggaagcttggtgcagacgatgtaattgattacaaatctggaagtgtggaagagcagttgaaatccttaaaaccgtatgtattagaacaatgttcacactgggagtgggaacaaggacagttgattatgcaggtctgagatggcttggtggctttacaatcatgttggaatcttgagaaggatctatgaaaacattccatgtcactagaagttacttaggttggcttctgttttaattccagatgttaatacaacacagtaacagcatgtggataggcactgaggaagttattttgcttacatggtctttgctaatttttaagttagcatgctggtttgtaagaggcctgaagacaaaattggaaatgtgttcccttctgtggcatctgtcaccacaggaagaatatagagtagttcatgaaatacatgattagcccaaaacatactttcgtgttttggcttaaaaaaggcttaagagaaacagtgtaagtctaaatcttggtaatgggagcactgtggatgttcccagtgtgtctgaatgccaggctgtggtttggcctgaggtaccaagcaggaatgcattcaggaattctcttgggtcatgttgattctgactgtgactccagcttattcatctgacctttatccagccaagaccaagctgaagctgagagcagaaatgaggagtatttggaaagctattttactgcttctgtttaaaaggttttcccttttttgattagttttcagaagtcaactactcttgaccacattgagtagaagtatatttttaaagagaaagaaaaaagaaaaaaaagggagtccttatctgacaccgcccagcctttctcagccagtgccaccaacttctagcagtagtttggtggtgcacccagcagcagccagccaactcatcattccttcaactgttcagggagcttctactcttgccaggcagggttccaaacaccagctacagtggtgaaccagacaaatgcccactttcatggag

SEQ ID NO: 122187 - DNA, 1333 bp, Homo sapiens
taggtggcaaaattccctgcactttccagcagccaaggcagtagggacccacactagcagttactcaatttacggtgatgttaaataggacagatactgccaccacttagtgttcagaaaagtgttttttttgtaggccgtcataaagagaattctcatgaattctgtcaacaatatccccttagctaatacagtatcagatatcaaacaatcactttttataatgtccctcagcctcaatcagtagcatgacaccaaagtacagtacaaacaattttctgggacttgaaaccatccagtccaagtaggcagttctctgaagctctaccttaatttaagaataaaatgtaagagcatggaaagcagttttttgactggtgattctcttttggattgcacacttctttgggaaatagatgataggtctagattcctttccttgtcaataagcatatgcatcatcgcacaaattttacatgttattttaggaaattcacaatttcagagagttcataatcccttaccctacccctcaccccttcacccttgtcccgccccaccctcctgccctgactgatccaggctcagcaccctggtcttcaaggctattgtgagttaacatggtaagaacatgcagtatgaggatggttgtgctggtttgacagattcctctgctttaacaggaagccacatcgaggatgggaattgattttcatttatgaaagttgatgaacttgacatctctgaacaaaagatgtttatttcgctttggtgagaatgtagtcaggaatgtgatttttcttagagaacagctaagcataacaaattaaaaagggccccaaatctccctctcatagaggaagctctaacaattttagcctagaaaaattataaggcagatattacaaaggaccatctgagctatcttaaaccaacaaattattggtattttcggtatttgatattcttggtacagagctcatagaatgtctttattttaagcaactgcagtttcttggtgaacctaaaataaaaatccttgtgtaatatatcttgggaagctgaataactttattttcttttagaattatttatcatcttatcatcaaccagttatttgttgaaaacgtttatccagttatatctgctttagattctcgttaattgtggtttcctttgcatttcagtgttctaatcttaggcgcttcaggcggagttggtacttttgctatacaggtaaaaccattttttaatcttgtgaataggaggattttgtttgcatgaatttataaattaagatacattatttctccttaaaagctgagagaaaggt

SEQ ID NO: 122188 - DNA, 1039 bp, Homo sapiens
ctttaaactgatgacagatttaggatttttcaaattggcccaactctctgaacaagtcaaggtgtcaacccctgtcaataggatggaacacttaagggccccattcagtcatccgtgtcaccaaacaggttctcaattactaactgccagctgactacattctgggttcaggggcttgttagatagtaacagtgagccaaggctactcagttgatgtattagcattatcaggggaccaagaaaactaaaaacaaccttgggctgcaggctctgtatctcaaagaggactgaaacctttctgcagctcttaaacagcagctaaagtttgacacgactaaatgtccacttctgttgttcaaaccacatagaagtttcagtgaataattgtttaattatctttagcagtggaaaaggaatgtaaggcaggaaaagtgaagcacatgacttttgtgaatattacaagtgaagttgttttttttttccctgacagagtataatcctgactccccagatggcaaatgttgtaatgttggtataatggccatcagcttagattttctgggactttcccacctttcaaacactttatcccatgtgtcttgattttttattagtaacacaactcatgcaagctacccacctgtcagcatctctctcggtatcttctaccttccctcctgctgtatggattagctgtcactgctttcacataaggccagccctcggcttgtgtttctgatcccatccccctcacctactctgggatatcattccggcaggtgtctcctgcatcatcagtcttttcttttctactggatcatctccattagtatacagacttgctgttatttctcctttcttaagaagaaggaaaaggctgggcacagtggctcacacctgtaattccagcactttgggaggccgaggcaggtggatcacctgagatcaggagttcgagaccatcctgatcaacatggagaaaccccgtctctactaaaaattagccaggcgtggtggcgcatgcctgtaatcccagcta

SEQ ID NO: 122189 - DNA, 1050 bp, Homo sapiens
attcatagtgtctcttactcgaactccacaataggtataaagatcttatttagagagccataaaaatcctgcaatgcctcgtccagttcacttctctttttttctctctggactgcctgtgttgcagctaagctaccctctgtacagaatctgccctcagccatccttcacccatgctgggcctcaactccccctggacaggatggtttacctaacttactgccgttgtttgtacagcctgactttgaaaccaaaagttggctaaggagaagaatgtcatgtcctccacctgtcctcaagctgatcagtgcatcacccttcatccactacactaagtgtagaggtaataggttctcttgattttgaacccaagcctcactttaaaatgttatacttagccactccatctccccccacccccaccaatataacaattgaaacttctgcagactcagtaaaaggtttttgaattgtatacactataggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggtaaattgcttttaactatacttaattgttatatctccagagaagtttaattgtttgtagcagtctccatttggcaagtgaagctttaaacataaaccatagccttatttaaagaacttgccatgaggataataaaaatgagggtaatggctatgtgatgcttcataatgtccaactgtattaatttctgccataaatttgttttctgaagaagtatctttgccaaaaactagtagttactgtaataacatgtattcatgtatctttatattttaaactatctcctttatcactcttttggctttttaatgcaggacagtcacttggggatttagatggaattcctattgcagtaaaagacaatttcagcacttctggcattgagacaacatgtgcatcaaatat

SEQ ID NO: 122190 - DNA, 1029 bp, Homo sapiens
cttcattgcatttcatttttaaataatttgagtgtgtgctcactgattatacaaatatttagggactaacatacaatggctttagttgagtgctgctgaactaaactgttggtaatgtttatccttcagcaagatcaatcttttgaaaaaaaagaaaaaatgctaatatgtattaataagatattttaaatagtgttttcaggaatctgcaattaaaaatgtacatcagtaagtaaagttttttcaagcttgttaggtgctgattctgtttatctatcatactttgtatttggtaagaatccattgatcatattttcagttccatttgtaaagcatttcttaactacccaaagaaaagaaagtaaatatggctgttgctgtgtttatcagtctcaatttaatcaaaatgaatgtgtttctttagtaatagttttgtattttatctccccttaattatccattaaaactaagttctttcacacacattgcaatccataaatcatttatatttttttagagctatggagatgtgagttctacagattttttttcagttttcctaaaatcttattaacaagtaaaaccatttcattttatctctgtgaaattttatagcattgcattaatattaatgtgagttctgacaagttaggactgcaggattaggtgctttttttctgtcctcatcatcccacttagtgttcatctttctgaatgtgctttttagtagatggcattttgacacataattcctatggaaatgtaagttttacttttacatagccgtcagtgaatgctaataagaaaatgtatcttttaaaattgtgaaagcaacagtctgattttgtagcttaacttgacactgtaagaaaggaaatctaatttgcattttctgtagggcacaagtgccatgttattgttaggagcattgttcagtccaaagcttcactttaaatataagcaacagaagtacagaccaaaaataacttcagattgaatgtatctcaaactgtaaagtgttctgctttt

SEQ ID NO: 122191 - DNA, 1556 bp, Homo sapiens
aatgcatttttaaaaagacttgaacttaatatgccaaaatgttaacagtgttttcctctgggtattggaatattgagtacctaaagttttctgtactttatgaattctctgagatgaacatgtgttacttttgtgtaatcagaggaaaatacagtttaaaaatatacaattgaaagggtagattccaaatataattagagatatatcattcttctaaagataattccatttaaattccagggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtatttatataattctatatcatttgcaacagcttctctataaaacaatatatctgtcattcataagtattgctccttacaggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatct

SEQ ID NO: 122192 - DNA, 1050 bp, Homo sapiens
cgtttgatgaagcaatctcctcctcatctaagaagatttcaagaataccaaaaaaatacatacacaaagtaattctctggggcattgtataaaatagctaaatattgaaaacaatctaaatacccaaccacagaagactggtttactcaattatggtaaaaccaagtaatggagtactatacagcaataagaaatgaatgaagaaggtttctgtgaactgatacagaatgatttccaagatatattgttaagtaaacaaaacatagtacaaaagcattatatagcataatatttttggttgttttttaaaccttatcctgtattgtacttattagcactggaaagtggaagaggtctctgctaattagggtggagaattaatcacctactgggtttccttcttttcccaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagt

SEQ ID NO: 122193 - DNA, 1371 bp, Homo sapiens
tgggtttttttgttttttgttttttgctttttttgagacggagtcttgctctgttgcccaggctggagtgccatggcacgatctcggctcactgcaagctccgcctcccgggttcacgccattctcctgcctcagcctcccgagtagttgggaatacaggcgcccaccaccacgcctggctaatttttttgtatttttttagtagagacgggatttcactgtgttagccaggatggtctcgatctcctgacctcgtgatccacccacctccgctcccaaagtgctgggattacaggcgtgagccaccgcgcctggcgaagatttctttagtattctgattccctctctgctagattaattatataagaatagtggccttcattgttcatttattcccttaggaatgattgcatgcatattgtatacaatgtaagaattgtgatatgaataaatgcagcaaaacttcttgtgtaatttgtacctttatgacctaatgtaatggcatagtttaattttttaatccctgaagcttaagagattcataaaaagggccgggtgtggtggctcacgcctgtagtcccagcactttgggaggccaaggcaggtgtatcacgaggtcaggtgatcgatagcatcctggctaacatagtgaaaccctgtctctactaaaaatacaaaaaattggccgggcgtggtggcaggcgcctgtggttccagctacttgggaggctgaggcaggagaatgatgtgaacccaggaggcagagcttgcagtgagctgagatcgcaccactgcactccagcctgggcaacaaagtgggactccgtctcaaaaaaaaaaaaaaaaaaggttcataaaaatgagccagcccacaggccccacccttggcattctgatcagggtgccattagagaatgttctctaaactctggcaaacaaataagggggcctctcctctcccagagtagtaactcctgctgttgttattaagccaagctccacatgtcagtcacctggaatcagatatcaaaaaaaggtgtactgatttttagctgcttcctcccccggtctggttgccctagtgcgttaagttcagagagatcagcagctgtcagattggaatctccccagcctcagtacaaactggcagagggtttcttaatggccttgccatacatgtggtgcctggtttttctctcagtgtacagagcaggtgtctgaggggaaggaagtgcccactcactttggctgttgtgaatcaccagagctgcagcctggccatgtagtctctgcactgggagtcaggtggagtaccccaggcccctgtccagaatggagcttgacatctatgctaaaacctttcttaaggct

SEQ ID NO: 122194 - DNA, 1010 bp, Homo sapiens
ggaggcggagcttgcagtgagccgagatcgtgccactgcactccagcctgggcgacagagcgagacttcgtctcaaaaaaaaaaaaaaaattctgttagaaaatatttttttgtaaaagtaagttacgtatatatatacatctggaattaaaatactgctgttactagcatttatctttaattgaagcattatgggttatgttaatttcatagtttttattttctgaatttttttaccatgagtatgtatcactttcataatggaaaaaacaatactgataataaaagttaacaaaacacaataaaaagttatgacagagacccttaaaaagtgtggaagacacaagacacgaggtattggaagacataatctaactcagtgttcagggaacaaaggttccagagaagttagacatactttggagattgttttcatttcatctttcatatttcaaaatacccctggggttggaggatccgaactacatccggttgccctaggacatgggaaattgaggctgtcggctgtcagccgtgcatttgggtgagcactgaggcttcctgcagtccttgctaactgggatcatgcaggttcttgtagctctgtgggcagaaggagggaaaactcccccaagctgtctcagcccccaagtcccagggccctggtgatgcccctgacttgaaccggcaggctgggactgtggctggctgtcagcagctattgctcagtgagctacatgcagtcataagcccttctcatctctgaatagctttttcctgctgtagcctgccctccttctaagctgcagtattccaaaaacaagatgtattcttggagtaaagaatgattactccctgaacaccctgtctctgtgctggggcctcatttacaaaccccactagactatttttcctcacacccctcccacccgcccccgttttgtgatgttgttaactacagcctaattgctgctgcttcattctgccttgggtgttctgttgtctcagct

SEQ ID NO: 122195 - DNA, 1114 bp, Homo sapiens
aacctctacttcccgggtccaagcgattctcctgccacagccttccgagtatttgggatcacaggcacccaccaccacacacagctaatttttttatttttagtagagacgggatttcaccatgttggccaggctggtctcgaactcctgacctcaggtgatccaccgagcttggcctcccaaagtgctgggattacaggcgtgagccaccgcacctgacctttcaccctccctttcacgctgaggcactgggataggtgacagtgactaaggtcagggcctttactcacctgcccctcctctgggtcatgatcatgtggtgaaaactcagagcagtaatgtttgcattggcctggatttcccgaagtgtaaccaagcctctgttttcttttaattttcaggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtggaatctgccgagccattttgtggaaattgggatccatatctggagacacttcccaaggcctgcctcacctccaccccctgcccaccttgatccatgctcctttgacctcctcgtgtgagaacccctttgccagagtgagacgtgtgcagaatgaactaagccccagagggttttaatggcttgcctgctgtttcccacataaactacctcaggagtcactgtaaaataaactggccttgttgtcttagtgtttttatttaaaatgttccctgtccagcggggccagcttcccaggttcaggtttctttagacaaaaccaagcaaagtcaagggtaccttcagatgttaggggataacctctgggagagccctttctccccctgcccttctgaattaccagcggggggccttagtgcccttcaatttgtct

SEQ ID NO: 122196 - DNA, 1627 bp, Homo sapiens
tgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgt

SEQ ID NO: 122197 - DNA, 1872 bp, Homo sapiens
ggtgagcacatttaaaataggattttgtgcagaaagagatcattagaaattcatatactgtgcaacaagagtacatgttctagagggagacctgccctaattaatacccaggatagaaaaataagtacagggtctctactaaaaatacaaaaaaaattagctgaccatggtggtgtgtgcctgtggtcccaactacttgggaggctgtggtgggaggataacttgagcctggggagggtggggagtgatggcgaaggttgcagtgagccaagatcacatcactgcactccagcctgggcaacagagtgagatcctgtctcaaaaaaaaatttgatgatgatgatgaaaataataatgttgaaaatgaaagtggtataagcatcattcatgcgactgtgattccaggagggagatgccagcccaactgaccactgtttcacatggcctctctgcttccccaagccatgctgctttctgagtgttccagcgtgctgactctcagggcacttttgagccactcattcattgaactaaattcagtgaccactcttggatttggggttgcgatgaagacgtctagcacttggagcatctccagggtgtcccactccctgggatgtcactgggcatggacacctggagtctccctaaatagtctatttacccctcacttgtaacccaacatcagcttctttttgttcagtcagattctccagctgagagatttgggcattctctctgggttctacgggtgctggtggctgaatgaaacgccctgatcaagatccgggctagacgctggcattgcagagcctgagctgtacagcagagttcccatatggttggaagacgagcctcagagaattgggaatgtgtcagccagtcctacccagtgccaagtagcacagatttaaagatttcttgatactcctagacagctgagccgagattttatcatcagccacaaacgcagccagcccattgccgccttggcagcatttgtggaattaattggagcactgagctgacaggacaccagtgtgggagtatctaagaagtttctcttcagtgcttgtgttgtgttctgtgttgaattgtgtacccaaggtttctgggagtgaatattgccctctactgggacactaacatttttaattcaagcaatctagccaaaaatgtttctgttgacggcagtgtttctaacatgcttggtggaaatggaaatatttgtattaatgaggctgaatattgagagttatggggggtttcccagtttcaatgtactcttgcctcccacctgctgtaggaatgtgagggagtcaaaccttgtgtgtgttgttggtattcaaataattcaccagaaacttttccctgtactcatttctcccctgggcaagtctccctctagaacatgtactcttgttgcatgctatatacgtttctgatgatctctttcttaggaaattctattttaaatgtgctaatggaaccttattttaaagcaaagtctccttttctaaaatcactcctaatatagttatgatttgtaattgttagtactccaaacccaaatttctctctattggtaaaccttatagtaatcttatagtccatgggacctctaaaattattttagtgtaatagaactaaatggtgaataaattgccaaaaattttactttacattctacaggaattagcaagtaaggcactttgtatttgttagggcaatggttttccacagtgacccacagttataaatcaccttatagagcaatacaacttacctgtatgaatttgtaaataagtatttagacatacacatagtaatgaaacaaaactcttaacttgatttactttgtgcagtacactt

SEQ ID NO: 122198 - DNA, 1040 bp, Homo sapiens
gcaggggcattcaggtgacctgcagtgtgtttccttgagaggcctcctaccaggctgggaatccggtcttgaatttctgcctggcattgtccagcccttctagccactcagagacacccagctcagatgatggcgatccaaagtgaggtgtagttccttgaaatacagtggaaggagttgctaaaatttgactctggtaaaatagttctcggacccttgaagttgacttattatttgttttctgtcaatatcaccctgtgtgtaatgttttttcaggtaggagatggcttggtgagtaggaattattttcagtttcaaatctcattttggttttcattcctctgaaaattagcaatacagggatgaaaagaattgtgcctgtcttgcactattgtgcactgttcttgaactaaaaatagtgcttcacatcataagcactgtatgtgttgccattattagtaacctttgcagtgatgattgtgctcatggatcacccagacacactctccctcttgctgccatccccaccccattcacctgtctaaaacaggtactgtatgtcaaacacacaccattctgtggctactccttgaatggttcactgaacattttagatggcttcatgcttacagagtttctttctttttttttgagacagagtctcactctgtcacccaggctggggtatagtggtgtgatcttggctcactgcaacctctgcctcccgggttcaagcagttctcctgcctcagtctcccaagtagctgggactataggcgtgtgccaccatgcccagctaatttttgtatttttagtacagatggggtttcaccatgttggccaggctggtgttgaacttctgaccccaggtgattcgcccaccccagcctcccaaagtgctgggattacaggcacgagccaccattcccggccagaaatttcttaagagatacttcttggtcctgctctccactcatcctcaaccaaaatgagaactctgtgtttgtagtcagcttaatcagttgtggggatcacaactc

SEQ ID NO: 122199 - DNA, 1055 bp, Homo sapiens
ggcgcgatctcggctcctcacaacctccgcctcccggattcaagcgattctcctgcctcagcctcctgagtagctgggattacaggcacgcgccaccatgcccagctaattttgtatttttagtagagatggggtttctgcatgttggtcaggctggtctccaactcccatcctcaggtgatccgcccgccttggcctcccaaagtcctgggattacaggcgtgtgccaccgtgcctggcctcttttttctttttcttttttcctaggcttagctcagctgtctgagggacatagaacagacatcccttggggagaaagttgattttggggaacgtgtggatgtgttgactgtcccataatttgaggtttatggtgggaggcatgagaacattttgaaaatgagagaatgtcagaatgagaagttctccagagtccaggaggcaaagggaatgctcacagcagcctttaggaggtgggtgctgtggtggttgggtagttgtggcagcgcctacgtagcctatagtcaggtaggcgagaggaatgtctgtggcatgctaggcatctgggtgctgggtgtccacccaggaggagcagagcttgtgaccctcatctgggcaggtgaccaggaaatggaggtagcagtgtgctccccatcccctttctgcccagctgtgacattgttggtgtgctgtccctgcgccagctggggatgcagggagtggcctacacatctctcttgtagaagcttttctgtattgtggggtggagtctgtttctacgcacggagcagactgactttccagagtgctaatggaggcagaaggagatgtggtttcctggtgctgttggacagagggactcaaatttggaaacaggcccatggttcatcagaagaagcttaacaaaagaatgaagactctattatttcctccctggctggctgagggaaggcacagaaagactcgatttgaagccaggttctgccactcagtgatgtgacactggaggagttacctgtcctgggtttctctatttgttgaaattggaactaaaa

SEQ ID NO: 122200 - DNA, 1033 bp, Homo sapiens
gcactccagtctgggcgacagagcgagactccgtctcaaaaaaaaaaaaaaaaaagccctctttgaaaactgggctgggttaagggtcaggtgtggtggcttgcatctgaaatcccagcactttgggaggctgaggccggagggttgctggaagcccggagtttgagaccattttgggcaacacctggagaccctgtctctacaaaaaataaaaaattagctgggtgtggtggcgtgcacctatagtcctagctactcacaggctgagatgggagaatcatctgagcccaggagttcaaggctacagtgagctctgatcatactgctgcactctgcctgggtaacagagcaagacccccatctctggggaaaaaaaaaatgaaaaaactggattaaaagccagggtttcatgcagttccatctgactccaaagtttagtaaagaattccattttttggagggtcacctgcactaattcctgccttggtcacagactggcccatctggcttgttgacttgctcatgcacctgcacccagctcacagcttagcaggaagagggaaagaaagctgggaggtcatggcccattcctcagtcccagcttccttggaaggctggaatgaagctctcatgccgggagtctcctgaagtccttcctactccctggtctcagctgcatcccttgggcagcacaaatcaccccacccccgccccgttccctatctgcacaagaagcagtgctggtggggactgtgtgggttgacatatgtaacacttagaacatgaagcctgtgccacatgaatactaactactgtccccctcttctaggtttaatttttagaagtcaatgtcacctgtagcagagaagttccttgaaatcaaatcagacatatggcaattgtgaaaagattgaagtaaggtttaggtcttggttaaatttttaaaatccttgagtttgttttgttaatgactgagcatattctctccactttaccttttgtgtgtggcaggggccacacagccaccatccct

SEQ ID NO: 122201 - DNA, 1216 bp, Homo sapiens
attctcctgcctcagcctcccaagtaactgggattataggcgcgcgccaccatgcccggctagttttgtatttttagtagagaggggatttctgcatgttggtcaggctggtctcgaactcccgacctcaggtcattcgccagcttcggcctcccaaagtgctgggattacagacgtgtaccaccacgcccagcgtttttttttgttgttgttgataccagagatgccatcttcttgctgaagaactaatataatgggaaagttttatgtgattccgcctaccttctccatgcccagcaagacgataggctggttaggaactggcagatgagacagtcagcatcccaacaatctattaacaggtgccatattgacacattttctttacatcctctccctgtgggttctttcttggctcctaagcacccctgtgtgagcagaagcatagcagaatgtccaataattacaaagagaaaaattggagtgagccctgacacaggtttgattaggtgaaaatgtaatatcctatattaatgtctcacctgctactttttagcgctgcctagaaagtccctggaaacaatgagaaggaaaacagcatgtttatatgaattgtattgacaccatgatgaaaagtttaaagacctcaaattgtataatgtagaagcatagagtatgaaggtcgctagccaaccagcaaaaatgatttggtgtttgtatatgggaggctgggatgtagtgtttttttcctggtgcttaatttttttttttttttttttttttttgaaacggagtctcactctggtgcccaggctggagtgcagtggcgcgatctcggcccactgcaacatccatctcctgggttcaagtgattctcctgcctcagcctcccaagtaactgggattacaggtgcgtggcaccacacccatctaatttttgtatttttagtagagatggggtttcaccttattggccaggttggtcttgaactcctgacctcaagtgatccaccggcctcagcctcccaaagtgttaggattacaggtgtaagccatcgcgcctggcctggtgcttaattttggtgttaagtgataggttttggttgctaacctaattgtattgttcccatcattggctaaggtaagcttggggaattaattgtagaattactctttggaatgggaaacctattctgtatctttttaggggtgttta

SEQ ID NO: 122202 - DNA, 1047 bp, Homo sapiens
cggcggggctttggcggggcactgctcggcgtgtggaagggggtgtcggagcgggagcagggggcggggactggagggagatgccgggcggcgagcgggaggccgggggagcagccgctcggaggaacgaagcctccggaggctgcaaatggagcgaggccggcccgcggcggcggcggccgggagcggagagggatgggccccgccgccagggggcgcagcgctcccttcccggccgttccacggcggttcgcggttcccgctgcccaggagctggaggcgggcccggcgccttgggtgtgcacccgggctggcgcgaggcctggccggccggccgcaaagctgaagcctggggcgctcgccgctcctcgtgagcgctcctttccttctctatgataaacgtgatttcccacgcatgctttgcccttgcctcatccgtgagctgtgcaccaccgatttggaggcccttgtgtgcttgtttacctacgtctccctatgtagctattttaaacaaggtgtttttacagagataaaagttttattgattgctcaggtggtctttctggaagaattctgcacgtaaacgctaactcgacaagagtgccgggaggaacaaggttactcactagagttggaaatgtgcagttcatctccttaaagtaacttttgaatggttgaatacaaatagtaaacatgccacagggcagcgtggcatagtgccagaaagctacggttgcaggaaactgaggtaaggaactgagtccttcaggtagccaggtatataaacggctgggatggaggactttctcttgttacccgctccccacttccacccttgcagtccgtttttctctcttttttttttaaaccattcatccctagatattggctttatactaccatacaagagcctgtcaagctttcctcggtactgggacttgggcaagattttttatctccctcacagtttcacatccccagcctctaacccggtgtctcataacttagtaggcgttcagtgcgtatttcctaaatgaatggagagag

SEQ ID NO: 122203 - DNA, 1051 bp, Homo sapiens
gcatatgttggctccttgctgcccagtcgcggcgagggtttgaattaacgtatagtttgggtttaccgtaccctccttcagaccactccaattgggaatttagtaattatgcaagttcccccccttcgggcttgaaatcaaaaggcacagggttaagtttgaggaactacgtggaacattctcgagctgtatttggattactggtttagtgaagtcagtactaattgctatgcaaaattaagcaagcagcctgaagaaccaagccctgcatccagggggtgcttttatagaagaatctatacgtgctcagtgtcattgaaaacaggatgatgaaaagaatggggccgagatagcagcccttcaaattcaaaagacttaggtcgccctatctacatttaaaatagggcggagggaggaagggaggaggactgcttgggggagaatggttaatttatacattcgcagaagactgaggggaggcacttcgatttctgcagagaacttgacttttacacttgcacattaaataacacgtacgacacagtacatcgcttgacttagttaacagatacaccagttttattctcaccttcaatttaatgtgacagttataattagaatttttaaagtagaagttgcatttcattagttcagttttctaggatttcccagtagaagagttaggaatagttaagtagcacttaagcacattttgcatttaaatcactttgctgtggtgctttaagaatgtaaaacgaccttgttaaatttttggaaagaggactagatgaaacgtgtgtagtgaggggatatatatttaaccaatctttcacagtgacaactcaggtttttaaggagaaattaaataataagacaatagagatagaaattaacatttctctgttcatattgcttgaaacaaaagatttctgtcaaatacaataattgaactgatatagctgacttttcaaaacaactttcaggaaactcaaacggaccttgaatattattgtaaaagtatgtatcttatatttgcataaatggatctatc

SEQ ID NO: 122204 - DNA, 1039 bp, Homo sapiens
ctgtgttaaggcagtttctccttctttgcatatacaaacatgtgaccctgctctagtatattaggcattgcccctgaacagcttaaaactgggcttcttggaagccatgtgggggtataagactgtagagggcaatggtcagttactggttatgtttctgtccctatccctcttcctggcatcttcccaattccgagttaccactgtattactgagtccgagataagcagtctgagagaccagcatttgcggccagcagcagagctccagttcttggatcagggtcttcttggtttgtggctgccagtggtcacatttgtcttcgatgaaatagtcaagcaccaggctgattgccaggtttcagaagatgtgtggctcagactggaagaaggcctcaatctgttcaccacctgtctctctggccttacctgttacttctccctctaactacagtgctctctgtttttcactcagaagggctatttataggtttccaaatatggcctgcagtttcctgcctcagctgctgcccgcaattttccctgcccagagtgcccttcgcccagccttcatgggtcagaatcctgctcagcccctcctccatggaatcttcctgatctctttgagctccttgctcccccgcactctgggcctctcctttctgctttacatcacagtttccggggctcacgattgattcctcggttagatgatagttctatgaggacagggaccttgcttatccatttcttagtccccaaaggactcaaggctttcaatcagaggtgctcaattctttgtttgtttatttgtttgtttgagactgagtttcactctgtcaccaggctggagttcagggatgcgatctcggctcactgcaacttctgcctcccaggttcaaacaattctcctgcctcagcctcctgagtagctgggactacaggagcacgccaccatgcccggctaatttttgtattttcagtagagacagggtttcaccatgttggccagcatggtctcgatctcttgacctcgtgat

SEQ ID NO: 122205 - DNA, 1028 bp, Homo sapiens
acatatggtgttaaaaaaaaagttattaactaagatattagtgaagccttcctcacataagaatatcaggctgctggccaggtgcggtggctcacacctgtaatcccagcactttgggcagcctaggcaggtggatcacttgaggtcaggagttcgagaccagcctggccaacatggcaaaacgctgtctctactaaaaaatacaaaaattagatgggtgtggtggcgcatgcctgtagtcccagctatgtgggaggctgaggcaggagaattgcttaaacccaggaggcggaggttgcagtgagccgagatcgcaccactgcactccatcctgggcgacagagcgagactccatctctttaaaaaaaaaaaaaaaaaagggaagaatatcaggctgctgaattcaaaatgccagagatgtaaatgccctccgccttcttactgccatcccccagcatggcacatttcaagatattaagggatgggagtcaggaggagctgtaattaagctgattggaacctattgtgctgctctggagcacagacaccaagcagccttagggaatgagtgcctcaagatcactgggaaatgatgtcctcttttccagaaaataacgtagcagaaatactcaatctatactatttctccctttctttgttttccatctcccctccccaatttaattgtggtgcttactgtgtacctttaaaactgacttttatcatgcatttgtttcttaacagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcaca

SEQ ID NO: 122206 - DNA, 1052 bp, Homo sapiens
caagccaccaatgcgcagctaatttttgtattttttgtagagatggggttttaccacattgctcaggctggtctcgaactcctgaactcaaagcgatctgcccgcctcagcctcccagagtgctgggattccaggcatgagctacctcacccagcctttatttgatgttaatatattggaggcactatgctagtgccaagacaaccatcatgaacacgactgccagggtttgccatcacaagctcccttgactccagcttccctatctaaagtagccactccacctttgctctgtttttttctccttaacatttatcataacataaaattatcagtttgtatttaagtgcatgtttatttcttcttccactagcatgtaaaagatctaacggcaggtgcttcggtggccttgctcatggttgcatcaccctccctagcacaggcttacataggagtgcttgacaaacatgtgtgcatgagtattacattcgtgttatgttaggagacgtacaggaggttaggagaggtctgggatcgaggaccgtagactcaaattagtcattttaagaggtttttttttttttttgagatggagtttcactcttgttgcccaggctggagtgcaatggcacaatctcggctcactgcaacctctgcctcctgggttcaagcaatctcctacctcagcctcctgagtagctgggattataggcatgcgccaccacacccagctaatttttgtatttttagtagagatggggtttctccatgttggtcaggctggtctcaaactcccgacctcaggtgatctgcccacctcggcctcccaaagtgttggaattacaggcgtgagccaccacaccgggccttaagagtatattgactgtgtaatacattccatcccaaagttgcctaaggttgtcttttcaagtgcccagtaatagtatttctcatgccagtaaatagaaacccacccctccttgaatatgtagtgctattctgatatttaaagacataactcgatttaggtagttaatccagacctgtcagcc

SEQ ID NO: 122207 - DNA, 1252 bp, Homo sapiens
tccggcacattcggagcttgctgggttggcatatacggggctgtgtgatctctcccctaaagagaccctccagcttcatctcccatggtcctgcagcagcaccaagtttcataaagcatactgcttctgttctctgcgccttcactcatgctgtcccctctgcttagaatgtcctgccgtctttatctggctccctctgctcatcctatgaagcttaatttgggattgtctcctatagcaaatcctctgtggtttcccaggctggattaggtgctttcctcagttcctcaatacactgtgcatttctcagtcactgctcttactctgttatattataatgatccatttatgagactgatcctagactgtgagctcttggagggcagagacagtttcttttttctcttagtatatctggtacccaacacagtacttgacacttagtaagtgacgagtgaatgagcaagtaagcgagtgaacagaggccatgagtaagaaaatagaaaacacacgcagtaagttggggagaagcaacctgctgcaggagaaaatcgggggatagggcattggttctcaaggcagagaggaaaggaaagcgtttgacacagtttgaggatatcagcagggttaagaagattgcttaggaaggttgtagtaaactagtttgaagataaagactgggatttttactgtggtagtgacagaaagctaacatatgaataaaaagataagggaaaagagtgacaattgaacattgatgcttattttggttatttttgttttttttttttagagatagggtctcactctgtcactcaggctggagtgcagtgtcacaatcatagcttactgcagcctcccactcctgggctcaaatgatcctcttgcctcagactcccaggtaactaggactacagatatgtgtcaccacacccggctatttttttttatttgtttctttctttctttatttatttaattttaaggaacgaggtctcgctgttacccagactggtgatgctttttttatgactcaaagaatgcctctggggtttcttatcacagaagcacttgacaatggaagagatttccactggaaaatggcaaagagaaaaatatggtgcacaaataagagcacccctggaccaagcaatggctctgccaccaactcaatgcaaaatctggtaacagtcactgtgttagtcttttcttgccgtgcaataaaaaatacctggctggggccgggcacagt

SEQ ID NO: 122208 - DNA, 1051 bp, Homo sapiens
atcagcctattttgggcccctgtgagaaagttattttaataatatcttgctctggctggccgcagtgactcatgcctgtaatcccaacgctttgggaggctgaggtgggcggatcacctgaggacaggagtttgagactacctggctaacacgacaaaaccccgttatactaaaaatacaaaaattatccaggcatggtggtgggcacctataatcccagctactagggaggctgaggtaggagaatcgcctgaacctgagaggtggaggttgcagtgagccgaaatcacgctattccactccagcctggggaacagagtgagactccatctcaataataataataataatatcttgctctgctagaaatacacatgataagtggcaggtgtcagaacaaaaagggaaaagttgcagtccattctcctcgagacttatggagtttacatagttgttctctttcagcctttgaagtaaaccctgatgcacatagaagcacaaattaaaaaagacattagacataggccagaccaatgatcctcaaacaaatcagaatcacaggggtaggctatggagaatctgcatttttcgcaagctacccaggtgattccaatacatccagcccagcatttgtgagagcccagcatctgggaacttctggtctggtctggtgttctacagatcaagaaatgaaggcctatacaaaaatgtaaaaattattcaagttattaaccaatgaaggactagaaaccatattttctggctcccaacatatccatcttcccaggtcacaatgcctcttgaagtgttcacaattaagatcttaggccttttgctgtaatcagtagacaaggcctttaatccctgaaattttgaggtgtatgtcttgaaatctctctggagatctgttaacttccattctaaggtcttttcctttagacgcactgcttttaaggttgaagcacttaattacactaattcttctctgtcctagccttttgttggttaattttcatgaaatcattgaatttgttttctacagatggaagct

SEQ ID NO: 122209 - DNA, 1051 bp, Homo sapiens
aaaattaagccattaatagaaataggaaagttaagtggaaagactggtttaacttaggttcttgacatggtgagtttgaagtactccatcaaggttgatggccgttgccttgggaacttgctgctggaggaagcaactaaattctactattagcctgatttccttaatcatggcctttctgagacctgagtcgattttttttcctggtcacactgtgcaatttaaaatttcatgtttcttccagattccaagagagcagcatagcaagaaaaacaggttacaaagaaataacaagacctctgagcagagagagatttgttatgtagataatacaagtagtatctcctcgccttactctagtatatctagtatctccttgcctctctcctttctaaaattggacaccatagccttctacatctgctgttgcttctttttctccagtgaaccaaaggaacagaatatgagaaaattaattccttagacatccacgcttgcctctaaaagtcgattagctttcccagttgaaagagatggtaaaatcaggtacccaagcaaagcagtccaggtgtgaatggtgttaacttccttgcacatgccttctgcgctctcttattcatagagaatgaccaagatagcagagaaaaggcctgccctgttcctttatattctgctatctttccagctctgtaactagaaagccgagcaacacaaggcctgcttctaccaaaccaatactcagtgggctgctctaacttccgggctagcagatgtagtagatttctgatttgtgacccttctttctgttatccccatacactacacactgttttgttttgttttgttttgttttgtttgttttttttttgcagagatggccagcctgaactgtattttaaatagcattatagggctgggtgcagtggctcatgcctgtaatcccagcactttgggaggccaaggcgggaggattgcttgaggccaggagttcaagaccagctaggcaacatagcaagatcccatctctactaaaaacttttaaaagtagcca

SEQ ID NO: 122210 - DNA, 1035 bp, Homo sapiens
aaaaagcttagagcctaagtgagtatctgcgttctgaaagatttccctcctcccaacccttattgattctcaaaatgctggctgccaacttaaaattcctcatattcaccaagtagaaaactggaggatttctttctgaagaaactgtcaaactcaggagaaaaagccttgcagatgtggatatttggggcctcctcagtaaacatggcatatccctgagcagtcctcctacagcaagacccaccacttgacaagcctcagaggatctaagtgcccagaatatctgctgccttactctgaagcagaataggaaaagaggaccactgggcatttgagaaaagctgcttccacgaaacagcaagtcaaaaacaaactgataaaaagggaacttagcggaaatagagacaatgcaatcaaaggcagatgtttttcaaagcactataatcaatatacttgacaaggaaggatattaaatccatggtataataatagatgatccattaaaaaggacaattcaagaataaaaattagaattataaaatataaaaatatgattgcagaattttttaatcagaagaatggaagatacaaatgaaaaaatctcccagaaaagtggacaaaaaagatgattttttaaaaaaagaaaaaaaataagaaaactaaggactctttcaggaaaccttgtatctattaagagtcacaggccaggctgggcacagtggctcacacctgtaatcccaacactttgggaggccaaggcaagtggatcgcctgaggtcaggagttcgagaccagcctggccaacatggtgaaacgctgtctctgctaaaaatacaaaaattagctgggcgtggtggtgcacacctataaggcagaggctgcagtgagcgagattgcgccattgcactctagcctgagcgacaagagctaaactccgtccccaaaaaaaaaaaaaaaagtcacaggccaggtgtggtggctcatgtctgtaatcccagtaatctgagcacttgggaggccaagggggtggatcac

SEQ ID NO: 122211 - DNA, 1033 bp, Homo sapiens
tagagacggggtttcaccgtgttagccaggatggtctcaatctcctgacctcgtgatccacctgcctcggcctcccgaagtgttgggattacaggcgtgagccaccgcgcccgtcctgatataggtatatctaaatctcatttactctgactaacatgcattcatttcacaattctgtatatctggtatctgaaggtactgatttggatgtggttatcatactagtttcttggcattttacaatttatactaacttttcctttataatagagcatgctctcttagtatatacacggcaagctgatggaaatgagggattttgtttcattagtaaccaaactcataaaaggtaataatgtttagggaataaaatttctgattaacttaggaacagttaatttgtggtccaattaacttatggtagtagatttcaggggactataaattaatcgtttcttggttttctgaattttctattttttttccagtgatcgtgtattacttgaataatttaaaatgtagaaatgatgaataataaagtcttaatcacagtaagaaatatgtaataaacaaaactgaatctttgattttagagatctttcaattattctgaaatagaattatctatacattctatatatagatatctgtatctatatagttatatctatatattgatatatatacattctatccctggactgtgagcttcttgaggacaggctgtttattaatcttcatatctatattgctttgcagaaagcctgaaccataatagaaccttaataaatgggttttttttgcatgaataaatgaggatgatatgcaaaccacagttaattgagagtcatacattttttaaaatgttaatttaaacatttgagaccaataaatgtaaaatattatgctcattagcttttttctttcttaacagctttattgaggtatattttatgtcataaaattcacccatttcaagcctacgattcaatgatttttagtaacttttatcaagtgatacagtcattaccaa

SEQ ID NO: 122212 - DNA, 1044 bp, Homo sapiens
tttggtttttggttttttttgagacggagtctctctctgtcatccaggctggagtgcagtggcacaatctcagctcactgcaacttttgcctcctggattcaagagattctcctgcctcagcctcccaagtagctgggattacaggtgtgtaccaccatgcccggctaatttttgtatttttagtagagatggggtttcaccatgttggccaggctggtctcgaacccctaacctcaagtgatcctcccacctcagcctcccaagtgctgggattacaggcgtgagccacagtgcctggcctgtttccagttttctttactaaattaaacaatattgtgataacatcttactgtatataactttgctcaatttcatactatttgcttaaaaaaaaaaatcctgaaagtgagattcttaaatcaagaagagtattttcagtatacctctgtgcagaaaaggattactgtcctgagaaaaacctgcttataaggttgatccttggctagcatcggagaagctggattttaggagtgttcctaccatcctccaaatgataagaatggctcgcagtgcctaaactgtttacagacaatatggtttatactgaatacctgctttccttataggagtctggaattttgctacatgctaggcagaaaatgcctacatgaccagccctaataaaaaccctcaccactaagtcagtctccagtaaatctccgtggtagacaatgtttcatacatgttatcacagctcattcttggaggaattaagcacactctgcgtgactccactgagaggggattcttagaagtttacacctggtttcttccagacttcaccctatggggctgtctctttttagtggttttgcattgtatcctttcactgtaaaaaagtcattacgatgaatttgactatatgctgagtaacatctgtcatcctaacaaatcatcaaacctgggggtgatttggagatcccgaacacactcattttctgattttttattgtttattttccacccactcctgatccttcctg

SEQ ID NO: 122213 - DNA, 1038 bp, Homo sapiens
aattaaaacaacctcttatcctctggctggattcacagtctgttcaatctgcagcagctcagtagacactgggatgcttctggctagcaggtagcagtgtcacaggcaggcaggctggaggagcagctcgtgctgaggcagctgagcccatcctttccccagaggaagggtccttccgtgtcacagaggagtggaccttgagcctaagaagatgactgttggggaggtgggatgggggtatcttttatatacaagatgcataatttactgcattattagattctttattataagaagtgggatgattgcacagttggattattttgattaattttataggtctagaattaagatttttttgactcatttagcaggacatctcaagaaaggttaggtttcatttccttaaaatgcagttatttcatttcggtaggatgttagatgtgaagtaattgcttcattgaccatcaccatcatttaacatggtagatactattataaggggctcctatcttagtgtttcattattctaacttctttagcttctgtattagcaagatttcactcacttcaaattagaaaaggtatgcacatatgcacatcttaagctttttgacattttcatttgaaaaaaggaagataaattttattagaagtgaaacatagggcatgagtaacttggataagaaatttaaaatttaaaagtataacccagggactctgggtggttcagagactggttagaatatgaagaattgcactttggacatctgccaacgtttggttcaagtaaccacagttcctagtaggcacatctggcctcacctaagcagcatattggtatgcagagacctcacaggatggatgaccacagtggacctttcaaagacatgcaagttcactactatggatggaggttaatatctgattgtaaaatgggtgactactggtctagttccacttgtaaaaagttacgttgtatagatagtatgatgaagatgacaacagctaagcaaataaccctgtagtaagtgattt

SEQ ID NO: 122214 - DNA, 1483 bp, Homo sapiens
cattggaaacagatctttgcccctttattcccaccttaccttcacatttcccagcctcagacacatttgatggcctaagtgaagcctgccaaggttccctctttggtccatcactgcctcttgttatttagctggagaggtctttgcagaatgacatttccctcctacagtgcttactgtgccccatttagcatgcagccttcacatttttcctaacccctgcttgctctctaaaggagagaaaacccaaacctcagcctcttgtgaagcaattcagaactcaatgcctggcagttggcgttggtcctgtcactaaactttaataatgattgagatcccccttattttgatccagtctccagtattcataggtaaaagcctgcttgtcttcttcatctgctatcacacatcttttcttctaccccttctaaaatcaaagtatgtatgcccactccagttcaccaaatatttttagctttctcatatgctgattttgctcagcagcattttctagtttactctctgggttgtcagtggactgtcatttctcccagtccagttgtgcctgaagcagttttcatagctaaatgacaaacccttgaagaaaggggtttgtaatgaaaatggaaactccagtgtgctctttgtaatcagttctttaatcctccacctgccagaccatggatacaattcgtaattatcagagcagagaactgaactcccgtaccgcggcagaaagcatgagcactatgggagggcaagtgatagaatctgctctccagtggggagggggacagatattttggaaaactttgacacagaatgtgatgtatttgtataaccttttcatgtaaaactgtgctgcagtcagagagggggtctgggttttcttcattaaaagcttattaaagaaagaaataggacagtcgttttgcttcggtagatgggggtcagagaggcaggtctgatctcctcaggatattaatgtctgccttcagccaggggaaatgagccgtcacttgagttagaggcagctttatgtgctcatcactagggattcccatatgtccagggagctgcaacagtgaaaaatggcagagctcagtggtagagtacggagggctttcattggaattcatgtcaggaagctcagctcagtctgcccagagcaagtctgtttaatgttgatcagctgtccatctgataaaccgaattgatacgggtattccctccaagggctgccctgacagtgacagccgccgcacccagatgtcttgttaggcttttttggtagtctcaagtatttttaaccccttttgtgacatgcaaaccccaaagtacttttagaaacctagataaggatgcctagctaggctttctctctgctcctctggcagataagagccccacataactgtttctagaaaccagagattattattagttagctgcccctcctcctcctcataagcatctggttgac

SEQ ID NO: 122215 - DNA, 1030 bp, Homo sapiens
tgaacttgggaggcggaggttgcagggagccgagatcgcaccactgcactccagcctgggtggcaggagcaagactccgtctcaaaaaaaaaaaaaaattcactcccacctccaaaaatactgtttacatgttttccagatacttctgggagtattttttctaggaaaggagggatattgtatatgtaccctaagagcacttttaatagaggattatgaaaaagcaattcatatttactgaggcataaacattaaatctgagactgactgagatttgggaagcctttctgggaaacactggtcttttaattgtcactacccccatgtcatccactggttaggatggggtgtattcctttgtctatgcccatgtgagaggcccctgctgcagtgcccatctgatgttctgttaattcccttcccagatctagaccattgtaattgtttactctctatgcagtgctttgtggatggtggcagtcaagcactgaggggaaaataatttttcttgggatttccacttctcttacaacaccattaaatgtttcattttcgtatttttctctagtttcaaatttgtgatgaggtataaacatagtgttgaataacctttttttaaaccaggcattcttcaataacaatgcaaaaagtatttatggaatgtttactaagtatgcagtactctattttgggtaaaggatgaattgagttcagtgttttatttttttattttgttttattttatttatttttttgagatggagttttactcttgttgcccaggctggagtgcaatggcacaatcttggctcactgcaacctccgcctcctggattcaagtgattctcctgcctcagcctcctgagtagctgggattacaggctcctgccaccacgcccagctaattttttatatttttagtagagacgaggtttcactatattggccaggctggtctcaaactcctgacctcaggtgatccacccacctcagcctcccaaagtgctgggattacgggcgtgagccacca

SEQ ID NO: 122216 - DNA, 1312 bp, Homo sapiens
attaagtatctattattttgcaatatttatttaaatctttgtaacttattccaagatctgccttcttgatcacatctttctggttataatagttatatctgcaaattctattttattaaatattgataaatgtgggtttgctataaaaatttaaaaatgggttatccttttaagaaaataagtatttagagtaattggtaaatttatttaaaaattatatataatgacagtattaaaatgtttaaaaataagttaatgtaaacaagacattttaaagtacaggttggtacttcattaactttaattttgtgacttttgtcagttgatgtcacaaccttagtgttattttaaaaatagtttttatagggctacttaattaagtaacatggtatttgcttatttcaaacagtctgcctttgttcctgtccaagccatgctggcagggcattgcttttcttttcccttttgttaatatgctgtgttagataatggttctgtaaataatagattccaaggacctttgatccaccgttactgtaaaataaaatgcaacttaattttttcagggcataatggttttaaccttgcgtactaatttgactgtgcttgtgggggcagatccttaaatgagacgcaaatgaaggaaaaattgctaatgctgccactgtatatctaatgagcactgtgtaataaaccataacctctttgacatttctctggaaagcagcatgattattttggatagctagccctttgtggatggctcattaccgtctggcataatatgtattgatagagactgtaattgtcaactcctatttgacatgctgcctctaataaatatggcttgcatcgctggagcccactgatggttatatgggaaactgtaattaaagaaaaaaatatatttttaggttaaataagtatatatgtatataaaatgtctctatagaagattatctgcttccttactgccaccacccccagcttcttgtcatagagtatttggagcttccctgaaggattggtgctgttttatcagtataagggccaacatgtgacaagatgtgtgtgtgtgtgtgtgaatcatctccattggcaaagaattgacaatatgaaaaagctcgttctacatatataacatccataatactatagtattattttattttcttttgtttttagagacaggatctctctctgtcacccaggctagagaacagtggagcaatcatagttcactgcaaccttggactcttagatcctcctaccccagcctccctagtagctgggactacaagtgctaccttca

SEQ ID NO: 122217 - DNA, 1025 bp, Homo sapiens
tatggtgggcactcaagtgctccatgtattattgttgatttattgagacaaaattttcttagggggttgaatgtggattttggtggggctctatataatttaaaaataaaaacgtttatgtttgcaggccattatctctattactgcatgtttcctttcacacatttattctttatatgttgtgaaacacagatatttatatattttctttgacacaagaacctttttttaaaatagacttgtgccctaagcagatattctgtctaatgggctttccctatagacaaagagtaaagtgtatttcatttgtcattagtcctgaaatgtcagtgctgcaaattttgttatttttggaaaccattacattcatactcattagagacaacatttcaaggaaatacttgaatgattatgcacctacaagattttctcttgtccatgagtaatttgtatcctgtaataatatggagcttctattactctattataattacttacatatttgttgcaaataatgatgtaatggatttttttgaggctgtacgtgagaaccaacaaactgcgacgcaaaacaagtttccaccccttttttccaaagctatagttaatcacttgaacactatccaatatagtagaaagctggcagacttttctttgcagcaggctatgtaaaaatgtttataatttacagcttattatgccatgcaaacgactgtgttcccaatgaaggcgagtgagaaaatatggctgttaaattacttaactcctctttgttacttgttttctggcaacagtggaaggatactttgcacttaaaatgcatttctgtatttaattttataccattcaactcagaactttaaaaaatagggatttgcttttttatctctctctatagatagaccagaccaatttaaatttaacaaaaacagtaagctgaaaaatcagaattgtcagggaatgaaaatgtaataatacaaaattattagggtttaattcaatttagggctttaactttgcaaaac

SEQ ID NO: 122218 - DNA, 1063 bp, Homo sapiens
atagtaaaaaattttaaaatcctttccttaaagaagggctgtatgttgactggtaagtagccaaagttaaaggcactgtccagtgactaattctacattttaaacagtgcttaattttgggcattcatcatgtgatagaagttgtgcaaatcacttaaaatattaattttattggcagagtcagcttagtagcttcatgacttaatggtgatcctttgaactcatacggaaggcatctcagtggtaaacagtgtgtcataataaaggcatagatgaagggccagagatctgggttcttgtctcaattctgcaattgattagctatttgaccttaagtaagttacttaatcactctttgaaattactcatctgtacagcaggggcaatgatgggcttcaaaccaggagcttaactaacagggtacacatctagataggttcaactatcctgtggtccagaataagtcaccctgaccacctcctgtctctgcaaggcacagcactggacactgaaagacactgaatatttcttatgaataagaaatagtctttgacctcaaatgagtaggtaaggaaacaatgtatgcatctagagtcttcctgacacttgctattgatgtaatttcctttctaaaactcttttgctggaacttaactactagagctatttccacagtcaccattgggttcacaatccacccatgtccactgataaaccctttgtttaactaaaggtaggtagtctttaacacccctcacataagatgataggtgagagctgacatctgtaggtggcttagtgcctaagaaatgtcttcctcactgtgctcttggactttccttctcactcctgaaagtgggtggtgttgataatagaggcaaagagggcagattctctgattggttatctctaatcctggcatcctccctctctatagttactggaatcttaagtctcccttttctgttgttaagatttccctcattccctcctcttctcaaggtttttgttttttgttttttgagacagggtctccctctgttgcccaggctggagtgcagtg

SEQ ID NO: 122219 - DNA, 1050 bp, Homo sapiens
catggtttttgtgagaattagagcatatgcatgtaaaacagcagatgcctggcattatagtatattatagttgttgttatattgttaccatttttattactcagtgtgttaagtgccaaactagaggtttatagtaagtccatgaaagcccatggaagaagcttacaactactggccctggtttctgtgcattgtactgttgtagttctctgcctccattgtgcgtgtgtatacatacttcattatccatgtctgtggaggccttttatttgtttgtagctagaacatatttcttcatgttggttactcatctcattcctttaagtgtaggaattctccaagattcccttcccttctcttcttttcttttctctctcacctaaaagctcatctgtcagttcctacagcttcagccatcgcttctatgaagatgcttcccaactctataggcacagcatttccagctgcctgcttggcatcaccatctggaagtccttcttgcattcaaagttaacatgtccaaaactgaactcattcattcctcattagttctcctccttctttccaatctctactaacggtagcattatcacctccagcaaacaggttggaatcttacattcctttgctttctgatccctccccaatgtctccttcatccctccagttggccacactagccttttccacctccatgctactgccatcattcagcttttcttccccatccctattgccactaccctcatttaggccctcattatctcccatctggactactagaagaggctcctcctaactgatcttccttctcctttccaccgtacacaacatagcacctgccagagtaacaggattaggctcagagtaacagttttagtctttagctctaattacatttctcccttgcagacaaaccacttatgcctccagatttcctgcagaattaagtccagactctaaacctgactttcaaggcccttcactctttaggttgtctgttttcctggacttgttttaccttcacacattgcccaaatgggtagcccc

SEQ ID NO: 122220 - DNA, 1019 bp, Homo sapiens
ttcagtgtgactaaatattactttttaaatggccctattttccattagtatttttaaatctttagttaccatttcagtggggaaatctttgttgttgtttttccagtggtatatttaattccagggtgactagccacatcttgctgcaaacatgattgatcacgacattttatacttctttttaatttcagttatatttcagtatacaactagtggtcagtaaccatttctgaaaagttcctggcttgatttagtccctgctcaacaacccctgcaccctacccccattctactttctcttctctcttccttcctttccttccaggcacctgtcttctgccacatgctcatcaaacctaattgaagctttgggagggctttggtgaggcagttcttggccctgctgtccctcgaggatttaatgcaggtgggatgtgtgtgtggccctcgagccatatcaatgactgccacagctcctgtattctaaaggctggtcacctcaggccctaaagttgtttcaagtctgggacagtttagtcttagaatagatatggcagtaataatacattttgggtcattttttccatggaaattaacctccagttcttctgctaattttatataaaaatctgtgacatgcagactatttttagtctctctaaaattacaattctttaaaaaaataattttcatggagtgtttttttcttttataactgagtaatattgctgtcatcaaattgctaattatatttatgtttttaacatcatttcattgataccatttaaactttggtcctgtgtctaaatctcagagaaattaaaagtgaagtagtaggacccaaaagggtccctataccatagggctctggagttcattaaatgtcacttaattttttttcttcaagttagaaacacaactataatatactaagtcatttgtcttcttagaattctgttgtttttaaaatacagtgtttttttctccagtcttaaaaagatatctgtgctcttgtgtgc

SEQ ID NO: 122221 - DNA, 1157 bp, Homo sapiens
agttgtcaggttagatgagatggcaccttagaaagcttgaggataccatggtaaatgaaacagttgcccctgcagcttcctggcaatttggtaaatgagagatttcttcctgctaggatagagcaaatactgttctctgaggcttaattggctagaataacctgtatgtaatttattccaagtacatatcttttcattcactaggtgccattctattcaataagtgccatgtaagtgtaacttttaaaaatcaaattatatttttctatggacataaataatttgagagatgcgactattatagtaatcctctttgctagctctgctggtggccattttaaatatctgtaaggtcttaatgttaattgggtggcacatttgtgattatgagagctaaggtttgaacttaggcagccagtcatggaatcttttctctggtggaaatttttctgtggaaaatgaatacatgaaatgtgtgtcccgccatcactgtcacttccgatttcctcatgtcttggtctcctctaccttgaattcaatgttgattctggaaaaataaacgagattttcctaaaatttttgaacttctgaaccatcatgttgcaataatatagttttacattttgaatgtttttccattcatttttaaacatatttttcctactaaaaatctatgatgtatttcactttgctcttccccctcccccctaatttgcccttgaggtattatctgttactctataaagtatttcatcatttcccccaacttcctgatttttactggcttcatccatctgctgttgtattttttacatttggctttagcctcttcataatatgttatgagtaattgtcagttgaacaatcatctacctttatctctttccacttgttcaagtacaaatcttctaacttttgcacaattgatgtgattccattattagctaataggactgatactccatacactaaatattgattacttacattgaaacattctttttggtaaaaacaggcctacatactagatgagtaaaaccataaaaaattatagactattaaagtgagtagttctcttgcatttgaatggcagattctattgaaactggaactgcaagttgaggaaagcactgagtactaagggaatactcattcac

SEQ ID NO: 122222 - DNA, 1085 bp, Homo sapiens
gcatagaaagggccgggcgtgatggctcacacctgtaatcccagcactttgggaggctgaggtgggcagatcacaaggtcaagagatcgagaccatggtgaaaccctgtctctactaaaaatacaaaaattagctgggcgtggtggcgcatgcctgtagtcccagctactggggaggctgaggcaggagaattgcttgaacccaggaggcggaggttgcagtgagccgaaatcatgccatcacactccatccagcctggtgacagagtggaactgcgtctcaaaaaaaaaaatagaaaaaagtgctaaaaattagcaaatttagggatgggtgcatgaaaacaggactttataaaagggagaatgtaggacagataccatttaccaaatattattttgcaggtataataaaaatggctatttatataatttaaaatcataaatattgacccagctttttttaaggtaaggatcctcaagctagcttggaaaatagatcaaggtctctaagacgagcctgtgaaaaagactgccagttttccctggggagccccagcctactgtacagccccttctgactgactgactttcttccagatacagggtcgctgcttcacatgtgctgataatacatgcaggaattggctcttcagacttcactgccagactaatcacatttatagtttcttggcttcttttagtttttaagcaaatagtacccagcaagttaccacagttaaaacagtggaattcagagtacctgtatttctgaaagctgccgctgtgtacatggaatggagtctgatttttaaacagcaattttgccctttgctttatatcctatcatttattgtaaagaaactcttcctgtttcataatttctcatttgttctttaagaaaagatggcaaaggaatataattacagacatggtttcacttttattatttcaatctattatgttctccttgtcagattaatatttgtggttatatgccctgcatggcaagtgctgagaaaacatttgtacaaagtcttgccaaggtagactattgagtatatggagtatagtgacttcactgttcaa

SEQ ID NO: 122223 - DNA, 1011 bp, Homo sapiens
tatatctggtgtttaccttcaatatttagaattcaagaaataccacaagaacctgaatttattagtaatagatttaatatcttttatcaaattggtatgtttactttttaaaaatgagaacagtctttaaaatatgagacaccattttgttaaaattctaatttttttcacaatgaaggttttccaaataggatttgggtatttatcatatatcatgaatattataatatatgtaaattatagcattaaatgcaaaatagtttggcattgcagttttttccaactaaaaataagctgtcttctatataaatcagacttctctgtatctctaacatttgcaattaaattttcatgtaccataaaatgctgttccaattagactttgttaaaggaaatactgcccagtatgtaaattcagatttagcaaattatgtccaaatttctaatgttggagatatcactatacatagagtcaaaacaaaacagtaataacagaacttttcagcctgtaggcatccctttgtgaaaacacagaccgctctcttctttcacaatgttgaagaaacaaaagtttgttgagtatgagaaattgagaccacttggtaacttttcaagtgaaggcaaaaccaaaatgagcaacactgtcctcttagtgattatgatttcgaaattcatcagttatccagatgttttttgttggtttttaatgcagagcttgtaggcttctagaagcagagaaggttctaatggcaagcctatctcataaactatgcctctggtgggcctacttctttttaaatttgatcccaagccaactcacatttggtcactaattctcaaatattcctttccatcttttctctcttagtgcctttttctagagtacttccacagactctatgcaccacatttttaatgaggtactgctattaccaagcagttgttcagtttatacttcagcaggtgtgaaggctagagaagagagaatacacaggaagatgcatgagacag

SEQ ID NO: 122224 - DNA, 1020 bp, Homo sapiens
gaagaggaaaaaaagaaagggcaaatcctctgtggcaaataacatcaaccgtagtctctacagttattttatatatagcatttgacacacaatcagatatgagaaaggactttgcttttagccatgaggaaataacaggatctagaattgccatttctctataaacaactgaataactgggcaatgtacctgaaacaactgtcttcatatatgggataacaggtaacaacactgttgattcctgagagaaaggaaacaaaagagataactctatgattgtcttggctttctgcctggaggcaacttccagatcttggtgcagggaagggaaattcaaacagcgcctgtggtattgctgaatggtgggagacatagattaaagtttgggcaggtcttggtaactaggatgtgcaaggtgatataacagacaggagggagctatggaaaaaaaaagttctagataatctgtttaggagtccctttgagtcctatatatgggtaaggtgaaattccatggagtgtgcaaaaacaacttcttagaaaaagttattgaggagctgaacaattcccagagaacatacaggaccagaaatcatttgagttcccattagagtgaaaaacactcacagaatacgtgggttctttgggggagatattagaagggtcacacctttgtagtgggaataaattagttctagaataaagactagtctaagccaccataaatgaaactccacatagatcaaatgggttcagatgtaatttaactgtctgttagaacaaagatcaatcctctttaaacaaatatagcagaatctaacactcagcaacataaaatcaactacttggcatacagtaaaaaaattactagacatgtcaagaggcagagaaacatagctcaaaaatcaaaattaaaaccaattaatagaaacagacctgaaaacagaaataatggaatcagcagacaaacaagaatgttgaaatagctacaataaatatattcaatatattcaagtaatt

SEQ ID NO: 122225 - DNA, 1046 bp, Homo sapiens
gggtccccatcgtgcctgctgtaagttggaatactgtgcttacaaatttttttccttgaaaaaaaggattagacacatgcctgggaacagagttctgtcgttttaccataggaataaaatacattttccccaaataacagtaaatagaataaagtttcggcaaaatgtactaatacataatttgttccctgcttccctggtaagaactagcacaattctaattctataaagaaatacaaacattgccctcaggaatagctatcacatcctttaatatcccctgttacttccctctggttctaaaaagaaggtatgtaaattaaactaagaaaccagctagccaacccctgttcctttcttctgaaacaacctcctgcagagaatcgatacctgggagtacattttactaagtgaatgcagttctctgatacagtaccttttcataattccaccacttaagactgatagcagaaggaacaacctgtggcactacttccacagagtaatttggaagtcggaagcattacattttcccagttgatgcaaatctttttgaatatgactttaggtggacattgaagtagagctaaggtgtaggtgtagggatacaaaactgtagaacaacttaaatatatatccaaccttctagatggagccacaataaatgagttgttaattgccttctctatttcagacacccttttttccttctcctctacctctttttcagtgattttagttgaatctactgattctgcttggtgtcttagcaaccaaaggagacagtaatcctgatgtgagagtatctgttttttatgaacaaggatcttacacctagaagaggccttactagtacttttggtataatgctgtctgtgcctataatctgtagctggtaagtagtagaagggacctggaacttctgcattttagtgctatgattaacaaaaaaaaattttttttgttccaaattgtgttaaaatgggaggtaaaaagatattggtctatttcactatttttccacattggaaattggtttgggcatg

SEQ ID NO: 122226 - DNA, 1099 bp, Homo sapiens
gcctgccaccacacccggctaattttttttgtatttttggcagatgcggggtatcatcatgtttcccaggatggtctcgaactcctgacctcaaatgatccacctgccttggcctcccaaagtgctgggattacaggcgtgagccaccacacccaaccaaacaacacaactgtattacaagtttattaacttgtgttctggaggtcagaaatctgaaatggtcttatggggctaaaataaggctgcaggcagagctgtgttccttctggaggttctagagaggatctgttccttgcctttttcaaccactagaggctgcctgcatcctttgacttgtacctcatcactctttgctctgtcctcacatctcctctcaatctgaccctcctgccttcctcttttgagcacccctgtggttatgttgggtccatccaggataatcctcccatcttgagatctttaacttaatcatacctgcagagttcctcttatcacataaagtaacaagcactggttctggggttgaggatggggatgtctttgagggccaattattcagcctgccatactaccctaacacaatgattgtcactttgacattttccttcctagtcttttttaatatgcatatttttatttaaatataatcatggtaaatatgattttctatccttttccacttaatcttcttaactgtcattttaaattgctgtataatgttgtatctgtgattatatattttattgtcttgtattacacatacctttaccctgttgaatgtttatgttgttttggattcttattattgatcaagctgtgataggtgtatatatgtgtgtgtgtgtgtgtgtgtgtgtgtgtgtgtgtgtattattattaatttttttgaagatagggtctcactcttttgcccaggctggagtgcaatggcatgatctcagctcaactgcaacctctgcctcctgggttcaagcgattctcctgcttcagcctcctgagtagctgggactacaggctgcgccaccgtgcccagctaattttttgtatttttagtagagatggggtttcaccatgttggctagactggtctcaaattcct

SEQ ID NO: 122227 - DNA, 1007 bp, Homo sapiens
aggatggtcttgatctcctggcttcaagtgatcttcctgcctcagcttcccaaagtgctgggattacaggtatgagccactgcgtctggtctgattttctcttttatgtttctgttgcccagcatatacttgatacagaaagccttcaataagtacttatagaattgaaggaatggaataaaattttgcctaaccagagagttttgccctgtcctgacctttgccttagtcacggcattcatcttgtgtatcattcttcaaagcatagaacatcatggttgaagatagtgatcaactttttctaaaaacagagcacaaaagaatacacttaaattgtagcaagtgctgattaaaattaagtggggaagctttttgaagctataccacttgttagcaatggattactacaagatgctgttgcatccttttattttgaaatcttccatgggattgacttgcaccttaaagacagagtgaaggacaatataaaattccttatgagtctctgcagtgtactagtgagtaattggaatagttcagaaaattttgactgtatcttatatacactatgaaaatatattagttttaaacattatagatatagatagaatttcagaacaaattctaatcagctggtgcacaacctctgtaaaaaatgtgaaatttgtcaatccaaaatttgttcctctctcagaaacagctgtctctaaatagggcctcatattgttggtaaattcattataaatgctggaagcaactccagtttgatatggttgggatttgtagaaataatgtagacgtaggctatctacaaaccattttttttaaagtaacaatccaatctaaatactcatatgcattacaaatgagtgtcataaacttaaattctggaacctccaaaaatataagaaacctctggaaatataagaaagggctcatttaggatggaatgacaaacaatagggagagttctcattttggtttctgcccacctgctcccacccctt

SEQ ID NO: 122228 - DNA, 1059 bp, Homo sapiens
gtctcccttttctaaaaacaccttagaggcccattagttaccaaaaaaatccatctgtgtttgtggtttgacgaagagtttaatgaatgttttcccaaaagtagctatactagagagtaggttttaaaaatgggcacatagttaacacatcagatagttgtttctgatttaatattttttggaagttctaaatacaaatctttagtttatggagtgcagctggatttgcttttcttcctgtgactcaccaaaggctcttgaaaacctttcatttttttttcgcaatttttgtgttctgtaacttcgtttcaacaaatgttttaaaatagctttaaaaaattattctcctggagtctccttggaatattatttcatttgcttcaaagattttttttagcaaattaaaaagattttatttccagtattgtgatgctagagataggtctaatgaatactctaaaaacttagcagtcatgttttgaatttttgaaacagtgataatttgcatgatcgagctcttgacagtgtttaataattacaggggctttatgacaggagatttctgtctgttaaaatgttgatattacaaataaatgagatttatcttcagaataataataccttcacaaatctaccttctttaacatctctctctaactttaggctatgtcttttaggccactgtgtttttaaaaggaatgtcatttagtttcacaggactactactctagtatatataaagcttttgctaaaagcatttttgattattttaaaatatttattttctcacatactttttattctgtagtgaccatgattcaaatcaagtgtgactatatgacaatggagtatgcatggtacaattttatgagtacacaaaaaggaggtcattttaatcgtgtgtgtgtgtgtgtgtgtgtgtgtgtgtgtgtgtgtgtgtgtgtgtgttttgaggcagtatgttgctctgccacctaggctgcagtatggtggcatgatcatagctcactgcagtattgaactcctgttctcaagtgatcctcccacctcagcctcccg

SEQ ID NO: 122229 - DNA, 1111 bp, Homo sapiens
tgaggtcagtggagatcataaaggttaagtactagacagacctaagcagatgtgcttttttgaaagctgactttggcggctgtggtggttgtgaattgcagaaaagaaaagctagaggcaggaaagcctggcagaagactgctatggtttattcatttcttctttcagcagctagttaagtgtgttctctaatggccaagtactatgcttgttagtcagggaaacaacaccagacactgacccacatccctcctctcccttcccctccccaggatttatattcaaataagggaaatagacatgtaaaacacaaagtgcaataaattgttacatatgttaggataaaagtgtttccaaataaaatgaagacataaacaatagagtggcaaaaggtctcaacgagatgatttaaacattgaaaattgagatgttcttgcggatagaggaatgatgatggtgagttataaacttaggcagtagtgatggagatgaagtggaaagactggattcaagctacatttgtgaagtgaggttggtaattgcagacttgataattgtgagagtgaaagaacagaagaagaataagctgagcaattgagtatgttgagatactagcagaagtatgttgggtgtagagtgtagggggaaattttgtagacctgttgaacgtgaagtatttgcagcaagtggaaatgtccaaactgaagttaggaatgggttaggtcctcctacaggaggtaaacactaaggctagagttggaagtactcaatacaggtgagatttaaagccataggggtttctcatctctcagggaggaagtatagaattatctcagcattgtttagttgcaagcatagaaattgcttttgttttttgttttttgtttttttgtttttgttttgagatggagtcttgctctgttgcccaggctggagtgcagtggtgtgatctcagctcagtgcgacctctgcctcctggattcgagtgattctcctgcctcagcctcccgagtagctgggattataggcatgtgccaccatgcctggctaatttttgtatttttagtagagatagggttttaccatgttggtcaggctggtcttgaactcc

SEQ ID NO: 122230 - DNA, 1109 bp, Homo sapiens
aacaacccgcctctgtctttacggcaggccgcattccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccaggtgagctacccctctcccgctgacacactcgcactcattggaatacttttttttctggcgggcatacgcattctagctctctcagactggctcctgatttatctctttttagtccttcctttttactcactcctcctagacattccgtgttgtctcttctctagtccacttaacgttcttgctcagctgagtgcataagtggttttctttgaaacacttgtatgctttcctcgattttgcttcttaattgttgaggatgaagatgcctcagtgatttgtggagaaatcgagcggagatgtaggtttattgagtcacttcctagaaattttttttttttttaatgggatagattaattttctgtcccgcactgttcagggggtcacctccagaaagtaggcaaggagagagagagaggctgaaggtagataattctttccaacgaatgtcttggggttgaagtaggaatttatcccgttagtagtcattatcttcttg

SEQ ID NO: 122231 - DNA, 1047 bp, Homo sapiens
ctgaaccctcagttttcccaatcacttaggataaggacaggaggaattaacgatgaatggcagaaatgtgagtacttaataatgtaatgatataatctcatcatagctaatagtttttgagcatgtattatgctagtagatttatatcatttaattttcacaactctttgtggatgctattattaaccttgttttacagatgagaaaactgaggcccagaaaagttgagcaacttgcctgaggttacacagatactgagtggcagagctgatatttgaacctatacattatgtctccttagcctatatccttaaccactggattatccaaaacactatggcagtatttcagtcagttaagtatttactgaatgttccttacattgtgctagacaatacagatgtatgtcatcatccttgactaccaagaacttaatagtactgttggcatatgatcaaaacatcattctagttttaccttggaatgtatgatataattttagttgcatatggaaggtgcatggtaggactacaagggcaattaaagtggagtagcaaaaagtctataggcagataatcaagaactgttatatttatacagttgaggggaaatggcacctgaaacttaatataggctagaagatagcaattgaaaactcaaattcaaagtgataaaaaaagatccaaaatgaaacctgaaaatgttagatactatgatatgggtcctgctttattgttctctttacaattaagggttcttaaaaatgtgtaaggcacattttagtgtgttctatcatttttaatgccagatgaaatgtataatttgaatggtagcatgaggtggtgaagactgccagagcaagaaccaggagacctgggttgctaatgccagctctgccatttattggccatgtaatcttgaataaggtagtttctctaagccttagtttccttgtctgcaaaatgatgtggttagcttacatgatctgttatttccctatatttataaaatccttattttgtgacttgtatggttagttgctctcct

SEQ ID NO: 122232 - DNA, 1084 bp, Homo sapiens
gacattaaaacacacacacacacacacacacacacacacacacacacacacacacacacaaactcaatcaagtctgagaattaccaagtccagagtgctgtcggatctgaccaggtttggggtcagggaaggtctccctaggatgaggtttaagataagatacaaaggactgaattcatcagtaggactaaactggcaaaggattttagggttgtgagggaggaagcagcacatttaaaggctgagtggagggagggcctcaaggaagtgaaagaagccagaatccagaaagcagacaggtgtgaggctggcctggtcttaggagccatggagaccatgccaggagtgccactttcttcttgagggcagtggatgccactgaagagttttgagcaggtgagagcagtggtcatattggtgtttcagaagaattttctagatgcagaatggagagaaggaactacatgacagtgagttagaaggctacttgtagtttgggcaagaggtattggtggcttcactgggattgagggtaacaaactccatgaagataaggcacctagaacagtgcctcacatataagtagacttgataaatattcatcgaatgaatgaatgattgggtgtagtataaaaacttttttttttttttttttttttgtggcaaggtctcattttgttgcctaggctggagtcgagtggtgccatcacagcttaccgcagccttgacctccctgagctcaggtgatcctcccacctctgcctcctcagtatctgggactacaggcaggcacgatcatgcccagctaatttttgtatttttttgtagagatggtgtttcaccatgttgcccaggctggtctcaaactcctgggctcaagcagtccacatgctttggccccagaaagtgctgggattacaagcatgagccaccacacccagctgtgtaaaaatatttaggaggacctggtgattaatcagaatgtgggaggtgggaggtgagaggtgagagggagagaagaggcaggaaagatgctgggtttctgccatcaggtaactgggtagatgatagggccaggaactga

SEQ ID NO: 122233 - DNA, 1018 bp, Homo sapiens
gcaggtaaagtcagcagtgggaggaggaccatcacatttcactttctaccaggcgttattgggatatgtctttgaacatcttgctaaacctggaagttgcagcagtttggtgtttagccagtgactttgccagctgatcccagttgtctgttagtgtacaaacaattcctcccttctctgcagtcttcatccttccttatatatcccaaagctctgatgtgctatgccttcttgtgtgtgtgtgtgtgtgtgtgtgttttttttttttccaaatagagaaataaactagtctatcatttgttggcttctttttttttaattttaaagagtgttatctctgttacaatattatattgtcttacaataaacatgtacagctgctgcatttctgttaactgataggattttgtggtcatttcatttagggcttgggtttcctaatggattgtattagataccagtctccatcctgccatttctaagaactgcttgtaataagcccctgggtgttccgtactgaagacaatagcaaatagctacttctcctcttgtatcatttaacaaagtccttagtccttgttaattaaattgtggactttcttaatcttagaaaaagggcaaaattcttcccattcctacataacagattttttttctggctaaattctaccttttttaagttttgagaagtggatagaaaacagagtgaataatgtgtgtgtgtgcagaacagaattttgccttaggtatagtgtagacttaaaaaaacataaaattaactgtgctgtaaattatgctttatgacagcccgcttcttgctggatagcatggtgggatctaaaaatggtctctaagttgaacccaaattgcatgcataactttacaaagaaaaatcctagtagaaaaggtagctaattaggagcagtattcagctgacctctgttttgtgtctgagcaacacctgcatttgtgaatgtaaattggacagctgtgcttgtggtctctgtgcatttctctt

SEQ ID NO: 122234 - DNA, 1025 bp, Homo sapiens
ttgaggagagctagaaagtgttccaaggcagaggttctgcagacagggtgggacatagtactctagaaagccatcagaagcttggggagaggtatgtgacctcatgttcaccaaaacacttgaaaaccacttgagaaactctggtctaagggatacctggaacacagcatggggcaagtaggtttgtactgaaaggaacagcaaccacttctagtttttaatgagccacatgttgtgagactgtgaaggaaacagcaataattctaacccattagccagaatggacatcagtttctgaataacattagatattttaaattaaatgtgaagagttgatgaaaactcgaaatagcttcaagccccagtctgtgttcaacatttttcagtgagcggaaggaagagagggagtttttcataaatcagaatccggtcacctggggatcaatacacagtgctattgacatatatgctggaatgttaattttcagacatagtacatctctggccatccttctggtgaaggctaatgctgttcacttaaatcaagttttttctcatcggaactgccggtaattatccaatccatctaaaaggcacgctcccttttaacattaaccacagtgtcagattgcatcagccacattgtgttctggtgactgcttctgcagagtgatgaatgtgcgtgtttggagttcatagtccgactgtctgtttgggcagtgggcagttcagtgaaacaaatgatcaggaagggatctatttatttgggacgaacattctccttattgatccagtcacttacatttccaactctctcaccttgccactaacagtgttcagctttatctgaagaatgagcgtttaaagaattatcttacaggtcattttgatgtgattctctgatcataagctgcattcagcacaaagttactctttgtgcctgacttaaaaaggaaggtgttgtgagactttattaataaaaaacagaggagggagaaggttctgagagtgcttggtgaactgtc

SEQ ID NO: 122235 - DNA, 1073 bp, Homo sapiens
aagagagaaggaagagcttattgggctgaggacaccacagtgtgatttctaattttggcattgatatgcgctttctttgctaatttcatgttctttatgaaggaatggcgctttacccacaaacaagagaacaattgaacaaacaaatattccctggaatgataaccccatttatccatttgtttgcaaattcattcattcattcattcattcattctaccaatccttggggattagttgcttgcctgctggcctctgcctgctctgacttttcgatcagcttcatggactatagagttagcacattaatactaaatcatttcggagagtatgcagcttgtaactcttgaaggtagaagcattttataaatacatcataatactgtaataatcacaatgataactgtaagagcttaagtgttcttaactatcaaatgtactagaaaagcaacaatgacagcagagaaaagattgggcaaaaatgcactgatttgagagaggagaatagtgtaattactgtctgatgaatgtggttgaaagataaatgagataagtcactttttgcggggaagagccacagaaagggcagatactcaccctcatccccactaggtgtggtgaagagatatagttttgttatatatagagagaactatatagttacgttaacgttaatacaagggcagacagaaactttgggtaatgatgaattccaggacagagaactgctgattgacactcaggtccctaggcaagacaatcgtgataaaacggaaagagaacagcatgtttgctggcacggcaacagagggtgattcttgtggtgcaatggtgtggcgggaaggaagggattctcctccctttctttgtattctttgtttcagcctcgcatgtaattttagtacctaaagtcatgatgacaactctatagaaatgtagtgacaaataaataggcaggtaagtaattcagattttatcttcctgggtcttacctgggtgatgtggacatggatattgctaatgagaggtatctgaatctctcttcagatgccagatgggagagatgaccctta

SEQ ID NO: 122236 - DNA, 1081 bp, Homo sapiens
agaaacaggcatgaaataagaaaaagaggagatattgagaattaccacgttcgcctagtcctgtcaagaataaatggatccacagtcagaggatccttaatctcctgatcatccatccacatggctttatcagggaatcatgggttacacaaaacgtttgcagattaactaatcagtcttcctaaatttgtcatggttggagtaattatcttgttctcagtcacagtggtaattgtcatatgaaacctcttattttgtgttgtgtgagagaatatggatttgtatgaaatttgggtgacatatagatctgattagtttctttaatacacatgtagtttgtaccttgtggcaaacatagactcttataatctaaagtaggaatctcagttgtcagtccctgagtgacttgcaatagaaatgtcagtttcttctcttaaaaggaactgtgttcaatgcactgcatagaactgagttatgactttattcagggggcagcagtgggggagagggtggcctgatgtcctggttgtctatcagagggagcccagaaaaagacagaaaataactaattcaaaatgaccctttcacagttaaaataatggtacgtgccttagaataaccattcttttctctcctctagtttgtctggtggtttctacttagcagcttcctgccttcaccctaccaatctgtttttaaaaaacaggatttcaggagccttacttatccttccccagcccaagaggtgttcagatatgttcatgcagctctctcctgggtctcctgtgtagatcctggtagtaaagataggagtagccctggaaggatttgagaattttcacaggggtctgttacaggactgtgtgaagccagggtgagaagtcaaccaagtgtgaatcttgaagtccacctgctccctttccagggtctcacctttgtccacccaatgacggattccttcctctctggattctctccttcaagtacctgactgtccaggcccaccctccctttccccaaaacctgacctctggagccttcctgacccctaacaggtagcatcctcttcatacacctatgg

SEQ ID NO: 122237 - DNA, 1050 bp, Homo sapiens
atcagaatgctttggggtagcttacttctttttagagaaatttgcaaaagtaacatgccatatttaatttttgtctatttgttggaaaaatgaacatgcttgagtcctggttgtggtcagtttatactggaggaagcaaaacatatatgtgaacatcgtttttagctgtctttagagaaaatagatgttttgtcattgctgtgcttaaacacattgttgtgttggcagtagttttgagcaatttggtacaatcttcgtccttccagtcactgttagaaatgctttattttggtcagtatactttcctgtgataaaagaaaaggaataaaaagaaaacataagtaagcttatttctccaaggagaaatttaatttttttcagctgtaagaaaagtgatggtgtttggctggttatgaagccctgagaagttatgcttctatatgaaagagacttgttcattcataagaaagaaataggaaatccttggagttttcttagtgcaacttagagcagatttttaaagaatctgtcagagaagattgcaagctccactccaaagtacttttttagctgaagggtggttctgccatcttcttgcatggattgctgcaagagcagtagccagtttagaaagcatgggagctctggagaaagcactgagggcacagggttcttctgggcccccagatgatcaggagcacatggctggacgactagtcctctgtgccacagacactgacagaaagtgccctggccaggtagacgggacattgccttgactttattactgactctctaatgtctctgcccgctccccacccccacatgcctgcttcttggaagagggaggaatattaagtaacttaaacaaaagcaaagcaaaatcgatgcccggaatacacaagtgtgtgtaatcagaaggcactgacaaagaaagcattggctgatagaaaaatctgctatgcaactgtagatttcctgtagggtattgatttttccatttaaatcccaaactgtgatatgtgccttcacacttaatgtacaacacag

SEQ ID NO: 122238 - DNA, 1081 bp, Homo sapiens
aagtgatgatgagaagagatgcttaggctatttttctgtgggctgatttttccatttcatttcctcgtggatgtagacaggtggattataagagttgcatgtagtccttaggcagtagaaataccccgtgctaatccagggctcaataaacatgacattattgagcatcttctatgtacaaggcattgtactagacagtgcaggtagggacacaacatagaaaaagacacagtcccttccctgaaggagcatgcaattcagtaggagaaataaggcacatacagtatcatagtcgtcaaaaatgtgggccctcaggtcttgccccagctggactttatacactgtcatcctggtggtatagctaaggatcatagacgcaaaggcttaacatttattgtaacgtatctgatatcacatcacacttttggatccctgtttcacccccttggacctctctgagcttcagatcttttgtaaaatgtgataataaaaggaaataacctcagagcatatcataaggatagaaaatgatgacatatttaaagagccaggcacatagtaagtgctcagtatatattagctgctgttattatcatcttcttatagtcatgattgttattacacagtgagctatgccccaaaagagcactagcaaagttcttggagtacagaggaggaagagattgtttctgtatgcagtcattaaaaacttaataagggaagatacctttgatccaggcctttcatgggttggatttagatagttgccaggaagtgtaagggaagggggttttcccagcagaggaaaatagcacaggcatggaggtgggaaagtatgggccaggtgcactgcacccaggttagtatataggttggccaagtgtagagtacctgaaggctaaggggtgaacagcaggcagtcccatatgcaggggtttcaataactgacactatcctatcgagtctggattttagtaattctgcttcatgggaattcctagcacttctgtggattaaaaacattattatggaaaatttctaagtatacagaattaaagtagtgggaatcatataatgaacc

SEQ ID NO: 122239 - DNA, 1106 bp, Homo sapiens
tctgggcaagtttctcactctcctgagcctcagcgtctttatcaatatgacgagaataaatacagcacctgcctacctcatggggttgtttcagcagtcaatgagatcatgtatatgaagcatttagtatacctagcacctaataaaagctcaacaaccagtagtcttattactaacaaaatggagctagaaggatgcattagtttaaacaaaatcttgaggcagatactgggagtacctgtctttattcttcaacttgagtctcctcccagtttgtttggataaaaactcaaatgtaatatttttaatttgggtaaaagaacttctgagaaagggttgaacatctatccacttgcctttttatgcctagggaactagagatacttgttggcggcatcgcaaatgttgctgacttatgaagtactgcagtatctgaatacctttttgtaggataatctaaagtttccaaaaaatagtatagtgttgtagtgaagaacttggactcttaagccagattattttgttcagattcagaaatcccctccactccacccactggctgtatagccttgcccaaatcactgaatctctgtgtgtctgcgtcctggtgtgtgaaatgaggacaatagtagctattgggtagggttggcctggggtctaagtgatgactgcctgtaaggtgtttagaacagtatttggtaaacaactggcactcaatcagtgttgctgtgattatgatgatttattccaaggttgcttgctttccagtacatcatagactactacttgaccaaatttactagcaatggagtacctgaaagttttacatgtgcacatttgcatgaaaaccccacaaaatttccctttgaacagtgaaggggacggcacaaagataattcttggcactaagcttaaaaaaaaaaaagactcaaggaaaactctctacatggtcccagacctcttcattctgcctaaccatttaatagtaaaatttttaatgttaaaatgtgcaactaagaacataaatgcaaagcaagggaaaaaggtgtaatttacacagagccatatctgccatagcaaatggatgtgcctctgataccgtgcta

SEQ ID NO: 122240 - DNA, 1028 bp, Homo sapiens
gatattggagcaggatgtgctgctatttgtttctctgtgtgaacagggaggggaaaagaaacacgtgaacatttttaaatggcaaaaccagagatgggaagggaggcaatattgaacgtgtgctaggataaggctttcatataaaaagtgttcagatattaagatatgtgaaatatttggggcccttcattagatagctatttcaatcagtgatgcttttaagttccaaattgtctggtaattatgtaaagatgctccagtgaaacaccatttttggcttagggaaatatttatatacttaccagatagtaagtatataattatgaatatgatagtaagtatatgaattttgaaaatatgcaatgttattacatagctaccatataaaatacaatatatgagggcagatttacatatcccatgtagaaatgtgggtatttatatataggaaaaggaaaataaacaagcattactgaagtatttatgagtttatggcatttaactcatctcaaacatttatgcagtgttttttctatactaatttaatgtttatatatgaatgcataaaaataaataacatggaaaaattaagttgtaatggaatttttattttcatttttccttagccttcatgcattttgatttttaaacaatgttctgactgtcatcaaatcagccaagttgaaaattgagctgcatcaatggagacagccggtcttgataattcaaaccaaaaagaccttttctcgagggatatattctccctggtttatttggtctgagttgtttctcatagctctaatttattcttttgtatacactgcatgaagacaatgtctatagagatttaaagccttaaaaaaactgggtatttaatgtcatggacacatcccaaaaagtggaattcacatgagagcaggtggttatggggtgtgtgtgtgttacccagatttttaagacatttgtctttcaatcgacatgcatttattaggtacctgctgtctccccagggctgggcttaaaagtca

SEQ ID NO: 122241 - DNA, 1049 bp, Homo sapiens
aaaaaagatttattccaggaatatgaactgatgtttacagacatgccaggactgacttttaaaacacagtggaaaactgtctcaaaagcagcttaagtacgatgtaatggaagccccccaaaaagtactttgggggcatgaaggaagcctctatgctcagagagatgtactaagctagcatatccatggcaggccccttttccctgagatgtgagataccatgaggtctcatcataagtttctgagaaagcagggctagactcagagggtgcctgtggctctcatgctttggggacctagagttccccaaatccccagcccctgcaataatgttcagaaaacgaaggggaaggaaataactttggattgaacaattggatctccatgggaaagttttcttatttcctggctgggactcagggctgtactgggggcatcctttgttggtggcattatactcacaggcagacatgggcaccttggctatcatgtgatgaccatatgtcccaagatttgcacacccttttctgtttcacctattttgtctgttttcataaatcaatggtcttcaaatgagttcaggtggcccagcatttggaaatgtgccagtcttttgagaatgctgtgaattattgacatatttaattcccattgtgtgaactgagagtaatttttgccatctttaatacagttatcaaataaaagtcataaacaagagccaacaggttcacaaatatataatcaagctgtctaagcagtatggactgtttctggtatcctattagtattcctttgccacttgcttgttggttttgtcatctgtgaatgcttgttagtggatacagcagcctcggtctgtgagataaatccttgcctagtgaatttgggtaattcttgtttatgcatgctgtggttattgtcttgtgatataatttcgtttcactgctcgtcctgttctagagacctggccactccttttatgaagagtggctcctgcccccaccccctaatccccctacaccctctatcccacctctacccctacccca

SEQ ID NO: 122242 - DNA, 1042 bp, Homo sapiens
ttattacctgcaaatatcagtggaaaaaaagcgagaaggaaaagagtggatttacacatacagacccacatctgccaagtgcgtgttcgcccatgatcacataccagcatgccaccactgtttacaatcaaggaaagctgagagttaaatgagatgagtaatcaaatgcccagcatatgttgtttttgcattgtttatgtgaccaatcattattaaaatttatcatcttttaattatatcagtttatgatagtttttttaaaaaaccaacacgcaccaacaacagaacaacagacagcctcttcaacaaaaacaggctctcatttagaacaatattggaaccagtgctttattgggggagagactcaaattcaatagactcaccattgcactgtttcacaattctttctttgctgctatatatggcttgagtgctgagaaaatggcccccccccaaaaaaaaggaaaaaaagaaaaaagattgtgtgtgtaaaactctgtcaaaaaaaagtaaggcactgaaagaactattgaaaattttgacatctgtttatctgtttatagctatggcaagatcactcatattaattcttgtttaaaatgccatatgaaggaaagacatttgtgcaaacaagagtcatatttgaattgtagatcatgtcttcaccatctgtgagagctgatggtgttgcaaaattaatgtgttaatgaaatcacaataatttctccaaagtaatgggttctgaagctgagaatgagtattttttgaactttgatgtctagtgatttccaattgggaaaagctctcagcctttaattagttctgcagcccaactttaaaataaatttggtgatgtctttcttttgccaagagtagatttgaaggggggaaaaagccataacaacttttggaaaatgttctctggtgtttgaaaagttgttaaataagactgcctgccaagaaatgtcaccaaaaattctgactactgagagagagtgggcaaacagctcaaaaaataattctagcttgctgcaacatcaca

SEQ ID NO: 122243 - DNA, 1050 bp, Homo sapiens
ttaatgtgattgggggaactcaggcatttcctgtcgtgcacagtgaaactttcaaaccttgtttttggctgctgctgattattgttgccattaacaccaggatttagatagcagggttcaaagcacaagcttccacttagtcctcccaatgggcatttgacctcctcttgctcttgctaaattcatgttataaacactccaagcaagcttccaggtctctttgtggctccatttcttcactataaaatgaggaaatggtactgtattatctctggggtcccttcaagtcctacattctatcacctctctgaagttatttgttcattgttctaagaataatctcaacagttgtaaagatgtttacaagtcctctgtcaccacctcaccttagccaaattttacccattcacatttctgacagcctcatttattggcaggaagaaaaggtgctgttttggggcatggcagaagagaggcgcctgacccactcatgtgatcaaagtgtgtcgagcgcccacagcgggccagactctgagctacgagttgggtgtagagacacgagcaaaacagacaagcccctgacctctggggctttaccatgcagttggcagacttctaagtggctgctcccagaactgactgagtggcctcaggaagctctatttcaaaccaagtgactggcggcaaatgaaagaaggctgcaggtatcaagaggcagagcctcatatctcggtgaatgttgggatgagcattccccagaaactgactttcctggtggaaaatcctgttcagagcctctgccctgggaccccaaggctcttggttgatttattttcttccagtccagtgctactgtttgttttggatgtgaagagatgtgaatggctcaccttttacaggcaagacccacacacggagaaaagcaagcatttcttccagcttagttgcctttgtgggaaacttctgaagataggtatatgtgtccatggtaattttccacttgccaaaaagtgaatctattggccctcttttcagcaaataccagagctg

SEQ ID NO: 122244 - DNA, 1013 bp, Homo sapiens
tcctgggatcaagtgattctcctatgtcagccccctccgaagtagctgggaccacgggcactaacctggctcattgtatttatttatttagagacaggggtcttgctatgttgcccaggctggcctcgaactcctaacttcaacccttggccacccaaagtattggcactataggcatgaaccaccgcacctggctgtgtgtcctttaacccattaaatttactgtctagaaacattaagtccctttgcaaccaactccaaaagacaatccatatgtattcattgtgctggaattccaaattgcatttgtttgcttgagagaggtggacaatcaaataggacatggtaattccttaactctacaaaatctaacctgtttgcctgataggtgtcaactattaagagtccagagtttttacatgcaagctaacaagttaacctgccagtgtcatggatgccgacaaaacacagaagactccaaagacacaggcacagcaggtggcatgagcttcatgttccccatctgttcctgttgtcttccaagttcccacggaggcgatgtggagtggccaggcagatgctgttcatatcacagctgaggaactccaagcttgggagacctaaccctgtcaagcctgcaagcaaccctgtcttgatcttatcctggacagcaaacaaactcaccctctttctgggagggagacactgccttccaaggctgtttgccatacagacacccttgaaaagatagtctagaacaaaagcctgtgtgcctttgatcacaggtgtgcagagacatgagagactcatggaaaactgtctctcaacagctggaattcaatacatataggacctgtatttacaaagagatattatagaacactgattttcaaagggaatgaggtctattttgtgaaaactaggaccacttaggcagtttccttgagaataatatacatttaaactccttggaaatgttttattgtcaaagatagttttattgtcaaagatag

SEQ ID NO: 122245 - DNA, 2460 bp, Homo sapiens
gttccatatttcttttattaactgtagaattttacatcacaagtctagagactgcaaaatgtctcgggtttttcttccttaaagcagaaggcttctgttaagatatgactcagtgttcttgctcaagaatcacaattattttatgccatagaaatacattcataaatagtataacatacagaatcaaaatatcaaactgtattagaaatttaactacatttacatattgttaaatttacttgttttatttctgggatgaagtgtctgttctaaatgaatgagttgaatttagaattgtgtccataaaaaactatttctttgtaattgctgtggtcaaagaaaaccttttgtttaccaagatttcttccattatttctccccaaatttctgatgtctacatttaattcttctttctagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactcttgaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgaatggtttttttggttctaaatttaagatgtaatatttcctataaaagggtgaaagcagtttctttctctataacctcaatcaccagtttagtgagagcctttcttggcaggcaggaggcagtgtcactgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacgaaggcaaggaaactgagcagacaagacagaacaatgtgtagaatgcatatttcctagttttcttgaaagatttcaagaaaagttgtttttttttttctagtggctactttgccttaaagaggctttataagttcattcacacagctggcttctctggttttaagattctggagaggatgataacctagtaacac

SEQ ID NO: 122246 - DNA, 1064 bp, Homo sapiens
gagtaggcagagaaagggagaaatcaaagtccaaacagggtttaggaggagtgaaatagtttggtaagttcagagaagtgtaggtagtttgaaatgactagaataaaaagcacaaggagggaggcagtgacaggagaccaaagagaggcaggctagggtcagataatgaacggctatgtagttgatactacagtggttagatttaatatatttaaaaaggcattgtaaggatgagcagggagatgatcagatttgtgagactgaacttgttctaatcctaagtagttaattagcattgtcaggaataatacctggaaatccttaaagtgataaaacacatactagattttaaatattttaatttttttgtttactaggagtggcaagaattacaacaaagcatacagcgaaaagagagagctctattggaaaccaaatcaaaaataacacatcctgtgtatagcctttactttcctgaggtgagttatatacaggctactgtgttccttattccattcactttctcctcagggatttgtcagttgacttttagccctctgtcgtgtgtattagttcatatgtgctaaatgtggtctatcctgagaggccatatttttaaaagggaatattacaataggtattatacttagtgaacgtgttgcttataaaagagattgttagcttcttaagtatttctgtggttttctttgcttctgtcttttctgtgccctgattactgagtgttatgtgtaatggtgatttctcattagcagattaggcagtcttcatcagacaaatgcatattttgcctttgaatacttaactattatgaatctctcacctctgccaagttttaaatcggatgaaaaaattcttaaattttctctctgaggatcctgctggcgacatggaaccattagaattgctctgaccctggtcattgttgtcccagtccatggaaatgtgtgagcccatggctgtgggaccaactgtgttcttggctctaataaataaagttccataagagcttgatcataactgagccccgggctcaggacaggtca

SEQ ID NO: 122247 - DNA, 1036 bp, Homo sapiens
gttgcccatgctggtttgaactcctggcctcaagcagtcttcctgcctctgccttccaaagtgctaagattacatgcatgagtcgctgtgactggccccaaaattatacttttctataaactacctgtttccttaaataaaatatgattgatgtttttgaaagcagaaccatcttagcctttgtgttattgggctttgcaaatagaaatacttttatttgacaaattatgaagaatgaataaaataactaacaatagacagactagccagatattaaactctttagtctgactcccacatctttataagtaggaatgtttataattttaaaaaattgtatatgaatagtgaaattgtcatcgagtcagtttagttaaattgacaataagttaacttcagggattcagattgatatgttctcattgagatatgcagaatctttgtgtttgcctttcccttttaggaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagtaagccttataggtttaaataatttaaataattggaattatatctctgatgatagctttgggttttgttgttgttgttcatttgtttgcttgctcgcttgctttctttaaataatatctgtatattttataattttattactttgaagaacgtttttaaggaatggtagtcaaggttatacagaaaaatgatttctaacaaggattggaaatcctcgttttcttaaatattaaattgttaggtagagtaggacctgggtttgaggttaggtcagttggtctcataaggggattttcagtgttggggatatctctgggaatatgagtaaggaaaggtgtttgtgaaatgcatagtgcttacttggaaggctgtgtcacaagctccagttcatgtttactgtagagaaacagtac

SEQ ID NO: 122248 - DNA, 1054 bp, Homo sapiens
tattttactttatttctgaacctcagtttctttttttttttttttgagatggggtctcactcttgccctgaagtgcagtggtacgatctgggctcactgcaacctccggctcccaggttcaagctatcctccacctcagcctcccgactagctgagactacaggcgggcaccatcacgcctggctaatttttgtattttttatagagacagggttttgtcatgttgccctgctggtctcgaattcctgagctcatgccatccgcctaccttggcctcccaaagtgatgggattacaggcatgagccaccaagcctggctaaaccttagtttctgaaagtggaaatactttgtagagctattttaaggattaaatgaattaattgttaaaagcatctactggagagccttatacagagtagtcaatcagttatttttttaacaaatttaaaatataatatgcttgaaatactaaagtgccaaactaatttgggtaagctaagttttgctgtttgcattaacatagaacttgatttttattttttgctgttttttttcttccatcttaacagtgttagatgatgaagatagcaacaacatcacagtaggatccttagttacagtgttggttaagttgacaaggcaaacaatggctgtaagtagtctatctgtatttttatgctttaagagttgtgtgtcaaggcttttatatttatttccctcattgtcaaagtcaaaactgttgtaataccaagatctaattttgcaaattctgttaactcttttgaaattttaaattaattttcatgagacagttttcacatacactaaaaaaacctggaaaataatcctttgtgtgatagtttaattctctataaaacataatcataacaaagtaatgtggatatagttcttgagctgtgaagtgctatacagaagttgttactgatgagaatttcatcacctattcctttttagtcagttctatagagaattgacttttatttttcatttcaaaatctaagaattacaataaaaataacattttttttcctg

SEQ ID NO: 122249 - DNA, 1020 bp, Homo sapiens
tatcgttattttgtactttgaaatgcacattaatcaacacttttctaaaagttgctggattttgttgtggttaacatgtgagtaattttctttttatgaaaagctttgtgagttagggaattatgtattttcttttttttttttattcagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacagggtaagtgggaggtttctctgttgagcattgcttcccttttgatagattggttctcatttatttgactcaggattctcaaaacactgtacttaataacataacttgttattagactttgcagaactgtagtttacctgtcagatttactatgttggaaaatgatttatacctaatagtttgagaacactgatagagtcctacttttattatcctcataatgggatgaagtctgaacactctgttctgtagttcaacttttagcaatttcttaactttccaaagaatgatgaagacttccaggcataataaaagaatgagatatttgaagtatattattagtatgaaagaaatagctgcctagttctaaaattaaatttttaaaacccaacttatttatgttaattaaatgttgaaaattactgtgttttatgccacatttcatgtgtttttcttgccctacctctatattttctttgagggaaaaaaataaaggctatttttctacctatataattgctctgtgtttctatttcaatatctgaatggtcttagaatactgagagaattagagactatctgctccattctttcattgtggtggtggtctgagctttaacatttgctaagttactattatgagaacattcttttagttaccaagaatacagggatatattaataatggtttctgtctttattttatttatttataaataattttt

SEQ ID NO: 122250 - DNA, 1051 bp, Homo sapiens
tataaatgaaagagtctttctctttctgtaagttgccctcttcttctcttctacgtctcttatctctccccctgtatttagctgacatatttattttgacatatttagttgatctgcctgcctcagcctcccaaagtgctgggattataggcgtgagccaccatgcccagctgggagttggtttattaagcctaacattatgatattaaaaatttgtctttgaaacgtctaatctgagctagggttttatggctgatttttgacatagtgatactgaggagaaactcttccattcaatctgtaaaattctgagatcatgtgaaatatttgtggcataactttaatattagttttgggccacagtgataaagatgctttaactgtaaaattaaaatgatctgtttcaggttttttattgttttgcagatcagcaattcatgctaaaaaagtgtcctgccctacttcaagaaatggttaatgtaatctgccaactaatagtaatggcccggaaccgtgaaggtgaggaggaaatatagttaattatgttatactttttcttgcaagcatatgcagattgtacttcatattttaggatttatgggtactcagacttctgtcggccagttcagtgagcttcttcaattttactcatgtcttttcatatttctttcctatattttctattatttaaagtctatatcacagctcactgggttttttttgttcttttttttttttgagatggagtcttgctttgtcgcccaggctggagtgcagtgacaaaatcttggctctctgcaacctctgcctcctgggttcaagcgattctcctgcctcagcctcctgagcagctgggattacaggcgcgtaccaccacacctggctaatttttgtatttttggtagagacagggttttaccatgttggccaggatggtctccatctcctgacctcgtgatccacctgcctcagcctcccaaagccctggtcactgtgtttttgattttaattcttgttttttttttttttggagacagagtctcactctgtc

SEQ ID NO: 122251 - DNA, 1045 bp, Homo sapiens
tgagtagctgggattacaggtacccaccaccatgcctggctaatttttgcatttttagtagagatggggttttgccatgctggccaggctggtctcgaactctcaaactcctgacctcaagttatctgcctgcctcagcctcccaccatgttgggattacaagcatgagcactatgcctaattttaatttacaataaattgaattgtatatattccatatggtatttcaggaggaggtaggatatcagacttcaatcactgcaaccctaaaatgtcaagaattatcttactcagggatacattcctacttcaactttcttgaaaataattgtctaaaggctgtctttgaggcaataaaaacaaaatccacatagtctgtaatttgttttgaaaatggctattaagttattatctggcagattaaaattggttaccttgagggggtatacagttgctgcataagcttgtttgtcatgcttctggttagtaggaatagtcgagaaggaataagttactaccagatttaggatcaagtaataggagaaaaatcagtaggtaaaaattgctagtcagcattatgaagtgactccttgatatttagctaaaggaacctttggccaggggcttcttatctcatttgttcccagagcactaactactgagaggttgtggatatataaatacctgcctgactggaagagaaatgtaatttacaaaactgttttgctggtgttaatctgtattgtgtcagtaaataaaaaattaaaaggtaatttattatagtggatatgaacataggctctagagctgaactacttgggttcaaatcctggctgtgcaatttgctagctgtgtcctaggacaagttatgtaacccatgtgtactgcaggttttctacctacaaaaggagggtaataatggtaccttcctcttggagtttgagaataaggattaaacaagataatacatgaggaatccttttaatagtggctcccccattgtaagcctcaaaataaattcatggatgttgttttaatttacctg

SEQ ID NO: 122252 - DNA, 1048 bp, Homo sapiens
ttcaccttcccaagtagctgggactacaggtgtgcatcaccacacgagctaatttttgtattttttagtagagttggggtttcactatatgttggccaagctggtcttgaactcctgacctcaggtgatccgcccaccttggcttccaaagtgctgggattacaggctgtgcctggcctattttttgatatttaaatgtcagtattattttatgtaaatttgtcatctgttttcactttcaaattatcagtgcttagtttactatgtggcacatagtaggtgctcaataaaatacatatattggacaatataagtgtttttatttaatatatgggatgaaatttatgggaaaaatatataggatgaaaaatggattttgtctttctcaaaatactgagtagttcatattttaagttcaaaataggattgattatttctttacagaattgtgcttatttttgctaacagaaagcttgttttttttttttgtttttccccagggagccacagtagcagaaattaaaaaacaatatcgtttgctgtcacttaaatatcatccagataaaggaggtgatgaggttatgttcatgaggatagcaaaagcttatgctgcgtaagtatcaggatccattacaaatttttaagaatggtacagataagccaggtgcagtggttcatgcctgtaatcccagtactttgggaggctgaggcaggaggatcgcttgagcccaggagtttgagaccatccctggcaacataccaagaccccatctctacaaaaaataaaagaattaaccctgtgtggtggtgtgtgcctgtagtcctagctacttgggaggctgaggtgggagcgttgtttgagcctgggaggtcaaggctgcagtgagccgtgaccatgccactgcagcccaacttcgatgacagtaatactccatctctaaagaaaaaaaaaaaaaggatagttttctgttttaataaaatattaaaatagttgtcatacactttttccaagtgcttacttcatgttgagtctatcatttaggggcta

SEQ ID NO: 122253 - DNA, 2469 bp, Homo sapiens
atttacatctgtgaccgccattttagacttattctttccaaattatttgaagtgaaatggtttgatagaaaaacggtatgtatttctttagggcttttaataccttactgccagatattactttagagtgtatagtgtatgagagtttctctttttctttaacctctccagtgctggtaatgttaatcttttacataattttactcactagaacacattggagggagcagaaattagtttattttcaaatgatatgttcttttatacctttattttaaccgattatgaacatccttctataactatttattggctacaaaatgttgcattgtgtggctgtatcatggtttatttaattatttctttgtaaatagtttatttaatcagttcctgtgagccgtaatttaggttgtttccaaagttttactactataaacaaggctatgtatttatttttgcacaattgaccaattgtttttcctagtttatcttaataaaagtgtaattgctgggtcagagcaattcttttttacattaaatggtttacttagtatttatttattttgatctaatttaatgcgtccagtaagttaataagttgaattcacttctgtatttaaaattgtgcaaatagtaactgagaaaatctatgaatagtagacactgtactagattataaagaatgcagaggtaaaaaagacactgtcgttgctgtaacaggagtttgtaacccagtgattgtagaatttgagtcagtagcatagtgatatggtactactgtagagtttttgccttgaccttgccataatgtctttagactctatgcagatgtatttgtttatgattcacttacctttttcctaaacaggaaaatagttctgcttgcaggatgggcattgttcttattccttgcatataaagtttccaaaacagaccgagaataccaagaatacaatccttatgaagtattaaatttggatcctgtaagtagtatttttatataatgcatattagtttaatggtcccatgaaaatgctataggtcctcattctaaaagaaattgtctattcctatagaaatcagactttggtcagtttgtttattaaaataagatgtctaatcctctgttattataatttaagctataactgttgattgttatgttattaataattggttttcaattgctaaaatataagaatatttgaagatgagaggagaggttaacatttttttttacagagtctcactctgtagcccaggctggagtgtagtggtgtgatctcggctcactgcaagctccgcctcctgggttcacgccattctcctacctcagcctcccaggtaggcgcccgccatcacgcctgtctaattttttgtatttttagtagaaacggggtttcaccatgttagccaggatggtctcgatctcctgaccttgtgatctgcccacctcggcctcccaaagtgctaggattacaggcgtgagccaccgcgcccggccggttaacattttttaaaggctttttttttttttgagacggagttttgctctgttgcccaggctggagtgcagtggcacgacgtcggctcactgcaaactctgcctcctgggttcatgccattctcctgcctcagcctcccaagtagctgggactacaggcacctgccatcacgcctggctaattttttgtatttttagtagagatggggtttcaccatgttagccaggatggtctcaatctcctgacctcatgatccacccgccttggcctcccaaagtgctgggattacaggcgtgagccaccgtgcccagcctaaaggcatatttttaagagagatctgtaatattggttaatgcaaagttaaaactgggaggataatttgtgttagttgaatgataaaaatcttatgaccttgtattcattgacacttaagcaatgtaaaatctaggttgggggtcttagaaagaactaatatcagccaggaacggtggcttacacctgtaatcctagcactttgggaagctaaggtgggaggatcgcttgaggtcaggagtttgggcaacatagtgacacccaggctgtatcaaaaaaaaaaaaaaaaaattacctgggtgtgatagcaacacacctatagtcctagctacttgggaggccaaagtgagaggatagtttgagccaagaaggttgagatgagtgagccatgatccgcaccattgcactctagcctgggcagcagagtgagaccctgtctcttaaaactaaagtgaaactagtatcattaatgtcattgtcatggaaatttaggttaaccttgagtgtgccccttaggtgattttttgattaaacctgattaatgggttctaaatagaaaactagtcttttggccagccgcagtggctcgtgcctataatatcagtactttgggaggctgaggtaggaggattgcttgaggccaagagtttga

SEQ ID NO: 122254 - DNA, 1185 bp, Homo sapiens
aaacctacttaatgcttactctttgctaggtcatacaacatatacgtgtaatgatgaataagtcattgtgtctgtaaagaaattgtaatctatagtaagggtaagataggagaaaatgtgggaacagtctgaacagattggtttagaagttcaaaggaaggggagtatactgttgctggaggtcgggggtagaaagagataagtcatatcttgagggaccttgtgcaccttgtgccaagatttgaattttatcttaaagactatgggggaatctttaaaagatttcagaagtggagaggtgacatgaacaagttagcatttcatggtgataattaaagtttattgagcacatactgtatgctagaatctgtgctagggctttatatgttatctaatttaattctgtattaacttcaaagtagatggttttgcattttctcagatgaggaaacaaaggctaagaatgatgacataacttgaccaaagtcatgtagttagaagtgttggatcagggacctaatcaccctttattttaaacaggccattaacatgtttagttacagcagaccagtttaatcctgtgaggctatggggtgtactggttaaacacaaggctttggacatttatcctgcgtcatcagtttagaggtaatagatgaaactgacaggaggtgagagagttaccattattggactactatgtcttgtgaattacctacatttatccagtagattggaagagaagatgtagcaaaagaaattagtgagagtagaaacagttatttagaaatcttggtttaaatgatagttttttttcagcataatttcagggcgtttagtttttctttgtaaggttttactttacctaatttagtttatttttcttttcttttttttttttttgagacagagtcttgctctgttgcccaggctggagtgcagtggcactatcttggctcactgcagcctcagcctccttgggctcaggcatcctcccacctcagcctcctgagtaggtgggagtacaggtgcatgccactacacctggttaacttttttttttgtattttttatagggatggggtttcaccatgttccccaggctggtctcgaactcttgggctcaagtggtctgcctgcctcggcctccaaaagtggtaggatcacaggcgtgagccaccttgc

SEQ ID NO: 122255 - DNA, 4175 bp, Homo sapiens
gacttgaggtcattcatacagagattttgaatgtgtaccacgaatatttagttttgctggaaatctaactgctactatgttaatgtgtaaactgtggcctgtggtacttactgattgattgaaatagtctcctaaaaggttaagatttaatttttaggttggaagagtggggcatacaaggtccatgcacacattgtgtggcccccaagaataaggggctgaaaaccatatgtactttctcttggccaggaacagtagaacatcatacctttgaatagatcaaactgcctgcttcataaagagacttcagcattgttcttataaaacctcatcaaatgtttccttgattttatacttgaaagtgggatactgtagaggcttaatttaataaaatacatatttaaaaatcactagtggtattttcaaaagtgttctctaaaccatgaaaatcagaaaattaacattaccgccatctcatcgtctgactccatttgggttttgtcactttctcagtgatgttctttatagcaaaatatccaatttagaatcacataacatttaattgatgtgtttctttattttattttattttattttattttttttaattgatcattcttgggtgtttctcgcagagggggagttggcagggtcataggacaatagtggagggaaggtcagcagataaacaagtgaacaaaggtctctggttttcctaggcagaggaccctgcggccttccgcagtgtttgtgtccctgggtacttgagattagggagtgtgatgactcttaacgagcatgctgccttcaagcatctgtttaacaaagcacatcttgcaccacccttaatccatttaaccctgagtggacacagcacatgtttcagagagcacagggttgggggtaaggtcaccgatcaacaggatcccaaggcagaagaatttttcttagtacagaacaaaatgaaaagtctcccatgtctacttctttctacacagacacggcaaccatccgatttcccaatcttttccccacctttcccccctttctattccacaaaaccgccattgtcatcccggcccgttctcagtgagctgttgggcacacctcccagacggggtggtggccgggcagaggggctcctcacttcccagtaggggcggccgggcagaggcgcccctcatctcccagacgggcggctggccgggcggggggctgacccccccacctccctcccggacggggcagctggctgggcggggggctgacccccccacctccctcccggacggggcagctggccaggcagaggggctcctcacttcccagtaggggcggctgggcagaggcgcccctcacctcccggacggggtggctggccgggcggggggctgacccccccacctccctgccggacggggcggctggccgggcagggggctgacccccccacctccctcctggacggggtggctggcctggcggggggctgacccccacctccctcccggacggggcagctggctgggcggggggctgacccccccacctccctcccagacggggcagctggccaggcagaggggctcctcacttcccagtaggggcggctgggcagaggcgcccctcacctcccggacggggtggctggccgggcggggggctgaccccccccacctccctgccggacggggcggctggccgggcagggggctgacccccccacctccctcctggacggggtggctggcctggcggggggctgacccccacctccctcccggacggggtggctgccgggcggagacgctcctcacttcccagacggggtggctgccaggcgtaggggctcctcacttctcagacggggcggctgccgggcggaggggctcctcacttctcagatggagcggccgggcagagacgctcctcacctcccagacggggtcgcggccgggcactctcacatcccagacggggccgcggggcacagacgcttcccacatctcaggcgatgggcggccgggcagagacgctcctcacttcctagatgggatgacggccgggaagaggcgctcctcacttcctagatgggatggcggccgggcagagacgctcctcacttcctagacgggatggcggctgggaagaggcgctcctcactttccagactgggcagccaggcagaggggctcctcacgtcccagacgatgggtggccaggcagagacgctcctcacttcccagacggggtggcggcggggcagaggctgcaatctcggcactttgggaggccaaggcaggcggctgggaggtggaggttgtagcgagccaagatcacgccactgcactccagcctgggcaccattgagcactgagtgaaccagactccgtctgcaaacccggcacctcgggaggccgaggctggcggatcactcgcggttaggagctggagaccagcccggccaacacagcgaaaccccgtctccaccaaaaaagtacgaaaaccagtcaggcgtggcggcgcgcgcctgcaatcgcaggcactcggcaggctgaggcaggagaatcaggcagggaggttgcagtgagccaagatggcagcagtacagtccagcttcggctagacatcagagggagaccgtggaaagagagggagagggagaccgtgggccgtggggagagggagaggcaggggcaggggcaggggcaggggcaggggcagaggcagaggcaggtgtttctttagtctcctttagtctgaagtagttattcacttttccctctgctttaaagattagagaccagttatttagtaaaatggatttgaatttgggttgtacagtgttttctcattattagagtcaggttgtgtatcttgggcaggaatttcacaaaactgattctgtgttcttgtatgctgtcaggtggcatatgattttaggttgtctttttttctggcgatgctcaccgatcacttgattgaggtggtgtctgtttaggtgttttatatttgtttcctgttgctgctgtaacaaattactacaaactcattggtttaaaacagcacaaatttgttctcttaataattctggaggccagaagtccaaaatcagtttctttgggccaaagtcatgatgttggcagggctacttccttctggaggctctagggtagaatctgttttcttgccttttccagcttctgtagatagcctgtatttttttagcttgtggcccttccttcatctttaaaaagggcattagtccagcatctgcttccgttgtcacattaccatctgtctttgacccttctgcctccctgttaaaagtacccctgtgattatggtccttctatgataatcttcctatttcaagatccttaacttagtcatatctgtaaagtcccttttgtcattcgagatagtatatttactggttccaggtattaagatgtggacatcttgggggacagttattcagcctaccccactgcaaagtcattcgtttcccctttgtaattagtattttgtgggaggatacttggattcctggttcctgttagtggagaatggtatttagaagccaagatctgcatgctagatgtgctcattgctactaggatttttctgctcctaggcccacttagtagatagagctagggagtatgtatatatgtatttagaactgcatttgtatttctttattaaaagacattcattcgtagtgatatttttaattccagtccaacagtacagggttcattcttgttttctattttttcactcctttttcttgacagtggaaaactgactccaggtatctttaatatattaacttattcagtcagttcctctgcatattatcagtctccttttctgctaccatactctcccctacatggatctctccctcttcctgatacttggtttcggtacttcttgctgggtagtcctcccatgtggatgacttcatctaagcatggtggtaacaaggtagttggacttcttacctggtggttttggaaccttctatatgccaagtccttttacttacctgttacctcatttaagaactgcagttttgtagatttttttttaatatggtaaaaaaaaattataattagccagctggactcattttagatcatctcaattgtgttggcagcattcaaaac

SEQ ID NO: 122256 - DNA, 1538 bp, Homo sapiens
ctgagccccaacatggaggtacaaaccaaggaactaaaattgaccaacagccttcgtaatttaccctccaagcctttcccggaaagttgcaagccttcagtagactccagagttacatctagactcagctctgttgctgttcagtgagtgagtgctagctagcctgaaggtgggtagtgcggaatgcactcacggtagcactttgagctagattcatgtattatctcattttattcatgagaaaactgcgtcctagaggaggttaccaactttcctaaagtcatacagctaccaggtggaagactgtttgttggactcaactctgtcttatgccagagcatctcttgttagccactactctctgctgcctcctgtaattaagtaaatataacacattacgatatgtgttaaaatggctagtggaaggtgctttgggagcacataggaaggagtaaataattatattttgggatttggggaagtgtttcatgcagaggaggtgacacgagataggtcttaaaaggtaagtgggagaagggcattccatatataggggaaagtatatgcaaaagcatggaggtgtttagtaaatggtaaagatttgaatgtgattggcacttacgaccaactcaggtattttaagagggttatactttatcctgtaagttatttggtaaacaatggaggttttaaagtatggtaataaaacatggtcagtttggcttttgtggaatattgtgtggagaatggtttggtgggtggagggggaggttggtgatggctgggtgggaaactagatggagggggtgtccatttcagaggctctttccagtgacaggtggtcagattagaaagagaattctaagaaagcttggactgtttattgaatataagtactgaggagagaatgagagtggagtgcagattttgaattttcactcatttctaggattacttatttcttgtcctcttgaaagcttttggtgattggcccaatgatcagtttggggatttaagtgcagggaaaagaatggggatgaatttttttttgagactggatctcatgttgttacccaggttggagtgcagtggcaccatcactgctccactgcaacctcaatctcctgggctgagccatccttctgcctcagcctcccgagtagctagaactgcacgtgcacaccgtcactccctatagagttgtaattacagtaggatgggttatctcagtctcctgttgagtggtttggtttttttgttcttttttttgacaataacttcttgtccgatagtgagtgtttttgttttttgttttgttttgtttttgagacagggtctcactctgtcacccaggctggagtgcagtagcacaatcttggctcactgcaacctctgcctcccaggctcaagtgatcctcccaccacagcctccaagtagctgggactacaggtgcgccatcatacccagctagtttttataatttttgtagagatagggtttcaccaggtcaccaaggctgtgttttttaacattagaa

SEQ ID NO: 122257 - DNA, 1367 bp, Homo sapiens
ctccaattgagctttccaccgcctacccccgtcacttcctcccgttgctttttcatttgttcactcactgtgggggttggaagcaatgccgttattcctcttagcaaaaataggcttttttctatttccttttcttcggagtttcctgtttgtgacggaaaaagtgcaagtatgaaggattaagtctcgtttaattaatcttgtagggaattttgaggtagtgggtcgatttacttttggttctaagtcttttcacattaaacaacatcgaattaaagcacagaataacagattcttttcatatttcacttgatgtttgggtaatgtttgcatccatttgttgcactctactaggacatatggcagatggtattcttaaagctgatgtaactgcgagggcctaatgggttatttatggtagtgttaacagtaaggagtgggttttgagtattaacaacttagggaaagctttctattgcacaagagctgtgctaacttgcttaaatatcttctcttcaattgggtgtgctggaggtctaggttgtccaggttatatactctacttggagaagttgttaacagtgaagccttgaatcagctcagaacttgttatactttcagatggattcagtgtcctgtaacattctttttcccccccgccccatgtgatctgcaggaaactaacattcttgacttggaatagaactaaaataaatttaggataaatagtaacaaaggattgcatcattttgtacgtttgacaataagtttaaaaatccattagatgcaaaaatctgtccaaagttactagtcttaatactttttttactcaatgggtagtttatgaaatttggatcttggactgttgtgccttatttcctaagtgcatttaaattgtgtaggttcttcctcgatgttgaaaaaggaaaaaaaattgggtaggttctttgggcagtgattgtgtataagtgaagtcttaatgctgtaatggcttttcttatctgcaaacctaggccattcttgtggttgttgtatttcaagttaaaagggtacacttttcagtagtttattttcacctaacagccattatgtgtgcaattggtagtgtagaaaacaaaaaggtattgggagagtagtcggtgggtttggccagaatgtgttttgatcaggcagaacaaaggtataaaaaaaagtgttttgagaaactgccctgatttcagaaattagccatcattttttaatctacattggatttttaaagttgttctttttttctttttaaagcggggagagtctcatttacccaggctggtcttgaacttgcttcaagtcatcctcccgcttcagccccccgagtagctggcctt

SEQ ID NO: 122258 - DNA, 2024 bp, Homo sapiens
gctgcttcctcgtttataactacagagcccttttgggtgacaccatttctcctccaggtctgtccaggtttctgtcatctcttgccttaccatagatattttcagtccttaatggtcacctacaaaatattcattgatgtggccaggtgcggtggctcacacctgtaatcccagcactttgggaggccaaggtgggcggatcacgaagtcaggagatcaagaccatcctggcagtggcgggcgcctgtagtcccagctactcgggaggctgaggcaggagaatggcgtgaacctgggaggcaaagcttgcagtgaaccgagattgcaccactgcactccagcctgggctacagagtgagactccatctcaaaaaaaaaaaaaaaaatcattgatgaaaagtggctgtgctctaccggcgggatttgactgcgtgatgtctcacagaaagttttctgctcccagacatgggtccctcggcttcctgcctcagaagcgcagcagcaggcatcgtgggaaggtgaagagcttccctaaggatgatccgtccaagccggtccacctcacagccttcctgggatacaaagctggcatgacccacatcatgagggaagtcgacagcccagcatccaaggtgaacaagaagcaggtggtggaggctgtgaccattgtggagacgccacccatggtggttgtgggcattgtgggctatgtggaaaccccttgaggcctccggaccttcaagactgtcttcgctgagcacatcagtaatgaatgcaagaggcgtttctataagaactggcataaatctaaaaagaaggcctttacgaagtactgcaagaaatggcaggatgaggatgtcaagaagcagctggagaaggacttcagcagcatgaagaaatactgccacgtcatccgcgtcattgcccacacccagatgcgcctgcttcctctgcgccagaagaaggcccacctgatggagatccaggtgaacggaggcaccgtggctgagaagctggactgggtctgcgagaggctcgagcagcaggtaaatgtgaaccaagtgtttgggcaggatgagatgatcgacgtcattggggtgaccaagggcaaaggctacaaaggggtcaccagtcgttggcacaccaagaagctgccctgcaagacccaccgaggcctgtgcaaggtggcctgtattggggcatggcatcctgctcgtgtggccttctctgtggcacgtgctggggagaaaggctaccgtcaccgcactgagatcaacaagaagatctataagattggccagggctaccttatcaaggatggcaagctgatcaagaacaatgcctccactgactctgacctgtctgacaagagcaccaatcctctgggtggctttgtccactatggtgaagtgaccaatgaccttgtcatgctgaaaggctgtgtggtgggaaccaagaagcgggtgctcaccctccacgagtccttgctggtgcagatgaaacggcaggctctggagaagattgaccttaagttcattgacaccacctccaagtttggccatggctgcttccagaccatggagcagaagaaagcattcatgggaccactcaagaaagacggaattgcaaaggaagaaggagcttaatgccaggaacagatttcgcagctggtgtggtctcaataaaagttattttccactgggaaaaaaaaagaaaagtggctgtgtcttccaagcgatgtgactccacaatacatgggcagcagtgaacattggttttcccgtggcgccagactcttcctctgcctcagggaagcagctctgcttgaagcccctgtggatatggtttccatgatttttcttccagatatcactacttggaaaattgtggttttattcctactcattaagtcttataaacattatgatttgacatgtcacattccccagtgaatttccgctttgtaaactctgggctgtttagtcagttgcagaaactaggtagggaggctgggggtggcagga

SEQ ID NO: 122259 - DNA, 1180 bp, Homo sapiens
taattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtgg

SEQ ID NO: 122260 - DNA, 1091 bp, Homo sapiens
aaaagtacttaaaatgaaatgtacagtgtggctttttgtttgtttttactgctccattcctattgcctaaaacagtacctggtttctagtaggctctcaataaataataaatattttgtaaatgaataaaacagggcctaactatattcctcttcatataagttctttgtttgaatgtacaaatggttgacattctagaatactttggtcagtattatggacttagaatatgaaatttctgtatggatataaatttctacaatgactgtattttgaaccaggtttttttcctggcagaagaagttgtcctcaactatcagtaggtttttagaggtatgtattgagtctaaattctagattcctgtttagttattagcaaaataattataagaaattgaagacaagttaaatataaaatagaaagatattgtttgctcttgttccagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcgtaagttttttacaattatttattttatagataaaagcctgtattttaaaaatttaggcctgttttagaaatgatagctactctgagaactcaaagtagattagcctaaaaggactctctgctttaagttttacaatcatgcttactagtgaaagagatctgtgaaaattttataagtgtggacaataaaaagttaaaacagggctaggtgcagtggctcatgcctgtaatcccagcactttgggaggatgaggtgggcggatcacgaggtcaggagatcgagaccatcctggctaacacggtgaaaccccatctctactaaaaatgcaaaaaattagccgggcatgatggcgcatgcctgtagttccagctactcgggaggctgaggcaggagaatcatttgaacttgggaggcggaggttgcagtgaaccgagatcgcaccactgcacgccagcctgggagacagagtgagactgtc

SEQ ID NO: 122261 - DNA, 1050 bp, Homo sapiens
acagtctcactctgtctcccaggctggcgtgcagtggtgcgatctcggttcactgcaacctccgcctcccaagttcaaatgattctcctgcctcagcctcccgagtagctggaactacaggcatgcgccatcatgcccggctaattttttgcatttttagtagagatggggtttcaccgtgttagccaggatggtctcgatctcctgacctcgtgatccgcccacctcatcctcccaaagtgctgggattacaggcatgagccactgcacctagccctgttttaactttttattgtccacacttataaaattttcacagatctctttcactagtaagcatgattgtaaaacttaaagcagagagtccttttaggctaatctactttgagttctcagagtagctatcatttctaaaacaggcctaaatttttaaaatacaggcttttatctataaaataaataattgtaaaaaacttacgcagaatgagtttgcgtttcttttgctctgagtgaagaaagctactaaggtagaagacaacaggtagaaagagaatgaacacagaaacagcaattacaggcactgtgtcactgcaagggactgaacagttgaaagttcgactccatagttttcgagtgatgttcatctggaacaagagcaaacaatatctttctattttatatttaacttgtcttcaatttcttataattattttgctaataactaaacaggaatctagaatttagactcaatacatacctctaaaaacctactgatagttgaggacaacttcttctgccaggaaaaaaacctggttcaaaatacagtcattgtagaaatttatatccatacagaaatttcatattctaagtccataatactgaccaaagtattctagaatgtcaaccatttgtacattcaaacaaagaacttatatgaagaggaatatagttaggccctgttttattcatttacaaaatatttattatttattgagagcctactagaaaccaggtactgttttaggcaataggaatggagcagtaaaaaca

SEQ ID NO: 122262 - DNA, 1016 bp, Homo sapiens
ctatttctgtggcttagtttcctaatttgtagtgatccctcagattttttaaataagggtgagaagttagaatgagattcatgttctggagaagataaagcttcagagaatgtagagtatgtgagttcagagaggggacaactcctgaaataggtttaccaagaggatcctgtgtacaatgggtgcagaaggagccctgcacaagggggctgtacaaggaggtgaatggggctgaattccagcttagcttctggaggcaggaatgaccttttgtaatttatctacccagagggaatatctttttctgatttgcacaaaggagctttactgtgctgtctgcccctgtctaccaggtttaggtttcatctcagttgctaactctgatcagttggtggggactgcctgaatccctgtatggtgtaagatatctatgggtagtggagggagtaggcagtggcatgtatttgtagattccgagtcttgaacttttaatggtttagaatgtagatataaatatgtttattttgcagtgtttgagagtgcaggctcaagaatcagactgagtacagagtctagctttttacttaccagttttatgtccttgggcaacttccttaatttatctaaacctatctctgttccttatttataaaatggagataatgataatttttccctcatggaatcactgcaagaattaaatgggcaaatgtgtttaaagtgcagtgtaagcatagttcttagaacatagcaagtatttagtaagtgttaactttcgttgtagtaattgttgtctgtcagagtacatggatgtcccttagtgtgtcatatcctagtgtctacctagtccgtctctcttttctccacaaattctacttgccttgctgcctttctcctgggtaattgcaatagctttgcatgttgtctttccacttccagttgagagagatcctatctgatggccctgaatttctaaataaggtgggcataatacaaagccatctgttgaaattaag

SEQ ID NO: 122263 - DNA, 1012 bp, Homo sapiens
attggatgggtattatcttcattttaccaagagaggaaatgggacagagtttaatttgtccaaggtcacacagccagtaaaaagtacaattgggatttaaacccaagtctttgtgattctaaaacctgcacctgtgcgatggatgctgcctccaagctggaccgtgtgcagcttggccaaggcccatgccgaacactcgccctgacagctgctgcctgcagactcctggactctacacccgtcgtgctcacacagttgccttggtgccagtgttatcaaagaggccaacacgagcagaggctcacgttgagctaaagaaaaattaaacatttaagagaattcagttataaagctggaatggccgttcctgcttgacagatgtaaacactgcagctttgtcattacttagctagttgtctcagcacatgtcctttcctttctagctagattatactttaatccagttgttttcatgttcactaaatccaaaccatgtttaaccggtttattcattggagagtctctgaggtgaagaaagttttgtcctttcaacttcactggggatttgctgtcttctttctgcaaagggattttcctgaatctgtaatctgaacactttgacctgtgagggtttttcccccaactaggagcaaatctgtgaggcttgaccctttgtgtgctgtggagcagagacaatgcccttctgtgaatgtcttctcctcttgaggacagtagtaattggcgacaggaatgttaatcatttggcaagcgcttcttcatggccttgctgccctttgccactgcagccagctccctgcttgcctctactccctcgagaatggagccgccattttgtagcagctttctagagaagtttttttcaagagcactttgagagttgacagtctgacttaaactgaggtaagtgaataccagttcactctcagaccacagtctgtgttgatgatacaacaggtcctcacacacattgtctggtgggaggataaattgg

SEQ ID NO: 122264 - DNA, 1273 bp, Homo sapiens
ctgtgcaacagagcaagactccatctcaaaaaaaaaaaaattatacatgcttctcaactttaaaatatgtgttttgaactcccccaccttgtataaaatattggactaaatttatattttttattctcagggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaataccatttctcctatttttcagaagttttttcctagtcaactgagtgacttgtttaaacaaacttagcaagggtgtaataactcttcttagtcagcaggtttgtgctttc

SEQ ID NO: 122265 - DNA, 1023 bp, Homo sapiens
acaaagtgcttcaaaatgattcaataagccttaagcaatacattttttagtatatcacttttgttgttgttaaaaataccccattcaatggatggaagtatatttgatatcaccactgtttaaagggaatggagttacaggaatgagaagtatataattagtaaataatccctctcaacaagtgacttaagtagtcactcatagagagcaaaaaaagctggaggcaacacaatcagtgcatatcagaaatgcattttaatttttatttgaaaacaacttaaatttttagacaaatgattttagtatataaatttgcttttgtttttatacagaatataaagatttccctcattaatcttccatgtgaagggtattacaagcctggaggaagatactttctgcacacaagtatgtatcttatgtgtgcagtattggaaaccaatggtgtagtgctcctacacataaatggggtcaagtgacatcacaaattaaaagggggaaagagaaatattctagttaatcagatgcaagaagcaaacaagacgcaaaaactgtgcaaataagaccaagccagtaactttagttacgacactgcagattacactggaataacaggtttgtgaggctatagtgtgcaccacattaaaacagcaagaaagagctatttatatagaaaggctggaatgagggatttttactaaagcaaattaacttcttgtcaactgccaaaacaaaacaaaactgagcatatgagtgttagtatactgaaggcatgttataccagtttctgtgcagcatgctaaaagttagaacttcttcactggtgcttatcaatcattaatagtcacgtttttgccccttcttgccaaatttcaggcatgtcttattttagatggagtatagcttttatctattatttcatcttgtaaaaacatgtgaagacaacgttcgttctgtgccagaggatgaccagcgaccctgagaataaaaaatataaatttagtccaatattttatacaaggt

SEQ ID NO: 122266 - DNA, 1033 bp, Homo sapiens
ctagcaaagttttattttgttatgggtaaaaggtcatattaaaaacatcatgatttcggccgggtgccgtggctcatgcctgtaatcccagcactttgggaggccgaggcgggcggatcacctgaggtcaggagttcaagaccagcctgggcaacatggtaaaaccccatctctacaaaaatacaaaaattagctgggcatgatggtgggtgcctgtaatcccagctacttgggaggctgaggcggaaaaatcatttgaacctgggaggtggagtttgcagtgagccgagatcgtgccattgcactccagcctaggcaacaaagggagattctgtctcaaaaaaagaaaaagaaagtcatgatttcttttgttttgccatacccgtccccccatttttttgaagtttccttaatgtgcttcaatttaggactaactttttttgtttcagacaaatcttcctattttcaagctgaaagaatctactgttagaagaagatacagtgactttgaatggctgcgaagtgaattagaaagagagagcaaggtaagaatgatttatgatgcaactttaaagcaaaacattccaagttttaatgtttaatatttctcaggaaaatgatattgaataaaatgggtaaaagcaaatatgatttctttttttcaaatagttcagtgtcattttatagaggtagagtctgtgtaaattttccttagaactctttctcttgtctgctttggcccagttgaggtctttgctgactcacacttcaataacacttcttagaaccttgttgctattacttccttcctttccctcatcgtcctattccatcttcccctctccacacacttaagccaagtttctcttcctcaatacattttataaatgtcagtgtatttccaattttgttttagtgacatataagtttttttcatcacatatatgttcatgtaacagaagtttcataaagcagtaatgacctcactctgtgtgatatgtgctgatattcttcagattagcgtttttaaatg

SEQ ID NO: 122267 - DNA, 1055 bp, Homo sapiens
aatgtaaaatctcacctgcagaaaacactcaactctgtaaaggcctttttatctttaaggcatttacaaagacttaatattttaatgcggaagggtgaacttggttaaaaagccaataggtgaaattagagagaaataatccagtgctttctttctgggaattattctactctccaggggacctaattttattccctgtggggaatgagaataccctctgtacaacaagccagcatctttaaatataagcttgacttttagtataataagagtcttgttaggtgcaattttttccttagtcatttatacaatgaacaaatgttgtggttacctgggaaagaaaattcaagtgcttttaaatctcttgtgagatttggtttcatgcttgaaacctatacactgttatgcccaatagcatctgttgaaaattctgagctgtaaggtatacaacatagagaagttaatacacttaggaaaaaattgagaccactacaaaatggatttaagggcctgaattaaaagcttttcttgtgctgagtgacagctacttaccagtagcattaagcttaacaaataagtagaactttcttaggagtgaatattacaagatgatgtccctgtatacacagtaggaagccagtctttccttcaggtggcacttaacttttttcttccaattgtaaaacactttttagttctatgcaaattctgtgctaattagttcaaagtctgaattaacggacagaatataatctaagagaatatatagtgttgagtagtatttttggtagggtatggcattagttattatgttaagtcatttctgtctcctacaaactttgtgataatttgcacattttaaaatctttttggctgggcacggtggctcatgcctgtaatcccagcactttgggagtccaatacagatggattgcgtgtactcaggagttcaagaccagcctgagcaacatggtgaaaccctgtctcaccaaaagtacaaaaattagccagatgtgatggcatgcgcctatagtctgagctacacagggggttga

SEQ ID NO: 122268 - DNA, 1106 bp, Homo sapiens
ggaagacaccagaaaatagttttgcattttaaagattgtccaaaaaaggtgttagactattaatagacagttttatttcagcataagcctgtaggattatgtaaatcttcatgaattgttatgaatgaattttcctttaaaatagaattattaatgcacagtttcattagagattactcattgaaaaccttgtgtgagctctccaatgagtcttgttgctaattcacaaatgaagaatatggacaatgtaggaaaagtatctggaattccttggtttatgcatttaagctagtctagataatttattctctactgttttggaaattataccataaaggatacttcttttaaaataaggaggaattgtatcactggaaggcatgtccttattttttaaagaaagaaactaaatacgttggcttagtgacaatctacatttcaaaggttctctggactaaaagcttattcttcatttaaatgacttcttctcagccttattaagagttcatctaggttataaaccatatctccagttattcatgctgttccagattgggtaaaacaggtatcaaaagtactgaagggtgaagcaatagcttaagcacttctcagtttatcttttatctctagatgtagatatttggagaaatgcagctgtttaatgagaactgtagtggggcatccatttacatctcttaggattggttgaatagagtatggcctattgaatatacttttgatgttgttgccagtctcttttcaaatgtacacgtgacactatctgaagaaatactagaaacacctagtaaacatttttctaatatctattgttaagctatattcaggtgatcacattttgaggcttggttttctgcttggctatcagtgataatcaggtaacatatagggtatctgtgagctgctgactttaataggtcagcctgtgtaagtgtataagacctacctttttggagaccaataatgtggtagtttcctgtgcttagacttgaagggagcacttgttttagacctctataccatggtttgagaaatcttttccttagtatgtaatatccatttgcattcctgatgatcttaccctgtgt

SEQ ID NO: 122269 - DNA, 1044 bp, Homo sapiens
acattttagataatacgttgtagagactctgagttagattgcctcctgcccctccccaaaggggaggtggtggttgctatttattttttttagggacttgcccacattaagtctgtagtatgaggtggtgatagcacggatcaattttttttttttaagccaggttttctaagggtcaccctgagtcagtttgtcagcttatctcagtggtcagaaatgactggtcaaaggttatgcgtagctacttgagccagtgaggcttcagcctttttctttttttaagagacaggatcttgttctgttggccaggttggtcttgaactcctggcctcaagcagtcctcccaccttggcctcccaaagtactaggattacagacgtgagccactgcacctgaccagcttctgctttttgccagtgcaggttggggaacaagtcaaagttcaggcagtttacaagttcgccccagcttttacttcgtgccgtcttctcatgtccatggctctcccttgtctgtgaaaggtctcattcagccatggatgtttagataactagggttctctccagctgagcatgcatacagctttgtgtaagcacacatacttttttttttttttttttttttttttgagacggagtcttgctctatcgctcaggctcgagtgcagtggcgcgcaatcgtggttcactgcaacctccacctcccaggttcaagtgattctcttgtctcagactcccaagtagctgggattacaggcatgtacccctatgcccagctaattttttgtatttttagtagagacagggtttcaccgtgttggccagggtggtctcgaactcctgacctcgtgatccacccgcctcagcctcccaaagtgctaggattataggcgtgagccactgcgcccgacatcacacagattttcagacctccacagatacttgggagttaatcaaggccccaccatggctatgtaattcttctggtaagtctgctggttcattgcttgcccccagtattgcaaccttgggttgccgcaatatt

SEQ ID NO: 122270 - DNA, 1005 bp, Homo sapiens
taccactgcactccagcctgggtgacagagtgagaccccgtctcaaaaaaaaaagaaaggaaggaattaagttgaaaattgagaaactgtgataccagctctaaatgggacaacatagtgaattgatagaatttttgtcttagtttagaaggccagattatgttgatatgcttaagttgggataaattgcagttttagagcgtttttgtttagacctcagcatgattcttatctataattgatatttgttcagttttcttccctcaaaacatccgatcaattgtttttttctaactaaatttcttttttagagttgttaactttaacttgagtagctcctgtgggtcagttgatttattgagtacttgcaatgctaagtttaataacacatgttactgcattcagtaagttcacagcagcctgaaacagggctagatttctctgataagttttccccagaactgtccaataaatgaacatttatgaactgtctgttatattccagacattgctagatgcttgtttaaaagatgaataagatatgcctagcctttggaagcttccaaactggtggtaaggagagtggggagaggtaaattcataaaatatgcataatctgtagtgggaacccaggtctgccctgaggggccaggagtgtgtgtgggcagaaagtgagccagtagtctagctagggggagcacctgtctcttttgtgcttcactgccagcatctgacatcaatgacatgccagaatcacacagtaataatactggagtgattccttgttactctctgacacaaacatttttctcgatttttatttataattttatatataatgtataatttggttttaaaattgttattttaatttttattttttaataaatagtgacagggtcttgctgtgttgcccaggctggttttgaactcctgagctcaagcaatcctcctgcctctgcctcccaaagtgctgggattacaggcatgagccaccacacccgg

SEQ ID NO: 122271 - DNA, 1047 bp, Homo sapiens
agaatctatgtagctctatcaattggccaatgagatgttgtctgttacacatgttgctgccagctacggctgacttttccaggatctccatcaaggagaagcatgctattagcagtgaagattctgtccttatctaatccatccccagaatggagagtgggggaggaagacagtggctattttaaagtagtcctgttatattgagtttttagggattctgttctgttaagggatgtatcatttgagtatcttttatgtgcaaagcactgtgctctatctataaaatttaatcttgaggtaaccaagcagagtagataatattcctgtagaagctgatcaactgatcctcatctcttgtcctttcctcattttaactccagtcctgaactggtatctcccaattaagctgagttcttttgtatccaggccttttgcacacacttcctcctctgttaagaacaggcttcctttaagagcctcatctggttactatcacttatcctgcaggactcagccttaatgtcccctttttaaagattttgctgatcccttgactctggaccagatttccttcctgtgtgccctggtagctttgttaggaataaatttgtttgcttgtctttggcttcctgtaagttcctgtgtcacccattataagctcttagaggacagggactgtcataatcacccttactcaatatccaacactgcttggcacatagtggacacttacaaataaatgaagtttaagaaagttaacttccccagggtcacagctattaaatggtaaaactgggatttgaacctagattttcggaccttcagagcccgtacttttgtttgagacagggtctcactctgttgcccaagctagagtgcacggtggtgcaatctgggctcattgtagcctcgacctcctgggctcaggcaaccctcccaaccttcgcctcctgagtaattggggctacaggagcacgccactatgcctggctaatttttttgtatttgtagagacagggtttctccatgttgcccaggcttgtctca

SEQ ID NO: 122272 - DNA, 1047 bp, Homo sapiens
aactcgaggactcaagtattccccccgcctcagcctcccaagtagctggactacagggtactactatacctggctaattttttattttttgtcagatgagacttgctatgttgcccatgatggtcttgaactcctggcctcaagtggccctccccctctcagtctcccaaagtgttggaattacaggcatgagccacctcacccagccctgcaattttatttattattttctaaatgttgctgctctcccgaacccctactgactaccttttgctgttgaatttgctatgtggaaaaccattttatgttccagaatttgggcttttaaactatcttacagttactgtctcattctggtcttgagaaaaatttacagttttacaggatctgattgaaattactctaattcacagggcaattttatatggatggtggcacttagaatgcaagtttcccaatctccatttatcttttggtttgaggatagtgtttaagactattaggatcacttgattagtatctctgggcttttgaaaataattacacagtgttatgtttttaaaaattgttctaatgggtaggtacagcagagagcaccataaatgattaaaggtttaggaaagttcaaggtctggaattatttaggcatattcaagagaaggctgaaagcaaaattcagtcactgtttatgaagtttgtgctgtaatataactttaatattctggagatttttaagttaatcaagatctattttacctggagaccactgttttgaacaggaatggaattagaatctttcttgagctctgacatagtcctcagttcaaagaatagatttaacatttcctagctgggtaagatacaaaatcaaagctccacttcccctctgtgaaataggtgtgctaataatagtacctacctcttaggactaaatgggataaggcacatgaatctttctagcacagtgcctggcacataataagcacgcaaaatttagctctttctaaagatagacattttctaaattaaacgtcagtgatcaactac

SEQ ID NO: 122273 - DNA, 1082 bp, Homo sapiens
aaagccgtttccggcgctctaccccgccgcaggccgaggctggcgcagagagacaggaagcgccagctctgggcgtctgggtcctcgcctcctcggccgcagccccgcggcggcgcgctcgcggtgcattgtgggcgctgtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtgaggccgtctctcccctctcccaagaaacccctcccgctggctctggtcacccccactcgacccgggagtggacccccgcgggcagccacagcctcccaggccgggagcccccttgcagaggcgggccggggtcgtgagccagggcccctcttcctgtagggctggtgtggggggctgcagagcgagcccggcgcgctggcacttggagaaggtgctcgaagaggagggcgtgggttgagcgccgcttgcccctccagcagctgatcagggaatgacatttgagttggaaaggggtagatctttcgagaacacatcccttcgctgggaagggaaagagatgttgacagagaaaaggggcttgcgcaaagttaaagccttttcccagttttctcttcctggagacttcccagaggtagcaagccaacccggctgctcca

SEQ ID NO: 122274 - DNA, 1061 bp, Homo sapiens
cctgagtgactttcattttgagggtcagaggttgactcagagtttgttccttccgggacgtttagagagctgaacctagtgggagtgcctggcttgaagagatgcaggtgtggggttggggcctggggacccctaccctctgcgttttccaagctctcggggctggtgactgacgggcactggaggaagagccgcgcctgggacctctgcaggccctgatgtctctcgtgattctaggaaggaaggtccacacacattctcagattgagggatcgattcttggtgttcttttcaagtcactaggggcttcagtggaattattttgtcaccgggctttctttctccctggcttccttcattcagttatatgttcatgaatgaatgaatgaatgtatattctgagtaaccaagagtgccagttttactgctctattcatgtattcgcactaaactgcacgattttcaaaggcaaggacattgtgtcattgtttcctaagcacttagcgcaatgattggtacttgacgtgcaaatatgatttttgagtgaatgaatgaatgaaattattctccttgtctccctcatccacatactcgttttcctttttctcaaatccaagcaacccctgtaatataccttaatagattgatagaccttaataaggtatataccttaatagattatttattaatttagctaaaaatatgacaatctttgacccttatcatcaatgcagttgaaattaatactagaactttgattaggtcaccttacgtctttctgcaaagattagcataatgcatttagtataatggaataggctccacacactgcctgggggtagccctgatctgctggagtagtcgttaaaagtaaataaataaataaagatataatggaatattctggtagtgtaagctgtggattataatataaattttatttttcatttttggtagtcaataaaagcaaatgctataaatttcaacaggtgcaagaaagaatatggcaaaatgtaaggcttttttctatccctatcccttagctgcttagtttttctcct

SEQ ID NO: 122275 - DNA, 1050 bp, Homo sapiens
gtcactctgtcacccaggctggagtacagtggcacaatctctgctcacttcatcccctgcctcccaggttcaagcaattcgtgcctcagccccccaggtagctgggattacaagcatgcaccaccatgcccagctaatttttgtgtttttagtagagatgtggtttcaccatttggccaggatgatcttgaactcctgacctcaagtgatctgcctgccttggtctcccaaagtgctggaattacaggcgtgagccaccatgcctggctgaaaatgtattttatattatttttatcaaaatgacatttacaaaaactgctccaatagatatacttgtaactagttaaaagtttgaatttgacccttaagaaatgtgtagagcactgtgaaaatgtatttaagaaagtctaaaattttatgtttttgtttatagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaaggtgaggcttgtgtgatatgaaagattaaacagttaaaagtgtaagcattttctaaaatggatgcaatgcagtaggacacaatcatgaaacatcttgaaaaattttcaccagttcctttacacaaattctgttggatccccattcctggccttttgatgttccatagctttcttttgccttcaggggtttgaatagcttcatatttaggtatttaaaaaatgcagtccagtctaaataaaaacttctatggaaattaaagctttccctttcctctagctcaggcctcatccagggatcagcagtggaaaaggaggagtgatgtgttctttcccttttcttcctccttctttctctgtttgcctgacatctctagggtcagaatgagaagaatga

SEQ ID NO: 122276 - DNA, 1072 bp, Homo sapiens
gttgcccaggctggtcttgatctctgggctcaagcaatcctcccatcttggcctcacaaagtgctgggattacaggcatgagccaccgctcttggcccttatagtttcctaaacccactaaatctttattttaaataaagattttacttaaaaatgttattttttattttttttgagacagagtctcactctgtcacccaggctggagtgcaatggtgcgatcttggctcactgcaacctctgcctcctggattcaagtgattctcctgtctcggcctcccgagtagctgggattacaggcgcccaccaccacgcctggctaatttttgcatttttagtagagacggggtttcaccatgttggtcaggctgttctcgaactcctgacctcaagtgatctgcccgccttggcctcccaaagtgctgggattacagatgtgagccactgcgcctggccccactaaatctttaaaatactgaaagagatccaaacatctaacataatttgaaaaaaagtatataaaactttagtttttaaagagtgtaaagacgacacagacctattttttttctaaaaacaaacactgatatgccaattatcagaaaaggaaactttgggctattaggttttccagtgatggaaaaactccagtgatggagttctttattctggtgctatggttcgaatatttgtctctttcagaactcatgttgacatttaatccccagtgtggcagtattgaaaggtgaattctttcagaggtgactgggtcatgagatctctgctgtcatgaatggattagtccattcgtggagtaatgggttaatggattaatggattatcatggaagtgggaccggtggctttataaggggaagagagtcttgagctagcatgctcagccccctcgccatgtgatgcccctgtgtcatctggggctctgcagagagtcttcaccagcaagaaggccctcactaggtggggtccctcaaacatggacttctcagcctccatcactgtaagaaataaattccttttttattttttttttttttttgcgactgagtctcact

SEQ ID NO: 122277 - DNA, 1207 bp, Homo sapiens
aactcaatttcagatattctgttataagcgacagaaaatgaactaagacatgtgctaagtaggatttatgattttatgaactttggattttgttttcaatacagttgtttaaacttcattataggctgggtgtggtggctcatgcctgtaattccggcattttgagaggctgagatgggaggattgcttgaggccaggagtttgagaccagcctggccaacatagggagaccccatctccaccaaaaaaaaaaaattagctaggcatggtggtacatgcctgtggtccacctaattgggaggctgaggtgggaggatcacttgagcccagaaggttgaggctgcagtaagccgagatcgtgccactgcactccagcctgggcaacagagagagactatctcaaaaaacaaaacaaaacagaacaaaacaaaacacaaatagacttcattatggtggacttattttttttccctcattatactcctaagaaactttctgtaagtctatgctataatattaaaataaagtataccttcttcataagataccaaatttattaaccaaggtgataaaattggtgacaaactaccaggctgctttcacctacctatgtaacaatgttttctctagtaaattaacatttgaagatgttatgaacagatgaccatgccatatgagcaacaaactatgaagaatgaacatttataaacactttacttttgttattgaataaaatttacaaccaggttaatctgacacttttaatgtatgcataattgttattgtgctgtgaggtaattaggcataaatggtaagtagttcatgtaaatcactataattagaattacttttacacagccaaatcaagcatttccagagtcagggagggagagaattaaatagagtatggagctactctgaaaatctctatttccattaatcaggggtctataggcagccaggttttttcatctcttgggaggagacatcgtagcccaagagacctgagaattgggagccacagaactcctttcctttttctcctgccctctaccagataattttcagtttttccctaatgagaacttatttccaactccctcttatatcctaccatcttttatttggatacctcctcctcacccttccaagagcaatgcatgaggcagatggaaaagaactactcaattctaccattgcactcaga

SEQ ID NO: 122278 - DNA, 1013 bp, Homo sapiens
gctgattgaaactccagcttgagaggtttggtgactggtgtgctttaccagaaggtaatctggtagggatctaggtctttctttgggagaagcttaaccagtgtaagtgccttctggcctttttatctggagatcattcagtttctccagaaaaattcttctactctattaattgctgagaatgaacctagctgtcattgtttggggagcccatctgggaaagaagaagggaaagactacatggctggtaaatggtagaggggatgtacattcaagttgtgtgactgtgaacccctcgctgtgggctactatggttattgcctcctgtgttgaatcctaagaggggcttcacagcattttttccaatttccttttgtggtaaatacacacataagatttaccatcttaatcattttttaagagtacagttcagtggtattaaatacattcttaatgtcatgcagccatcactaccatttatctccagaactactttcatcttgtaaaactgaaactctgaacccattaaacaataattccccattccttcctccctccagcccctggcaacccctttttctacttttttttttttaaattgagatggggtcttgctctgttgtctaggctgcagtacagtggtgtgaacatggctcactgtagccttgacctcctgagttcaaacaatccttcaacttcagccccctgagtaactgggaccacaggcgcatgccaccatgcctggctaattctttttaactatttgcagagatgaggtctccctatattgcccaggctggtcttgaactcttgggctcaagtgatcctcccacctcagcctcccaaagtgctcagattataggtgtgagccacagcacctgacttctactttctgtctctttaattgttcgctgttctaagtacctcatgtaagtggaatggagaatatttgtctttttgtgactggtttatgtcacctagcataatgtccccaatgttcattcatgtatacg

SEQ ID NO: 122279 - DNA, 1043 bp, Homo sapiens
cctcggccttccaaagtgctgggattacaggcatgagccatggcgcccagccaaataagtagttttaatgccttaaagattaaactgttcctttctaaactgttccttctttttctaatttgtttactgctaccttgcattgaatgtccgttttgtatttccagatttagctaatctaataagagagaataatttagttcacaaaagtgaacattagagattgccccttaaaattcttcaggttcttgaaattacagaaaagaaggtcaaactattctttttcttagttcattggctaattggtacttttgagaccaatgtatacttacttcttattttgaaagcagttataacagacacttgatcaattttatgttcctgcacctttgggcaccattaatgattctcatcttgttgtcaggtctcattctttgcctcctgagaacatctacttccagtaccttcactttcatattaagtcatcgctaaaatcaacaactttgttcctcctgttaccttaaccacctgaccataaatggagatggttaaagaagcataactgcttccacttctgtaaaagcactttttttttaaaaaccctatgaatgttgttggattttagtttagaaaatacagccatatggtaactaattgaagggaagcatattacaagttattcatctgagtgtttgaaagcaatagaaaagatgtgatagtatgggatgttcatatagtttgggtaggtggcaacctttgtttggaaacatccttataatatagagaggggaagagaaaggaattctgaaatgggaagtgagacgaacattttggtggctataataagtttagttcagaccacttataaaatatgtaatcggccaggcatggtggctcatacctgtaatcccagcactttggtaggccgaggcgagtggattgcctaagcccaggagttcaagaccagcctgggcaacatggcaaaaccctgtctccacaaaaaatacaaaaattagcctggtgtggtggcatgtgcctatagtccc

SEQ ID NO: 122280 - DNA, 1036 bp, Homo sapiens
gcctgtgtttaatttttttgaagaactgccatactgttttccacagtgacagtaccattgttattctcaccagcaatgcacagattccaatttttatacatccttgctaacacttgttattttcttttttttttttaatagtcgttctaatgtatgtgaagtggtatcttgtagttttgatttgctttaccctaatgattagtgaatgcatttttggttagataattcatgactttattctgaatctataagtatactacactgcatgcagcagaatttgaaactttattaacttttctgggtaaatataattatttaaaatctactgctaatcactatatcaagagatactgtactgaatatttttgcaatgaatgactttccatcaaagtgacttctttattaaaaaaatgtttggtggattgttttttcatatacaaaagcactctgacattcaaatggcatgggcccagtgtcatcttgtggcttgaaggaaacccaaaagataagacttagatcttcctactttctgaagtgcctttggattctagtaattgcaaaggaattactagacaggaagtgatcttgtggtggtgggagatggggaagcagggaggatgtgagactggactagcacatgctagcctggcttactgaggaatgccaggtacaaactgagcttgggccactgacccgaatgccctaggctttctgagagggaataaggcattttatgctacctgcattaaatgctcaggctgttggatattcaattacagtagtttccccttattcacagaggatagttccagtggatgcctgaaacctcacatagtactgaaccctatgttttttttttgtttttttgttttttaagatggagtctctctcttgtcgcccaggctggagtgcagtggcacgatctcactgcaacctccgcctcccaggttcaagctattcttctgcctcagcctcctgagtagttgggattacaggcacccaccaccatgcccagctaatttttgtacttttagta

SEQ ID NO: 122281 - DNA, 1049 bp, Homo sapiens
acataggtaatagtcaaagttaatggtctctcatttcttgagagtttactttatgtctcataacaatattgcaaggtaagtattattactgctttcgttgcattgatgaggaaattgagggtcagagaggttcagtaacttgaccaaggtcacacaactggtaactaacagtttaagtccagcactaatgctcttgtttaccagtaacagctatgctatacattttccttagtatataaagtcttgtattatgtgtttaaatatacaattctagagctgggtggggttttggtagatgttttagtgatggaacctaaaaattatccttaagcctattaagcctagtacaatacttgctgatttattaaaaaagagtttttaaggcactttattcttagtgacagtatatctacaatcaccacttcacttttaaaatggaatcgtattagtagccttgatttttagctagttattattggcctttaggtagtgttaattaatataatatttattttactagggagacgaatggtaattattgctgcttaaaaacatggatatactccttttttgtgctcttgaatttaaggaattttaaagattatgttttggtaagcattcagattacacttgcagaatgctcttcattagtttggtcttccttactaagtgtagaatttcagctttttttaacttttagtttcaggggtgtgtgtgcaggtttgttatataggtaaacatgtgtcacaagagtttgctgtactgattatttcgtcacccaggtactaagtctagtagccaatagttcttttttctgctcttccccctcctcccaccctctacactcaagtaggcgcatttcagttttacctgaggtgttagatacacgattcttaccttggttgagaaatgtgtttggatagtttttttttgtttgttttttgtttttaacatgtgttttggttggtgaaataaataatagcttatcttcagagttttccttaggatcttcattatgtcctcttggaatatttatgttacatgttaaa

SEQ ID NO: 122282 - DNA, 1034 bp, Homo sapiens
gcctgtgtattttattattattattttttcatctctcttttttgagggggtgtgggaagcgggtgggaagaggaggagggtgttggtcatgttagttctaattaattagacttcctaaatgtttaggacaattatctatgctttccacctgtagttctataaaagaagttatcatagaaccatttggtaatttgtgtagaaatgataggcttgcaaaaaagaagagtcaagtttaaaagactgctatacagtgtttcatgcttttaattatctactcttttcttcatgatgataattagaatttttctcttggaatttacttccatcttaaaaaaaaagatgatccactagcaaatttgttacagcagaagtgaaattaaaataaaacaaatgtgttgttgtcaataggtcactgacattgctgatgccatgattctgaaacagctttttgaaaatctgttcaaaaacggggtcgtcgttgtggcaacatccaacaggccaccggaaggtaaaaacaaacattgtgctagtctcatccaattaggtggaaactaacaagcttttaaaaatccataattttgaactaaatgtattgtgttaataaatctgatgactttgcttattattagttttataactggcttaatctgaaaaatcagttggtatttgcatttgaaaagttttgtatccttagcaagctaaatccagttgattcccatgtttggtgcacttgctgtttttttgtttttttttttccctaaatattagatatgtcatatgtgcttagcaaaaaatgcaggccttttggactgctttttatggcccataaaagaaactcaaccaaatgaaagacgaaactcataattaaattttagaaaaagaccgaaaacttgcttgcatgaatagtttctaatacttcacttaaattatcatttctaaaaaagcacttgtggcttattaggaaagtacttaaaaattaaaatacaagtaatatttagattaaaaacaacaactttaaaatcttgcatctttca

SEQ ID NO: 122283 - DNA, 1062 bp, Homo sapiens
tcagttaaaggtctaagaaaccacaaatatttcatgagagacttaatgggaacatctttctgcctggagtgctgtttctccagatatctgcatggctaagccctcacctcctttgtctttgctcagaagttacattgccagtgaagcctagacttgtctccctgtttgaacctgcaacacatccctttcttcttggtgctgcttccctttaccctgctctctcttttacccatagcactatggacctaccatataatttacttatttattatatttatagtttattgtctgttcccttccaggatacaaaagcttcatgagggcagtgatttttatctctcctgttctcagatgtgttctcagcacctataacagtgtcttacacatagatggttctcagtaaatagtcttagaatgaacattggatgattgcatgttttaaaaagatctctctggctgcagtgttgagaatagagtgtgggtatggggtttcagggttagaagtaaggagaccttttaggagactactgcagcaatcccaaggggaggggaggtgatggagcagtaaagtggtgagaagagggcaggttctggatgtactatataggcagagtcagcaggatttactgatggaatggagctagagtatgaaaaaagagagagggatcaagagtaactcaaaggttttggcctgagcaattggaaggataaagttgctgtttactgagatggggaagactacagaaaaagcagatttggttagggaggtggaggtaggggtttctgtggtgacaagggggatacatataagagtttggacttcattggaaaagtctgggctggagatatacatttggaagttatcagtcctcaaggaggcaggaaagagcagctggtgaggtaggaggagaaccaggagagtgtcaagtgaggaaaagaaaagtagtacaaaaagaattgatgattacttctgttaagtgctgctacaagctgaaaatgaggttgagaattaaccattgcaattagtaacatggaattcattagtgagtctgaaaagagtaa

SEQ ID NO: 122284 - DNA, 1053 bp, Homo sapiens
gcatcagtattacctttagacattcagtgacaagctatgctcgtaaatagcaaagagctagaacaattttggaagccctttagcaaagactgctgaaaggataattaggctgctcagactatggcagtgtggttaactaactgaggaaggacagccaccaggagggattaaggaatgttttgcagctcctagctttgtaggagtgaacaaagctaccggtgtgtcagggtagcctgcagaaatctgagctggagccacccttctggagaagactgtaagttcaagatgcggaattgcaaaaattggacaaacttagagaaagccttttctaaatataaacagtggaaggaatgggatgcttgtcacagaccaggttttttagccacagcagacaatcatcataaataacttaatattttaaagtaatgaagatgacatgtatatgtgtgcgtgtgtgtgtgtataattttatttgtggagaaaaagactcagagagactaagcatatcaggaagaggtaaaactgtaagacgaagaatgaagcagtgattgccaaggtccagggtgaggaggtgtttgactacaaaggggcaggctcaggatgcaactgctgcatccagattgtagtggtggttacatgtgctaaaaactcatagaaccgtaggccaaaaaagttacatattataagtaaattaaaaacaaatgacatggatagtgaatgacagaacaaagactagaacttaggttttgtgactctttttacacattgttttctatctttttgccttatggtcatcactgatctctgtctatcctgtcctagagaaagaacgtccttttcttaaaacagcagctcaaagtactgtattaaaaaaaggtgggagggggagaagaaaataaagaagagtgtcctcttttccagccatcaaaatgcgttcaactttttttaggtcacaattttttttttttggagacggatccttgctctgtcgcccagactggggtgcagtgcgcgatcttggttaactgcaacctctgcctcctgggttcaagc

SEQ ID NO: 122285 - DNA, 1032 bp, Homo sapiens
tgaccaagtgctcatttcactctgtttagagatcatgaaggaatcatagtcaagaactcctgaattttaaaatagtatttagtaatgacaaatgttgatataaatgtattatgaaatctttatgtctaagaaaaataatattaaacagctaatattaaaaattttgttggctaaataacatttcaagagatggatgtattgcattgataattagcacgatatttgaattacaaaaaactcttcaatttaatgcgtatggtccattttcacttgtgttctataaaaacctaaaggttcttaagccaaatgatttctgtttagaattctgtttagaatacatttctcagagcatatagttttggatgatatatatatccttgtaaaggctgattttttaaaaagttcatcctttaaaaaattaagtctgtaagacttaaaggcattggtattctactttaactttgttgatgagtggaaatcttttaatcaagaatattacaagtgggtctttacatctctcattgtcattaatgaactaaaaggtgcatacttgttaaactacatctcagagccttatacatccataaaaaagatgttattctacaagtaggaccaaagtgttaccttaacatagatgaactttcattagtgtagtatcttagttttaattctataacattgtgctctttaataatcactaattatatgtatggcttttttcccaataaaatttttaaagggcttattgaaatatagttgacatataataggctgcacatagttaaaggatacaatttttaaaatactgacatatgtataccttcatgagaccattgccacaactaatagagtgaacatttccatcaccccaaaaagtttcctcttgcccttttctctttttcttcttctttctttctctctctgtctttcgccttccccttcccttccctccctccctcctcctttcctttccttccttttctctcttttctctttctctcttttctttcctttccccctcccctcccttcc

SEQ ID NO: 122286 - DNA, 1021 bp, Homo sapiens
ggctaatttttgtatttttgtatttctagtagagttggggtttcaccgtgttggccaggctgatctcgaactcctgacctcaagtggcctccccaaagtgctaggattacaggcatgagctactgagcccgtccaagttctttactaagaattttcattatagattgagaaaaggagagaattttttttatagtagaattctatatattcaagtattaaatgcttgatatctaatcttctcatattgggttattgattttgaattttggaagtgatactttccaaattcttttattgtctcattacagtttaaaactaatttgattgaataccttttgatcttctttctgtggctgttaatttttttcttttattaaaattataataaaatgtgtgtaggacccaaagagaaatcaattttggtctttttttctttttgctcctttatctttttttttaatcagtagaaagctttatttgccaggctaaacgataaattaacatcatgatttaggctaagcaaaaaactaatatcatttttttctttcagatctctataaaaatggactccaaagagctaactttgtaccattcatagcagtcttgaaggtaaaaacaaatcatttatttgtgtttactaagatcatacttattgataatcaagggctttagtaggattgtcttagtcttggcattcaagcagaatttattttggcatttagatagtaatagtcaggggccgggcacggtggctcatgcctttaatcccagcactttgggaggccaaggtgggcggatcacaaggtcaggagttcaagaccaacctgaccaacatggtgaaaccccgtctctattaaagatacaaaaattagctgggtgtggtggcatgcacctgtaatcccagctacttggggaggctgaggcaggagaatcatttgaaccctggaggcggaggttgcagtgagccgagatcacgccactacactctagcctgggtgacagggcgagacgccgtctcgaa

SEQ ID NO: 122287 - DNA, 1025 bp, Homo sapiens
ctattacgtaatgtctggtatcagctggttcacatgttttgtccagtgttttagttatttattacagaagggcaaaatccagttccaattactctgccttggccaaaagcataaatctctttcttagtttttagttataaaggaaaagaagatcaggttttttttcttttttctttttttttagtaatttaggaacttagagccatattttatcatagaaacaaaaaaataaataggataacaataaaaagacagttgtgggcacaggaattttgtttcagctttctctcacacatttagaggaacagttaggtaaatgatgatgcagtcacatgaggggatataacagttatacggaatatttttcaaaagctttcgataatgtagaataatgcttacagataacgtgagtggaaaagtatgatgcaagggtacatctattcctatctcaactgtggaaataatacacatgcatcaaaaaatactggaaagaaatatcccaaaatgttaatagaatatatttctggatattaagattatgagtgatttaaattttctcttttagacttttctaagatttctggaatgatcttgtattatttttataatgaaaaccatttttgaacaggtgaattttgctcactcctctttggaaatcagcagacctgactaggagaactcacaatcaaagttgagaaatcagcaaaaagcaaaatggattgaacatgggtcctatctgtagagaccattattacaaaaataaatgggatggcaggcacagggaggaaggagcaggagcggggggagaggcagagatgaactaacaagtaaaagcacgtgatagatatattttggaggaagaactacctcaggaaatgggagaatttttcaggtaaaattttctatattctaagagaaattaaagtagtcatggtactgatgacataagagattagacatgaaataattataagattagatgataagtgagctggcagagcagctctcaaataaactgagagcag

SEQ ID NO: 122288 - DNA, 1053 bp, Homo sapiens
cacaaagataaatcagaagaaaactttcatgaaagaaagttaggttgaaagtctagattcaaagtgttcattgtttatttcctattgtatgatccccccatcaagaatcatacatttttggctgggcgcagtggctcacacctgtaatcctagcactttgggaggccgaggcaggtggattacttgaggtcaggatttcgaaaccagcctggctaacatggtgaaaccccatctctactaaaaatacaaaaaaattagccagccatgaggtgggtgcctgtaatcccagctacttggaaggctaaggcaggagaatagcttgaacctggggggcagaggttgcagtgagccaagattgtgccactgcactccagcctgggcaagagcgagactctgtcttccaaaaaaaaaaagatcataaattttttgatgcacaactgaacctgaacctgaaggattataaaaagaatcttacaatcatatggaagaaaaatcattgggaaaagaagtcaagctggtctgaggcttgtaaactgcaagtagatactagaagagaagagaagagtttttactaaattcagttttttaaaaatgtgacatctggtcagctaggctgtcatgtacctctacgcccacagatatatgttttggatatatgataatttaggatttatagtccttagtgaagtttcctgaataaacaactttaagattttataccaccagtcaaaattaataatataaatggagatattgtggtaagaaaatattggtggtcattgaatctgactaaacattgtcttcttccgatctgtaagtcagacaataaaaatttttatcatattatgtgagaacttctgtaattgagttaactaaaggatgctaaaaaataaaggggccctaggaggttgaagatggccaaataggaacagatccagtctacagctcccagtgtaagcaatgcagaagacgggtgatttctgcctttccaactgaggtatcgggttcatctcactggggcttgtcagacagtgggtgcagtccttggaccag

SEQ ID NO: 122289 - DNA, 2026 bp, Homo sapiens
aattgcttaaaacgacatatgtcaatagcaccttttttttctatgaagtatgacttgttttatgtgatgaaaatcctgtgtcagcatagatttattagtaggtcttggagaaaggggcattccaagagcttgctggataaatggttgatcgaagggaggaagcttggtgagtgaaccaaaagcaaagatagtgattcggtatcaatttcagataatttagtaacttgagaaatatcagctttgttaggatcaactttcttagaaatatcttcaatttcatacatttaaaaggaataatatatcttaaatgtacattcactgaacaatatttatggagtataatctcactgcatttgtaaacattatttaaaattagtgtggttaaaaggaaaagggaaccagttgatattttgaacagaagaatagtttattaggttactttcaatttactattactagccttcttgaagattagattgcctggcaagcattgctattctcatctgatcaaggtccagcaattcatgatattttacacaaatttttccatttgggtaaaaatctgtctgtttactccatcacttacactttcataaaccatttagtttgtttcattccataatgaaccctaaaagagataaatgctattcataagttttaaggttaaaaaaattttcaatgtgaatttcattagctttctttttatgattttcttaatcagtttaacagtgtgaaataatctaaaataatctccccaggggaaatgttcctgtgcaagattgtatgtagtgtttttgcacacaatgatagatcttaatatcagtaatttagcactttgattctcattcacaatgacagcttagcatgctatcttctttcttaacttttaaatttcttcttaaaattaaatgtttgatgattagattactgaatgataactaaactggtgaaaaataaccaacaaggcattctacaatagaattttctcttgatgaatttcagatggttcgattagagaaaaataattccagcattaactcttataaatatgaattttccttttcctaataaagagttgcccatttggaaggcatcactatctgatttatttgttcggtttaaatatgtaacataaagaagtgatactttataatgtgaggtagtaacaattttgttcttattattgctacttttgtaatttgtttaatgttcaggtaatgacatcatatcttttacttggttgttcatgtttcttgactgttgtgcatcctttacataaaacttaaaaaaattaagtgatatattagtttttatgtttttatttcctgagaaaatttttccaatgataagaaaatttttcctgatagtaaactagaatattcccatggtgtgatttccagctacaaactttagaaaacttgtttgattataacccttagataaaatgcttcagtgttcagcctttgtccagccatctgcattaggatttatagacttgctaaataaatgtatatttgccatttttcctgccacagttttcatttcattggtgaaattgatttgtcagtttgttcattgtaactttcaataccagagctttcagagtgctaaataatcagaatcagcctttgaggtcagtgtcagtcagcctctatgacctctactgcgttgtcacctgagtcagccttgcagggattaaccctttgttagtgtgataatgtctttacttatgagttggctttttaatacttaagattgaaagaaacaaaagacagaacaaaagtagcagacaactcctgaattggaaagagttgttgctttcccccacaaactgtatgtggtaaaatatttctaaaattatcaagttttagtctaagtctaggaaatctacccaagatattttattaaatttatttaatttattaaattaaataaaaatatatttttattttattaaaaaataaaaatatatttaatattaaatatattaaaacatatattccatatatgtttggaaaaatttatt

SEQ ID NO: 122290 - DNA, 2478 bp, Homo sapiens
aaaatgcatcacaagttttcagttgttcgtaatgaggtagcggacctcatcagggctcagaggaagccatctttagcttttgtttaaaccttaatctcagttttttttctttctgggaaatctgttttcttaaatcaacacttcttttttcttctttgcttgcacctccaataagagatgggaatcatgcttaagaaagctaaatggaaaagttaaacaaaaattatcacataaaagatgtatgcattttttaatcccacatgaaaaagatgcttgctatattcccttttgcctttaaatcagtaacattctagtaaagttgttttataatagaaaatataagaaaacatatagggaataattttagattgtttttggaaagaacttgttttcaaattgaaattatacaaagtaaaatggtaagtaggttactgtttcacagaatttaagtttttaagtggaaatcagtttggttaaaaatattagtagctttactgcaaactttgtttatgcaagaggcatagttaaaacataggtttgagaacctgtgtccagaatagttaatttgtccgatatccactactgggaagtcaagaaattattcttgagaaagcattgcatttattctgaggcaggtggattacttgagctcaggagtttgagaaagcattgcatttattttgaaattttctgaagcactgaaacaataagtcacctaaaatgcagttatcaactttttctggcagttgaattatgttcactttgtctatccaaaatatttttttaaaattagtcctcagcaaaaaaaaaaaaaaaaaaaaaagaagaagaaatgctctatttcagaatctaaagtaaatcaagtattttgttgggggaaggaggtgctgaaataatttgtatattatcctcaatatcagaatagcatctctaagtaagttttataattctgataaatgttcaatctctttattagctactttgaaactacgtttaaaaaaatctacccttcaaatacttcagtgctcaggtttccgtctaattaatattattcttttaacgtattttaattataggactttctgcagtagtcatccatgatccattccttaatgtgtaatctgtgaagctatttttataagcattgccctgctttagagtagttttactatgacgttttgattctggatagacttctttcaagccacaatgctctgagatgcttttggctacttaacccattttgcatattgtgccatttgtagaataaagtagccttttatacttgaagttgatttgaactctgaaaggcaacacctgaacatctcacaaaactggataattatggctgattgtgtttttcaggtataggtcacaggaaattcatttggggtaaagtatgcacaaagctaagaaatatgcagattttctgttgtaggactgtgtaaaaattatttacagttaatacttgcataaaggttagaaaggttgatgaagtgatatttagttttgctttactattcactgcatgtcagaatgtaattatgactgattcatgaaactgtcttagaaacgaaccatctttattaaaatgctgatcaagataagagctgacagtaataaagaatagaacattttagtcttgttgcttttgaatgattgctaattaccccagaggtcatgtatagtgcttggtaggattcattgacattatttcttttaagtctgctgtttcaacaacatctgagcatgaagacacaaactgtgtgcacattgaacaatagtttggcttaagtttttagggcttcaagatatctaagaaatcttcttctgccatagtgaatttagtttttctgtatcaaaattatattatattaggggtgcttggtacaaaatacattgtatatttatttactattgactgtatctacacctcccatttttaagttgcgttaaatagtatatataggttattgggacagtgtcacctctaaatatatacacaagcatatacaagtaataagaacaaaatgagtactaacatttaagttagaatacataaaaggacttattaatgtgtaatcagaatatactcatcagaatatacaatttgaacactaactactgatagtttggtttttattaaatgtgaactttgtaatttgtctctaaatgtatgtggaaatccttatcatgtattccttagccaattatgattgataggattcatgtattataaatacatagttgattaactgaataaactctgacatactgtttaaaataacttaaatctttataattattaactgaaagtagaagaatgtggaatatatatgtaatatgcatgcatgtatgtgtgtgtgttagtatatgtatatatacaaactacacaatcacatcacacttttctttttttctggtttccatgatgtaacagaaaaatcaatgggatgagaaggcaatctttgtggacct

SEQ ID NO: 122291 - DNA, 1051 bp, Homo sapiens
gttgtatattagaattggatggtgataagaggtcacaggccttgtaaatatcactggaaattaggaaatttcttagagatcatgctcttttgactagattcactgtcgacttgcagcttagcttccccccgcctccacccttctgcaaagagctttgaagaatctagcgtaagtgaatgaaatctgaaaatctgaggtttatttaaaaaaaaaaaatatatatatatatatataaactgagtgttagtatttttcagacaattaagtgctaacatctaagtgctttggtaatagttcttttgctgctgattaggtattcctcagtggtgattagtgaatgtacaaatgcaatcatttcgtaggtcttaatcactcatatgatcgagaagttagttacccagaaagagaaattgaagctgtataactttcattagccttattttttaatagcaaaaaataagaaaactttttgactaaattaggaatactgagtcatataagataaattgtagtttaaaagaaatagagaacctggcaaatatatttatatgactgtattgtgacactgtatttgatgtctgtagtaaagatagcttatgaaaaattgaccattgcttaccatagtagggcaggtttttctcagggagattgagtaagacatgttccctgcataaggacatttttccttcttcttttttttttttactgggtgactgagctctcgcaattatagcaggaacaagggaaagaaagtattttttcacatttatgacatcaagaaaaacacagaacatcttgaggcaaggggagaaatatatattcatatatctcttttcttctcaagaagtaatgtagtatatatataaaacacaggacatcttgaggcaaggagagagtagaatgcatgtttttgggcaatgctgtattttcctctggtgggattggttatagggcccaggtcctaaaggagaggcctggggagttgggtttggacaacttggagtgatgagctagggatatctgtatagagactccaacaggttgctcatgc

SEQ ID NO: 122292 - DNA, 1045 bp, Homo sapiens
atcacattgtaagaagaacatgttgggatggagagattattttacaatgtacaagtcttaaaacccaccacaattacgttggttccgaaggtttgaaaaatgcagtttttgactgggcgtggtagctcatgcctgcaatcccagcactttgggaggctgaggggagcagatcacttgaggccaggagttcgagaccagcttggccaacagggagaaaccctgtctccactaaaaatacaaaaattaccggggcatggtgacacatgcctgtagtcccacctacttgggaggctgaggcatgaaaattgtttgaacctaagaggagaaggttgcagtgagccaagatcatgccactgcactccaccctgggcaacagagtaagactctgtcgaaaaaaaaaaaattgcattttttcattaataaaaatagtgatgttgttaaaatatatttttcccatgaattgccattaagacaattttcattttgaatgcaaacaaaatgtcagcctatagttgtttcttgacttgtcctgaaatcccttagtcaccattcttctactgaagtgaatatctcccatctatctatctatctatctatctatctatctatctatctatctatatctgcacaggcataccttagagatatcgagggtttggttctaggctactgcaatacaacagtattgcaataaaatgagttgcaggaagcttttggtttctcagtgcatataaaggttatatttatactatactatagtctattaagtgtgcaatggtattatgtctaaagaaaaccttaattaaaaaaatactttattgctaaaaatgccaataatcatctgaactttcagtgagtggtcatctttttgctggtcttgcctcgatgttgatggctgctgactaatcaggatggtgactgctaaaggttggagtggctgtggcagtttcttaagataatgttgaaggttgctatatagattgactcttcctttcacaaaaggtatttatggcagatatagccttacaaaatgtatttcttaaat

SEQ ID NO: 122293 - DNA, 1059 bp, Homo sapiens
tctcaaactcctggacaaacacaatctgcctgtctcagcctcccaaagtgctggaattacaggcgtgaaccaccattgtccactcccagctctcttatgctgcctctgccctcctgtggtgcttaagacccatgagttattctttctggtagcctctagtttctcactccagggtattagaaattgggctattttaaaaaaaacccagatgaagttatttggggaatttgctgacagcactttttaggcaatgtttcagaaaacatgatgcaaattttaatttttttaaactgatatttcagtggcttgatatatttaatattgcaactttagttttatgaatcttgcatgagttctgttgttttcttgtcatctcattatattagtttttgagcaaacatttgaaaaattttaaaaatgtatagtataagggaaggattgtaattctgagccactacttgtttaaaaaggcacttcatttgtttggattgtaggaatattgtaatacagtccagctagattctgggatagattaccggaaaagggaacttcctgctgcaggaaaactctactacctgtaagtgtttctaatttttaaagtttaatgtctaatcgttaatcagaaaaagaacataaaaataagcagtttaattattggaacgtgaaaggctggttctgaagcccatgatttttaaattgcaaatgttctcatgttaacttcttcaacccgtgtctttaccatccatatttgcatcatttataatgtgtgattggacaaaaccctaattagttttttggggtggaatgatgacagatggttagaatgtaatgagtatccttttataagagactctattattacgagaatatctttaatgtgtgaagtaattaattatttgtggatatcatctgacaagtgtgccatttccgttccccccaaaattgttgttttatttgtcaatctgtttgtatttatcattgttgattgacttccatatataactgatctacaatatatatacacaaatacaactggatatatttttgtcttttaaaagc

SEQ ID NO: 122294 - DNA, 1034 bp, Homo sapiens
ctcgggagggtgaggcaggagaatggcgtgaacctgggaggtggagcttgcagtgagccgagattgtaccactgcactctagcctgggcgacagagcaagactccgtctcaaaaaaagaaaaaaaaatcacaaaaggctgggtgcagtggctcatgcctataattccagcactttgagaggctgagatgggtggattgcttgagcccaggaatttgagaccaacctgggcaacatgtagagacctcatgtctacaaaggttaaaaaaaagctaactgggcttggtgttgtgtgcctgtggtcccagctgcttgagaggctgagatgggagaatcgcttgaacccaggaggtcgaggatgttgtgagccatgattgtgccactgcactccagcctgggtgacagagtgagaccttgtctcaaaaaacaaacaaaaaaaaacactcccgaatcacaaaattgtacatttggtataatttagatgtccttctaaatctttattaattaatcttgcattaactcaaaaactactgaactagaaattaatttcactatttgaaacagcacctataaagtggtacagcaacaaaagaagtccatctaatatagacttcagtaccaggttccaccagtcagtttagtatgccttttatctcctattcctttattgaatagtgtttgttttccagcaggagaaccagaatagagctggcccactaaatccagctaaacacatggacaaaatatccaattgtatggccacagtcatctagtagagtgtaaataataattgtgtatatatataatgtgtatattagtagataatatgtattcttacacgtataaaaatacggaagagggtatttagatttccttagaattttcattgcattatttcatctccaaatagatcacagttataactgaagatcaatctgctgcataagaaaagctgatctggcaaaaaccctaggtctttagttatttgctgtgttcatttttagctattaaaactccctggcctcagccgggtgca

SEQ ID NO: 122295 - DNA, 1032 bp, Homo sapiens
caggagaattgcctgaacctgcaaggcagaggttacagtgaactgagatcacgccactgcactccagcctgggtgacagagtgagactctgtcaaaaaaaaaaaaaaaaaaaaaaaaaatccctggcctctggcctctctttcccaagtggatgtgaccatctttttctcctgaagagaggttagagctttttactctccaacttcttctccctcctttttttttttttttgaaatcttcaatcattatatcctttctgaaattccattttaaaaagaagtatttttatatctaccaagttgcaattctagatgtcatggtactgatttatttggggaaaaatacaatatatagatttgatagaaattttatatgggagtttgtggctgagaagaggaggtgaaggtctggaatttgagagctaagggtgctagataccactttctgcataatgtacaggtcaagattaatggaaccaggtaagttactctccaggtgattgagaagggtgggaaatttagagactgaaatggatctctgaacagtcagttaagcctttgagtgattgagaagataaatactcagacaaaatccattctaacaactgatttcgttatgtaaaacaaacctacaggatttgaaatgcaaccaagtctgttttatattaaggcaagtataaaccaacttaattttagacctgcctccagccccagattatgtttggtataaggacaaagagctgtacagcatgaatgcgcaggcaatcagtagagtgagaaggctcactgccagggaagtttggcaaagaactctaagaggaaggggaaatttctgcgtcgaatcaactttggctctctggaatagagaacatggagagagagggactaaggaaagccaaccctattctacttgttgataccttaacaagctgttgatttttgaaaagggataaagaagcaaagtgtgggtagcattctgttcccttgagtcaatcctaatgaagtaggaggttcttgaagaaattaatttcca

SEQ ID NO: 122296 - DNA, 1050 bp, Homo sapiens
gtaagagatgaattttatagtaattatccagacaagattgagtctttgttcatgttcccatagtaactagaccaaggattctaaaagtgcaaggcagagagctgcgcctgaataaagcctgtggaaccgttgccgactgcacatttgaagagctgtgtgagagagtaagtatccaggcacgtccagactcactggccttttcacatgttaaaatacttcgtgttttcctctctgcccatttcagattttaaaataccattcacagagtcagaatcgatttaaaagtctcattaagggaaatactcatctatttttgccatgtgctttttatagatattggcacaaaatttgcacttagaggggctctaatgcaaaattagaaatgcagagagaactgtcaactgttgctagaagcaaaaataaaatcagttttggggctgttttgtaaaagtcaaacataagagattttggaaaaatatttgaggtgagagttaggaaaaaggaagatgaaataatgctatcatgatccaaggaagcatcacataaaagaatttccactccttgtactgattgcccatctgatattgccataacattggacctactagggccagggtcaaagaaggtgaatttctataactgtggcatctatattatatattaaataatatgttcaacagagaaaaaatgtttagctgtatatgcacacattcatataactgagaaagatcttgactgcagattcattatagatatgaattctgtcttttaaaaaatctggaattctaagtacttcagtggatattcaatgtatttattgattgcaaatcttgaggaaaacaaatccaaattagatataattttaagcataatttttcgattgacatgcttaatttatcattctagctggtctctgatttatcttgacttttaggtaactaaagaacagttgcttttcagtaagggaaaagacaaaatacttatacctgcggccattttatgagtgcttttcttaaaagctagtgacggccgggtgcggtggctcgcgcc

SEQ ID NO: 122297 - DNA, 1044 bp, Homo sapiens
gtgatgttattatttgttgattttttttttctccaagttggccagatcttcatttgtcagtgagtttgcatggacaggtttgccccttatctagactgtaattgtggggtgtttactacattacacaagcactgaatgacctgcaaaaggcattgacgtgataagtggggttaggtcgcagtgttaagctatgagggatctttcaggaagggctaagtttttaagtagctagtttgtttatgactattttcttgttatgatgattttgcattgctttgcaaccttgtaactgcaattcagatattgatttcttgcatgaagaggacaattgaaatccctcaacttcagatgtagcctaaaactcttaatgagttataatgatcttatgagccaggctaaataattgccaaaaaccattaagtaaagataaaaacacatccaacctaaggtaaagaagcaggcatctatctggtgtgcctgggacagtcccagctttggatcatctatcctaattttctagaaggctcttgaagcccaagacttgcccagtcacctgataccatcatgaaaaagtctttggcaaggagtagattggttaacagtccataatgactatttttgagccatggccccttccaaggaaaaaataatacagaaacttacctgtgtcttgataaggtaaaagaaggtttagattggaagcccttgacatatgccataagtaaaatgaaaaagcctgacacattctgctgtttgcacacctcttccctcactgttccaagcacagttcctcagatttagaatcctgcaggttaacatctagcttcttggtatctcctggattctctttcttcgtaaatttgtaattcagtaccgtcatgttcagcagtctgagttaggagaccctgcaacacatacataataataataatgaatatagccacacatcaggtatcattctaagcgcttttatatattaactcatttgatacttacaataggtaggcactaatattgtccccattttataggtagagaatttga

SEQ ID NO: 122298 - DNA, 1026 bp, Homo sapiens
ggaaatcatgaggggcatctttatcatctcttccttctctgaagttttatgtttctggggaaaacacaagagttggggctgggcgcagtggctcacgcctgtaatcctagcactttgggaggccgaggtgggcagggcagattgcctgagctcaggagttcgagaccagcctggccaacatggtgaaaccccatctctactgaaataccaaaaaaaaaaaaaaattagctgagtgtgatggcgcacatctataatctcagctactcgggaggctgaggcatgagaatcacttgtacccaggaggccaagattgcgccattgcactccagcctgggtgacagagcgagactctgtctccagaaacaaacaaacaaaaaaccggagttggcaattacagagtatattcagagaactacagactcagaaaggttctacttccatttatgtcagagtagctcctatttgatcaaattacctattgatcacctctgcaaactctggacaaaatctgaaaaataactatccagaaggcactgcttatcaaaagcagggagaaagtagagcacagccaacacttggaagaaaggattgatactggtgagtttctcatttttatagtttttctcctgagggcagatcacagttagtcttatacggatgtctaaaactcagtagaaacctgctgtttttagctcgaagaaccagagaagagcaaatcagtgaccataacagctggaaagtataaggagaaatctgggaaaggagagaaccacagaggaatagcctgaaatttttcctgtaaactctgcccaaatcttgggctgacctgtgaaatatacatacacagcaaatgctaaaataactgaacggagattttcgctgctacgcatcatggaggagacagagtttggagcttgaggctaaccaagttaattacctgctaacatagcaacaacaacaaaaaatcaatatacttaagaatcccaagtctccacgacataccatatacagtgtccagaatacagt

SEQ ID NO: 122299 - DNA, 1081 bp, Homo sapiens
atctcagctcactgcaacctacgcctcccaggttccagtgattctcctgcctcagcctcctgagtagctaggattacaggcgtgcaccaccctgcccagctaaattttttttgtatttttagtagagatggggtttcaccatgttggccaggctggtcttcaactcctgacctcaagtgatccacccatctcggcctcccaaagtgctgggattacaagcatgagccaccacacccagccttgtttttctaattattatatttattattttggaatctggcacataaaaatagtcttaacatcaattcgtgtgatattttcagtttgttttgaaaaggatacattcatcctaattccattcaagcattttctattaaaaggtacttctctttaagatatgaagtattgtcattgccatgtaaataaagtaagataccacgcatgtttgtttaatgaacagctatcagcgtattcctacaaagggtttataaggaggagtctatacagataaagagtaacccttaggaccgtataatctagatagagcttgaaatcataatcgtcctacttcagctgaaataatggtagcagagcagagcattagtgaggcagaggaaaaagaaactccagctgacagctcatttgggtatactgaagtggatcattgtagggcagaaggtggtctgatggtaatgctcgtgcatttcacattggtgtggcattgagaaaattcccacttctggcaccagggtcgataccaaagcagacaactggaccatttcacatataggagaaaaaagacagcaagcaagctctttatttttaagtttgttagagaaactgggctacatataatcaagctgtatactcttggtaattaaggaaaacaaatactctttgcaaagtcattatagatttaaagttctttaagttttcatcaggtttccacagaaacaaagagtttgaaacaatagtggagaatgcacaaaccatcgagtaagtggattttaattgttcctgttaagaaaattattcagataaccagccacatcaaagactattaaactttttaattgctcag

SEQ ID NO: 122300 - DNA, 1049 bp, Homo sapiens
acataaaattgaccattttaactaattttaagtgtacagttcagtgacattaagtacattcatattgttgtgcagtgatcaacactgtctacctctagaactttttcctcatcctagactgaatgtattaaacaacaattccgcattcccccaatgactgttgtcttgaaaggagaaagataactctactgagctttgttttctttatgtgaatgagcatgtaattgttttagggatatgaggggaaggaatagttgctaatgtaatggcaaatgcagaacctactgacaaaggtatgtaatttgtaaaatagctgaatgggcaaaattctgatttttcagttgccctaggcacttcagtgcacttctgataatgattttccttgggcatgtagttattctgatagaaatcacatccatgcataacgagtgagcttaattatacataactacatacataatatgaggttttacatttttttatgtatactttctggtttacaaaagatgagacactaaatcctaactgatctcaaaaaaagtagtgtaccctcagagcatgagagtcttaatgtatgagttttcctttttacaacaagacatgtattttgccctcccctctctcgctttcggggattgttttcactatttggtgattccacagtctcatctggtgcctgctgtgactcccaagacagacaagtgcacaaaggctgatttagggtcttggattcctcttgagaatgacatactcaattcatttgtactgatcccaatcatttgagctcaaaataataaaaataaaagtagccaagatggtttgaatactaatgtatgccccaggcactgtgctaaacactttgcatatattactttgtttaattctcacgattctgtcagataggaatcaaatccccattttacaaatgggaaaactaaggaacaggaagatgatgtaatttgccagtggcacccagttgataagtagcaactgaggagtcagatccaggccttccagagccctcactcccaccttctctattaacacgt

SEQ ID NO: 122301 - DNA, 1050 bp, Homo sapiens
gtctttttgtaaaaaggaaaactcatacattaggactctcatgctctgagggtacactacttttttggagctcagttaggatttagtgtctcatcttttgtaaaccggaaagtatatgtaaaaaaatgtaaaacctcatattaggtatgtagttatgtataattaagctcactcgttatgcatggatgtgatttctatcagaataactacatgctcaaggaaaatcattatcagaagtgcactgaagtgcctagggcaactgcctatgggtaacttggtcaagttacccacagctaccacctagatcacaccatgacaagaaagaggtgtttttacactaaaccactccaaaggcaaccagaattggtttatttttaagttttcttttatttcattttatcatagccacttggagccagtgactatttggaactatcaaagaattttgatacaatatttttacgaaacattccgcaatttactctggcaaacaggactcaaggtcgaagattcataactctcatcgataacttttatgatctcaaggtaaggatgtagtacattttcttaaaactaaacactttgtattgtgaagccagattgcctgggctggaaatcctgacttaacatacttctatcacttactgcacctctttgtgcctccattccctcatgtgtgaattggggatgataatattatttacttctgagggttgttgcgaggactaaaaaggcaaatccatgtaaagcatttaaaacatttggcacaagctgaatgctgtataagcactatcagtagaagcagcagtagtactatagtaaagctcccatcacaagacactctgctatatgaatgattgcatcattctaccagacagcttatgcgcttcatctatcacgttctaaaacacaatgtcttgcataaactgaatgctcagtaagtatttgttgcatgaataaatgattgcactgatagaataatgcatgagcaagccaggtgtgatggctcatgcctatcatcccagcactttgggaggccaagggaggatc

SEQ ID NO: 122302 - DNA, 1050 bp, Homo sapiens
aagtggtgaactccctccatcaaatcctgtataaaggcaccgaatcccatgcatgaaggcagagcctcatgactcaatcatatcctagaggccacacctcttaatcctgttgcattgtggagtaagtttcagcatgaattttggatgggacaaaaacattcaaaccagagcagtaatggcaaaagcattggactaagaactgaagatctgggctgacatcttgagctgagtcctctccagccctgaagtctcccaataaacctttgtgccctacttcacagggtggtatgagttgtgtggaaatattctgaaaagtactatgcagttttaaaacactgctttaaagagataaacaattagggaaaaaaaatggacgtcttaaaagcaaagatccaagctcctgtatgtgaaaaacagacttttattttgtgagatttttcttaccttcaacttgtgaaatgtaaagagtaacacatttacccattttcttctatttcaggtgcgtataatttgctctgcgtcgactcctatatcaagcttatttttgcatcaacatcatgacagtgagttggagcaaagcagaatactgatggatgatttggggctgagccaggtaggcgatattaacataatctctttttattataaaacagcttaattgtttttggtttgatgcatggctacattttgaagaagaaatgcagtgtatagttaaccattgattggcgcttcttctataagcccatgtagcaaatttatcattctcaatatcactgaatatagaaaattataaacttacagtggaaggaaccttagtggtcatgtagttcagtgctccattttgcatgtgataaaaatgaagcccacggaggtggactaaggtgcccacagtcacactgctgaataatggcaggccagagctggatgccaaaccacctgtgcccggttctgggcttgctctgctataccatgctgccctttctgggtatctttctaaatgattgctggatttgtagagtgcatgatacagtatccaagcatgtaggctgg

SEQ ID NO: 122303 - DNA, 1049 bp, Homo sapiens
ttcagccctggcttttagatcccaggcacattctccagaacccagacccactgctcatttgcatttgctctcctttagtcattggttggattggaaaacgctctccagaggtttgtccttagggcctcccccttaggcactgggaccctgtctggaggcctacaccagcctctttctagcttctcagaactactggttttttttttgccattacttatttctggtgtacacttttggagaaagttttcccttttaagttttctctctgataatttgatgtgtttactgcctatcagtttaaattggttgactctctagtctcatttaagagattgtatatggaaaaaaaaagttataaaaaaaggcataatctaaaccggtaagcctaaaaagtttttttaaacctatacttaggttctgtaaattttcatttgtgatagctttattttaatttctttgttttataaccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaatctgatataaac

SEQ ID NO: 122304 - DNA, 1029 bp, Homo sapiens
tgctgcccccgcccttgccgccaactctgccgtgagatggacctaataggaaataggaaagaaagcctgacaagcctgcttcacaggaaatctgatttgtccttcactgagctcatcttttgcttctttgagtaaaacctggctttactaactattgtcacaaagtggatcttcggctgtggatgagtgtgaaaaacagaaaaaatataaaatccacaaaatcttgtgaaaattaagcatttgggggaaggtaaggcataggtgagtcagtccaatgaatacaatggtcaacataagtaagctctttgaacctatttattttctatttattattatttttattttttatatcttggccactctagccatctcctggcaggggtagtgtggcacagcatggccctatttaatttcttagtcaataatccatcacatagtctcttttagatattaacctaattaaggcaagcaggtagatggatgagtacccaagccgagagaagagtttaaatcaagccttctgtaaataaaatgtggtttaaagatatttttattgaagtgaaacacagtaatttcaaagaggttacgtaatagggagaaaggatgggaaataaccactttgtgctggattgaatgctatatatttacattagctcagttaaaaaaaatagtcttagaaagtgaatattataacccctgtttaaaaataagaaaactgagtcttgggaaagttaagtagcttgacctgagattcacagtttacaactacaaaactcatatactatattttataacacactgtctcttactcttactatttaaaaaaaagagattgttttaaaaattgattcatttaactcagtgaatgaagttgaagataaattcacaacagaaccattgatttgaactcagtgaatataaaatgtttaactttattctttagatcttagctttttacttttcacattcctttggtaattattctgtatcttaatttttaaaaaaatcatgtgaatggacagacagata

SEQ ID NO: 122305 - DNA, 1059 bp, Homo sapiens
accaaaagtctacacactagttcataaatatattttttaaaaaatccttgtaagtcaccggagatagctcagagtgtagaagcgggctcctcaacgaccccatacacaaaaaggtccagcccagcgtacgcaagagccagcccgcccagccgcctccgggctccgggctttgcgcagcgcccgtcactcaagtgacgcgcggccccgcccctgcaccaagctagttcgacgcgtacaaacagatgatgtcatcgtatccacacgcgcgtgaccccggagctctccgccgcgtcgccattcgctgcgccgcttactcgtcaaggcacgccgcgcgctgactggccgcggccaccagtctccaggccccagacgcccctctccgcccccccgcccccgccccccagcaaataataaacaatcgagtaaaattctaaggaaggagagagaggagagggaaaaagggagagggcgcactagaaaccaatccttcgcgcgctggcggtgggagggttcaaggggggacgcgagaggacagcggacgggaggaaggcagccgacttggggcggtgggtctgccagcgaagaggaggcgtcgggggaggaaagttgcagcgcactcgactgggcgcgcctggcggggtagggggcgctagggcccggagcggcggggctgggggctcgggggcggggcgcgacccgccgagggggcggggactgaatggcgccggccgacacgtgcgggaggagggcgggcgcgcgccacacacactgggccggggcgcgcggccctggtagccgcgcgcgcttgtttaccagcgcacgtgggtgttatttttaaatggaatgtggcgctggctgcgctgccgagtggcgggcgcgtggggccgcccgcgctggcggagggacgcggcggggcccgcggcgcggcctctccgggcgctgctcgcgagacagctaggctgtccccactgcgcgccgctggcatagccggcggcccgggccggggaacctgattgagagtttcgcgcgctgcccgagccgcggcggagacgacggttt

SEQ ID NO: 122306 - DNA, 1784 bp, Homo sapiens
ccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaaggtgcgtacccaccccgggctggcagcaggacccgccgggcctcctgcgcagcgcgagacgcgtctcggattcgtcggagtgcgcttgcgggctccagggcaaggggttggcagggggagcctccgctgcgaggctttgggggttatctttgatccccggagtcggggcacctggggacggtctcggaggggtgaatgaggctccccagaagcttggggcatggccaggtgaggagagggggcaggggacgccggcgagggaagggcgaacggacaggagtacatttgctggattctccggacagcaccgaggaggtaggtccgcagccaactttggagtagagtttaccgtagtgggggtctggtgcgggcgctgtggctggagtgagaggtgtgggggtgtttgggacgcagtgtctggaggaggggttggatgtgtggtttccagtctgtcgcaggagcatgttgcgtcgtcactagctgaatgagaaccttcgggtccaagtttcagcttgtgggtgttaacacctacaggcacatcgatccgattagaaaaagcagtggttgcaaaccttttcctggacggcttcctttccttgcctatattgataccttttcttctcggagatgtcgctccagtaaacctgcttctgactagctgcttctgaaatgttctggggcctcgaaccggccggtctggccacctcaatccagactggctgcacccgctgctcccgccgaggcctggattcaggcactgtttgagggaagggctctggtgtgggggacgcggggcctgcgcttcattcactctggcgtttgggaggaggtttgggggctgggccgggccgtaatggcttctacctgtaaatgaacccgaagagagactctctaccgttccttatcatcctcttggggcacgggacacgtggtagggagagaggtgtggaaaggcctatgatgtaatgacttcctgcagttgggtatccaaagagattaactcctctgcccctgctgggctgctgatatccagctgctttcctcttcctaggcacctccctggccccttcccccaagacagtgtgtgtcagtaccaggccaaagagtcctgtgcgattggagatatacatctcttatcagctgcccatatttgcaatttagcttagatttttttttgttttgttttatg

SEQ ID NO: 122307 - DNA, 2915 bp, Homo sapiens
aaaatcttagaaaatactgtaaattgaaattctcaaggcttaatatgcttaatacagggcacacattttatgattcttttaccttaaaattttttaccaattccatttctgagtgtcacatgacaactaatccttgacgactaaagggatataattttgttagagtttttataagatgatcttcatcaaaagatgcagccatgcaggaactttcaaatctttgatgatggagaaggccctttgaaactggagctggttttatattttgattatgactaataggcaacctttttttgtgtgtgcttgtggtttagtggaagaagagggaaaagggagagatcaggagctaattgtgacccatttccaagtgtccaagtttaggagttgattcttgtcatgattagtcattttggaagcacgcatgtgcatttaaaccacactactttcattctgagtaatgtaagaggatttttaacttccaaaaatgtctagaattcaggttaacgtctcctagtcatgtgtgcataaagggcacggtatgcagggccttacttcttttcaggctatttgggccattgcattatgagaccttgtaaccaaaattatcaccctaacatcataaaatgaaagaattagaaaagaggacttagagatcagaatctaaatcagtggttctcagccctggttgcatgtttgaattacctgggaacttctgaaaaatacaaatacccagagaatttgatataatttggcttgtgtgtggcttagcattgatggttttgtgttttgtttttttttttcaagtttcttaggtgattctaatgtatagttaggatgaagttttctgatctagttcaaccctcttattttactggtgaaaaacctgatttttggaaaagctaatgactttcttaagatcacacagctagttagtagagaggtaattagtagccacagttctagaggtttttgttttccattttcttctttaaattgatcttttttaaaaggtcatttgctaggtaatggatagtctcacataagtagcgcttgctttcctgaaaggcttatttgcctctcaatctaaaaacatcttgcttattatttcagcatcaaaaggatgggcaaatgtagatggaggctgagtgagtgtatcatgtttgcatagctgtccagtgcctgtcagtaggggtacttaggaactatgaagtgataaaagaggtaagaaggatagcattttaacaaaaagaggaagcccttggttacttacatttgtcagatactgtgtcagggagaaggatgatgactatctcacaggttcccttacctcgggcattaaagtagaaatgaacaatcagatgtggttaagaggggaaaaggttacatttcctttaattcagattaagcttgcactgcacccatgattgaacaagtgagttctctcagttcctcttgtcttggggagacctctaaggacgccagggcttacctggtaaggcctatctatcacttatttcgttatacacagcacacatctgcttttcccatgggtcagggtgtaatcaaattaggcagacttgagtttctgtagtggttcccataatttcacaagtgtgggggatactgtgttaagatttctgctgctgctgctgctgcagaagataattcttcaagagtccgagtcttctttcatgtaagaatgtgtattgttatggcttcttgccaagataaaaagatgagggctgtcctgtcacataatgcttatttgtgtcctcactgtttctgttctttagattaatacatccagttccttttcaacacactgtattaggaaaatgttattttaactgcaactctgttttaaatttttttttaatttgaaaatgactaagtcataatcattccacattggctcataattttgacctcagtcaccttttggagtaactcaccaaaaggccagttatggtcgtgtgtgaagaatctgtctgcttggcccgtgttgccaaaatgtcgttttgtaatttcctttggcaatagtgtcttcgtcagtgattctcaactaatatacttcctctttctacagccccagtacactagagggactgtttttcctctttttcaaagctgtgtcattgacctctgaagtgaagaaattggcccttttagactttgatctgtgagtcccatgtaacagagactctttaaaaaagaagctaagtgtgtgttttgatatgtttatctccttcttagaaaatgaaatgaaactacagcagacttatttttaggagattttaggagtgttctattttaagaaaatgacaccatacaagaacatcttttagttaaacttcttagtactctgcttgtgattcttacttaaaacctgcaagatacttttatttggaaaattaatgaagaggccttgtctcactaataagtcatttaatttggtctggcaaaagtttaccatccattcaaagatcttcatgaaaatgcaaagataaggctgtttaggcttgagcccaggagttcaagaccagcttgggcacatagcaaaaccccatcttattttttttttaaagactgtttaggcctgtgcattctggcaggttgccccacttacccagagcaggtgcatcagattccagattcccagggctggagagaatatggaatttattttgtttgtatacccacttattttgcctatagggacagacttgaccctattctcaactcctcatttctctccttttcctgcatcacaaattgaggggtcctgaagagccactttacctttttggtgctataaaaggagctggggatcataaatgcaaagacgagttgatatcagtggatgttacagctggtatacagtaagtgaatgaaagattggaaagagaaaacccttt

SEQ ID NO: 122308 - DNA, 1113 bp, Homo sapiens
tctctacttaccttgctaaatgccttttctttcaacgccaccttaccctgcccaccccatggctgctacctgtttattttgtcattttgctaagactgttgaatatttttaagcacagtataagaggctttaaattagggaatgtgtctgccagacaaataagtgtttctaatatttggagctgctttttggattttataatcaacccatatggatagccttagttctggggctgtgactctgaaaggggctgatgtgactcaggagtgagctggtgtcatgagtggagtcttttggatacttgcagctctgaaggtggcatcagctttagacctcctagcatcgatgttgatgtgatgtggtgtaaatgtgagatgatgctgtgctatctggggtttcttgcagtgccttgttacccaatgcataagtctctgaaaactccataagtgtccatcactacttaccacagaaactgaaggaagcctgatcttgggatgaccttgttgcattaagagaaaaaggaaatgaagtttgccatctgtatgtaaacccgctatttgtatcatcaacatgcagtgtcgagaaagtcaccatagaattgttttgcctaaagtttattttactcacttttaggaacaaagctgttatgtaaagccttagttgtttgtaatgttctgcattttggggcagaagtcccaaatgtacttcaagttttctgtccatggattgggaaatagaagtcatgtatgaaaggagaggagatagcagacagtctttgagatgaactatttcaaggaccagtctgcagttcttccaagttagagttctgaatatgtggttaggctagtgatgatgatagaacaccccagttctgactgcatcattgcccagacagacccagtatctttcaccattttattcctgaccaaacaacgttcatttcccagtatcttagtctctcctaaaggaaaaagaactacggtagctggcatccatagagtactgtgatgtaccactcttggtaaaacggaaatgtctgattggagtgtgtttcaagccaggcttttctataattcgcttgttccacttttcactcctgagtttttgaggttt

SEQ ID NO: 122309 - DNA, 1132 bp, Homo sapiens
tgctgggattacaggcatgagccattgcacccggctcccttgtgtatttttattttaaattttttatttgagacaaggccttgctctgtcacctaggctggagtgcggtggcacaatcatagctctccacagcttcaaactcctggctctctctgtagagagctatgatcctcctgcctcagctgccctagtagctgggactactaatgagcgccacgacacccagctaattttatgttttttttgtagagatatgaggtctcactttgttgccaggttggtctcaaactcctgggttcaagcgatcctcttacttgggcctcctaaagtgctgggattataaacatgagcccctgcaaccagccttccttgtatttcagatgtctagtgaagttagttaagttagcccttgaaggtattgagaatttactttaaattcagagccagcagagggagtacacaagtctttaagctgatgtcaagtatttttttctccacacagctaaaataataccttgattattttttaaagaactctgatatatagtgtttccatgtaagtttattgtcatcattagaaaaggaaaatttaggagagggggtgtggagattaaaaacttaaagcaagtgttttaaaggaaaccctggtcttctaagacccatgatttacttcccactcctagatcattaaatgagagtgcttttaactgaaaaatatcctcccctgcctttcatctttttgctactcagttcctgatactacatgttcatttatacctaacaccaaatttttacagagtagtcacgtgtctggatcagtgggatgttctgtgttttagtgctattttgattgggacttttgatattttccaaagcttcacagttgctcatgggtgagagaaatgtatgtatgtatattgctctcaggtaagagagaaaggtaaggtaaaaagtaagaacaacattatttccaattcaaaaatgaatagtcatggatctacaggagactactgtaactttgaactttttgtaattctgtaatgctatatcggtttctcacctccctccactatgccccatattttggtggtgggggtttatttttgacatggcagttggagagggttaaata

SEQ ID NO: 122310 - DNA, 1619 bp, Homo sapiens
tcaggaggctgaagcaggagaattgcttgaacccgggaggtggaggttgcagtgagccaagatcacaccattttactccagcctgggggacaagagcaagacttcatctcaaaaataaataagtaatgataataataaagacttatgatattggccgggcgcggcggctcacgcctgtaatcccagcactttgggaggccgaggcaggtggatcatgaggtcaggagttcaagaccagcctgaccaagatggtgaaatcccgtctctactaaaaatacaaaaaattagctgggcgtggtggcacatgcctgtaatcccagctactctggaggctgaggcagagaactgcttaaacctggaggggcggaggttgcagtgagctgagatcacgccactgcacttcagcctgggcgacagagcgagactctgtctcaaaaaaaaaaaaaaaaaaaagaagaattagcgcgtacctgggtctttaatgggagagtaggaatggcttgagaattctgtcagaaacctgttggtttggtgattctgcagttctctttggtcactgccaggtgtgaccatggtttactatgggtcagaggcacagtgtattatttagaagaatagagtgacgcatggtaggtagaaatcttttgggatggggccttatcgcagaaatttctgtgttgggacagtaggatatctgtgctttttataggcttcaagcacgtagatgaatgcaggcagcaacatcaagaaaagcagatttcaggaaaaaaaaacatttacaaggagttcttggcagaagttttgctgccaaatcagaaatcataatgaaagatattaaaattattttgtgaggtggtcgtctctttgcagtgcagttactgacgggtttaagagcaggctgccaagatagagacagaaaatgttgcataatgcaagttgctggccaggttagtgtttatctctactgaagagcctacttgcttttgtcttcaaggtaaaaatatgtatgaataagacctaaaatggtggttttaattggccacaggaaggcagtgccgtaagataaaatgtagttaacagaatagaatgctaattatcccattttgttctgtgtatgttggaaaaaaattacagaactctcagtttcatagtaaagataggtaagtagtgtctggataatgtccagaggatagactgaaactctgtgataaacgtgagcaggcagcaggatgctacctgataactgagtataacagcatgcaggggaggactgtgtggctggaggcagctgcagtagaagttggcagtgccactgtggacttttaaagggacaactctgggtacaagcctgaagtgtaaggaggacataaaattaaatacaattgagcttgtctccttgaaaactggttctctctttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttac

SEQ ID NO: 122311 - DNA, 1133 bp, Homo sapiens
agtttttatcttacacatagctgttctagggcttcccaccaacatttatttccaaaccaaggacttgtttatctcatccttcatacttttgcatttcagtccgaattggatacgggtttttgttgtctttgtttttgcagtagaaaaacttcagttggtaggatgaaaaggagaacaaatctttattcactttcagtatagttccattaacagtattaatgtgccatgtgtgaatatacctgtcatgcagactgaggcccacagactaataacattttgagcaagataattttaagtaaaaactgaagctctgaactcaaacattctttcaaatttctttaaaataataatgatcacttagatgaggtgcatcatttatgtaaccctgaaaagcctggaattgacttacgaaaatgtcataggcctgattattttaaagttatcttcgagctgatgctggtgtgagcatgtttgctttagaacacatggactcttaagctcatgatagataatttcctaggtgagctagtatactgtttcttgaaattagtggccttgatcagcccttctctctccaagcctgtccaataaagataagtttacagccttctttttgaatagacacatgtcctctgctgaactgaattatctaaatcagtcctatttagtctcctccccttacaagaaagatccttatttcagactgaaagactaggtgatttgggccatattttaggttttatcatacttacccttcatgtcatttgttaaggtcaagttcagcatttgactgtggacataatttttagtaggtgttccttgggaagaggcttattgggaagagaagtttattccaatagtctcataaaatcagtgaatgctttgagttaatttatcagcaacctgtgctgaataagcaaggtgccatgtgttaaattaggaaaggtaacgtgctgctagtgaaaactgtgtcttctaagttggctttaaaataaattgtttaccagattaatgtttcaatcaaaaattacaattctcatttttaagatgcagctttatccacatctaagttttctcatcagccaaaaaaaaatttaaatggatgaatctgtttagcttataatgcagtggaa

SEQ ID NO: 122312 - DNA, 1034 bp, Homo sapiens
tccactggtcaccttactccaacatcagtggttttcaaccctggctgcattttagaatcacctggagagctttcaaaaccaccagtgcctaggtaccatcctaaggcagttaggtcagaatctctaggtatggggcctgggcatctatgttttttaagcttcccacgtggtgataatgtatagccaggattgagtgcctctattttagagacattagattttggctgtggaagttatcagctattttagtactgacttttagatgcatttcagccctctcctccataggaagctccacatgacaaggagtgctgtaaagttgggattaaagagtaaggttggcttctaagggcaagagcattattatcacttaacaaactgtgtttaactggggtctcctcttctttaatataaatgcatgtgatgtctttagtttccaactcccactcatttttctagtctctactggaccctagttaagttattttgaagttttcaggaatttttaagaagagatggtgctgttttaagtcattgcataagacttgaaaactgagagatataaacttactgttcttttgtgcaacctaatctgatataccagaagattccaccatatcctgatgtttgaaggtaatggttctccaagtggtccctagctcagcagcgtcagcatcacataggaactttcaacatcacgtaggaacatcacgcagattctcaggcttaccccacacagactaaatcagaaactctttaacaagccctccaggtgattctactgcaagctgagggttcagaaccactcttttaaagtcatttgctaagtctgtggaattattctggtgataggagtaaaaaatcttaacgtcgcttgccatcttggcttcagaatcatggcaaaaatggggaaaaaatatggtggtatctgttgaaatataacaaagctctagccccttgagtattttggacttcccacagatctgtgctgctctgtagccttctgtacaaggcaaggatactcacctctcagg

SEQ ID NO: 122313 - DNA, 1006 bp, Homo sapiens
cttcttgggggagtgggtagggcaggccagtcactttcctcagattcaccaagattcctgggaagggtcaagaaggcaggttcggtgttggaacaacatcagaaggtccacatggaagggaaagctgcactgagggacttctgtctggggtcagagtttggaggaaagtccaaaatattgtgctgttaactgtgaacagcattccaaattgaactccaggagagtaccagggacttgtacacattggaagtcagatacagctggtgggcactggaagtgctggggacagtaggatcctttccagagccatcaccactcacaggtgaaatgtgtcaacacacgtcagttgctcatccattttggttttcccaaagcatgggcctctgcttgcatgttctgggggcaaggagagagggtatcttgaaaggatctggcatcaggatcactttcacagaggagtaaaacatctggtagcagtccaggaataaagcctgcccagtagcagtccagaaggcttgtctctcagcccagagaaacccccagtccttggcttctgtgtctcagacctggagataatgagggacatcacctgcttgacccctctttgaacatttccttaaggaggctatagaggaggcctctggttttgagacggtcggtgtcctgacttctgtgtgctgctgaattacagagttgaagtttgaaaactcttaattcctccctgcccaaaaggggcaaaaagggctaaatcttccttctgtgttggtgtgaatgggtgtgatgtatacagtcataaccttagatttatctatcattttcatggctgtaactaaaagctacggttaattgaacatttattagcagtgtgccagacactgttgagctttatgagtattagctcttcttcatttttttttttttttttttttttgagatggagtctcactctgttgcccaggctggagtgcagtggtgtgatctcggctcaccacaacctctgcctcct

SEQ ID NO: 122314 - DNA, 1131 bp, Homo sapiens
gtgacccagctcatctttcacagattcagaaatgagacacatagatgagtttactctaaactgcacttaaactttcctgtagtcattgctttctctccctgcccctgccccttctgtggaagttgaagcagactaattgtatatcatcttttgttgaacagcgacatcgtgcttggaagccagtgggtcatttgggtctagttttcattcttttctttggatctgcttcacagtttaaattaggcccaggacattgtatatggtggtttaagaaggtgactgtaacaggcagatgttgaaagatggaagcagtaggaggaggccaaactgtggaggacaggggtaataactggattggcaaatgggggttgaggagcatggaaggcagcccagtcagaataccttggcagaggctggagggttgtagttgtgtgattgtgatgaaatattaggggtgatggctgggtttggaagagttaagccgttacaaaatttcttcaaagaacattatcaaacaacacatatgtactgctgattaagcaatatcattaatgagcctgctttataatttaaaatgcaagcagatttactttcagtttcagtcatggaaccattgagacactttggggaggcaagtgaaccactgcagttctttctatactggaaggaaaaggaggaaagcaaagttattttgtggttttggagtagtttaaaaaaaaaagttttgtgttttgatagtgccttccaaagagttcagcattatgaatcatttcttctttgtcaaggtgagagaggcattctgtctgtgaactaaatctcccaaagtcttcagtgtttgatgggcaaaggaacgagaggaaagaaataggaaactgccatgccatctttcccccattatctccctttcatgaaaaatgatctgtggctcgctgccaagactttgtttaaaaaaacttggttgtctggtatttctcatctgcatgaaaaataaaaagtgtctccattttttttctgagataaatggtaaagataaagctttcttaatgtttaaaaatataggctgcatactctccaagaaaaaaagccctacaaacaatgtcagctatttttggaatattatataaacagttt

SEQ ID NO: 122315 - DNA, 2429 bp, Homo sapiens
ttcccctgttcatctcacctggactgcttcctgagggattttctaggggaaggactaatctgagatgcaaattaatgccaaattgatgatggaactcctgagtcctgaaacgcagtgccttggatgtcatctgacttaccctttattttctggatgaggatattaaggatcaaagatgtaaaggaggttacttgaaaccacccagtgaggtcactcttacctgtgaactgactccgtggtcaccaccattcttgctgaggaagatctgcagctgtctcatgaacatatgtaatgtgcctggatacagtcctcgcttcagactcactactttattttctagggaagaactaggctttttatttcactgtggctggtgtgggggcattcggtgaaaaggtagctatgggagacaacaggcagccaaaatgctacctaataaacctttgaaccttgaagaaggattgcccggtggtagccctattatccagagtgatggggcctgagttttctgagtggttgtaactttgatggttgtgactttgggaaagaagtatattgcatgtaatgtttccaagaattagttactgtgtgccagaggagtgggcacataagctggatcagtggctttaatgggcagcagttggctgcaagagaaatttgcagtttcaccagtcttaatgctgggcaacccatatattaaataatgtttggtacacttggatatcttttattgggaattaagcccccaaagcagctttctgtaactattaaagtctgataatgctaagctcttcttcaggcactggagaagtttggcagtctctggaataaggaatttgtttggctttggcactgatagccaaaatgccacttctagtcactttaaatgttaccaagatttcagtctcattgccgattattgaaaggtctgtggcaaataagatttcagtgctgtggtgaagcaatctgtgtgtgctttaaaggtaaataaaaatacagcacattttctgagtataattctcgtagacagagttttgttggtcacccagatggttggaagttctggtccttcagcagtatgggttggtggcagtggtgctggcttctgcagcctgtgctggtccaggcctaaactcagggaaaagtatacatgtccagggctcatgtgacttgatcatatgggggcgtgcttcataggtcacagccatggttattcatccatttagtttcattccgccggcacggtaatgcatggaataaagatggacatacaagtgggcattgcttctggtgagtctgcagtatagtgggtgatagggatatgcaaacagaaagttgtttttcttgggagatggcactaatccaccttgcctagaaagaagggaagtcttgctgaactgtgcatcctggcatgtatctctgccatcattcattattttcacctttgataatgaaatttctgacaatacagggtgttgttggagttcatttttttgttgataaaagtattactgtaatcaaagaattccttgcagaagttttgcaaccctcaaggaaaagtgataaaaaaacagaccctgcatgatggattgcaggtttcagggaggtgggagttgtccatcctttcgcgttggctttgcttttgtttgtgtaaccatgaaaggatactgagtctgctttttgtaaaggagataacttggttcatccgtaacatgcagagtgttgggtgaattaacgagtggaaggcacgtaatgatgtgtggcacttatgtagtattttgatgatttcacctagaatcttgccatctggaaacttgcatttactaggatgtagagccaattttggttgatactgagtccaatgtttatttaaaatggtttagattttcatttggctaaaatctaggaggttgtagactaatagaataacaataatgatagcctttcctaaggagctctgaatagcctcagtagtactatagtgagaggtaaaagacaagaatcttaccttatttcatagtgatgcagttgaaacatggtagcctgcacagggtggtagagctggcccgttttgaaatgagaagttgaattcctgatctatggctttggcacttgctttgccaccaagaattgctatctccaaaatcttttttttttttttttttttttttttttttgagacagagtctcgctctgttgcccaggccggactgcggactgcaatggcgcaatctcggctcactgcaagctccgcttcctgggttcacgccattctcctgcctcagcctcccgagtagctgggactacaggcgcccgccaccgcgcccggctaattttttgtatttttttagtagagacggggtttcaccccgttagccaggatggtctcgatctcctgacctcgtgatccacccgcctcggcctcccaa

SEQ ID NO: 122316 - DNA, 1646 bp, Homo sapiens
cttggagtttagattttgctgaaagcaccaaaatccaggcctgaaagatctcaaagtggatcagggcctggggaccagctgtgcattattgagattggagcccaagttggcagggaggccatggctccttaactatccaggaaggccctctgccctcttactcagcgcttcagcagaacagggctgggctcttgatcctgagacagctgggagtctgcaaggtgtgccccatgctttccttcaatgtagagatgccttttacctcccattagagtgcttcagaggctacttagggtgccttaggaaaaggtatcgttattattattccattagtctgtaaccttctagattttagctgaatgaaactctaaaccacttaaaacacactgggctcagtagcatacaaaatcgctctgtgcttagaggcgtctgcaaagtggtgggcgtgctgccccagtggctgtcactctggctgctgcccttatgtctccttcaagggtacatggaagagagatgagggacacatgcctaaggtcggcttctaccacattcctatcccactttctcagccggcttcctactttttcactgcctctgaaatagacacagacctgccagtcctggaaggcctcaagcctctggaaaagcgaagatcacttttccccaaagatgttaattccaaacttgtttatgttcctccttggaatgacagcttataaaaatatgtgcagtattaagagatgaagcctgagggtgaaggacaacatagtacttgacaggcaccagaattaggtgacacatttcactcttgagtttcatagcagctggagcaaaaagggacataagattagcttccaaacttatgttatgcctttaaatgaaaacagaagtagcgtggctttttctgttacttagaaactttttctcttgggacatcataaagagaacactgatctaataaacgacattctcctgcttgaaacttggttctctgaggtaatgagccagtccattagtttcagtgtaccttcctcagtgatgtatctatgttcatctatctggccttgtgaatatttttttgacgtaacatgagctagactgagtatgaatggctccaaacttaggagtgactaggatttacagatgaagcagtatggatcagtttctttgggaaggttcttggaggaccctatgggaggaaaccctggacaggtaggaaaactgaggaagcagaagagaagggcagaagacaaaaaccctggcataagaaattgtcaatactgagaagtggcagggacgtagcagaaggggatggttgaggggaagaccagggggctggtatgtagttggtccccaacagcagtgtattggtgtactcgaccctccagtgtgattctgggcatgagacaagactcttgttctcatgaagcagggcatcagggaatgggagttggtgaggaaattacattaacatttattgagcaccattctcactataaacctgaacgtaaatattattattattattattattattattattattattattattattattattttagtagagatgaggccttgctgtgttgcctagactggtcttgaactcctgggctcaagcaatcctctcaccttggcctctc

SEQ ID NO: 122317 - DNA, 1825 bp, Homo sapiens
aaaatcaagacttaaaaaaggtaaatggaggcagttgcacaattacatttgtttaatgagcttttacattttaaaacttttaattaatgttatactatttcagaaattcaactgtagttataaaattataaagaatgcatttgttatttaaagtgagatatgcgtgcagacacacagaccatggtcttcccttcttcctctggtctactgcttctgccttatatcccctagattccttctcactccccaaaaggcagaggttaagaagaaagttaaaatatcaagacacactaaactgtttttgtggtgagtcaagctgcagtgcctcgctgactgggaaacaatgggctgggcctcctagaatatagtaggctggagaaacagaaaatacagcttgactgggccttgccctctcactccaagcctcaacaggatgctagagctttagcatgctttctgctgtgctgggattattttctgcaactagacaaaaaacccacaaaactccacatggtttgttctcaagcaactggaatatggaaaggcttgaaggaatacttacactttttgatggaaggtaatgaccttagttcttcagtatttattaggtaagcatgggttctgcagtatagcatttaaaaattcatgttcctcagggtttcctaagacaaaatagagtgtgtttggtccagtgtgatggagaagtttgatgcaaatccgtcttaaggaggagaatggaggctgtcatggagtcctgtggactgtttcgcaagtagttgttttccatgttccagttttacttaacttcagaaaattattgtttttgaaaataaagaaaaaatctaagtggtagagagaaatataggctgtatttaaactggcctttataatttttcctgggcacacgcagcccacattttggagctctgtgacataagcaccccctgccccggagctgggagtcttgaccgggccaggccttggctgccctgggctacacagacacaagcacaacccgaatctttgtttacttcctctccaagtgctggggacattcagtactaagaaggactgtgtgcttgcacaaacactcctgccagcattctctcagccctgccattcctgactgtcttggaaagttcttcgtttaaggcaggcttttgttcttagagtgcatgcattattccccagtcaggcagccttttccgggtttccagtgcagacttgcaggtccactcccctgcagcctagcccaggggtggaaccttagctttagttgccattaagagcaggaggaggagttaggcaggggtgactggctgttcatgtgagttcctgtgactgatgtctctgaagaaaccaatgccttcttcagatccttatgggaaatttaggggacttttggattacacagtgttgccttttgctgattctaagatagagccttccaattgtaagtatgttaaaaacacacaactatttcctactgaatgttagtcaagctaaagagtgaatctgcaatttcatgaataatcaaaacaaaagcatgctgccaggatgaactgttgcaagagcaggtgctatttttttccagaaacttttttatcctcgatcacgttatgggtattaagagagttattcttaaaggatatcatgttcagtgcaatgtcttaatagaaaaaccttaaacataagtatgcaggcaaacacaggtacatagctgtataaagttaaatatgaagactggaattcattaataggatttaatttaaatctttttttttttttgagatggctttactctgtcatgcaggctggagtgcag

SEQ ID NO: 122318 - DNA, 2119 bp, Homo sapiens
tgcacgaaattatttaaaatactaaatgaaattatcttcaggctatgtgtatgaggtgtgtatgaaacataagtgaatttcctgtttaaacctgggtcgtatccctaagatattttattatgtatatgcaaatattccaaaatctgaagaaatctgaaatctgaaacacttccaggtaatttggatgagggatactcaacctgtactcaaattagaggaaagaaaagaagtaatggatagacaaaagaaaagtacttatttagagtttacaatggccaagaattaggaatgaagaattgagactgatgttcttgtcagaattttggatgccttgcttgcaaatatggttttaaaaatatgcaacttttctcattttagtattgggattgtggcgcttttttgagcctcatatgacagctttcagattggagataacgttagagctcatcctagctcagctgcctcccctgacagcagacgaaactgaggcccagcacttggtggtgggctcagagtgccaaactagttaatgaggcagagtagacaggcaacagccttctcatgtaggtaggcctcatcctttagaagatgttgctgcctgcccttgtgacttgtaaagatctgtttgaagcatgagtaaggagatgggggctcaggagtgttacagcatttcacatctcaggtgtagctgggacttatcgggtgaccttttagaaactgtttattttcatttttgtaccccacattgggataagtatggtccactgacattgagaataaccaggcctgttgtagacagccagccatcctgaaactactaggtttatacttcttacctgttagaacagagtttcccaagttgtattcccttggaaacactagcagtcgtgcatcatttgggcagttaggttacacaaaatttaaatggtctatttattttcttttccagacagaactcagggcagtcccacctcaagggaaatctcattacatccttctgatggtggggtagctgggagtcagcatgaaatccaaaattctaaatcatcgggaaaaagcagaagggttggaacccaaattaaactgaagtcctaaataaagttcacttttcggtcaggcattcaggaagcagcacgtgaaaatttgcttggatacagtttcctcatagttcttcagcagcttgaaataacatcttgagctggctgtaaacaaaacatctcaagttatcgtttttctttccatttgattgagccagttattgtatagggaggtgacacaaaacaaaacttcgtgtttctgaagccgagattttgggattgtactttatgcaaagttacttataagttctgattactttgagagaaaaatattacagtatccttaggaagttttatgtatttgttttaaagctaagcaccaccctctttttagttaaaaaaaaaaaaaagtttggaaaatagtgacatgtcagtacaaagggaatactgctctacaataagaaggaacacgccacagatacatagcatggatgaatgtcaaaaacattgtgagagaaaaatgcctgaacaggagagtaactattgtttgattccatttctgtggaattctagaaaaggcaaaactaacttatggcaacaggaagcagatcagcgattgccaggggtgatggggattggaggaggttgactgcaaaagggcagaagggaacttttcagggaaatatgaaatgttttatatcttaattgtggtggtgcttacactggtgtaaatatatttgcccaaattcgtgtaagcatatgcttaaaatgggtgcagttttttgtatgtaagttacacctcataaagttgatttgaaccgaaaaaaggggttagaaaaggctgtggttggaattttttgtgtaacttaaggccaaatagtccatttacgccagtttttacagtattgtaagctatgccctttgtgttcacatttcttcagttactcctttattcgtcatcacttaggagactttgcatctcatctgccttcctcctagctccatgatttgagcaatagaagttcttggctttcaggaacctcacagttcttgttagtcataagcaagaatgcattttaaat

SEQ ID NO: 122319 - DNA, 1091 bp, Homo sapiens
atttgtagtagagatggggtttcaccatgttggccaggttggtctctaactcctggcctcaagtgatcctcctgcctcagcctcccaaaatgctgggattacaggtgtgagccactgaacccggccgccttgctgtgtatttttcttttcttttcttcttcttttttttttttttttttttttgagatgtagtctcgccctgtcacccagtctggagtgcagtggctcaatcttggctcactgcaacctctgtctcctgggttcaagtgattctcctgcctcagcctcccgagtagctgggattacaggcatgtgccaccacaaccagctaatttttgtacctttttagtagagatggagtttcaccatcttggcagggttggtcttgaacgcctgacctcaggtgatctacccgcctcggcctcccaaagtcctggaattacaggtgtgagccaccgtgaccggcctttgctgtgtatttcttttggacatcttttggctttgtgtttgtgtaaactttgaggtttcttaaaactaccaaagcagtgaggagaagatggcagaaagctgtgtgctgatattctttttcctgtttcttgtttttccctcccccaaaagttgtggaattaattttaagtagaaggaaaagggcagcttgagatgtttaaatttgacttaagttttaactgaagtttgtttgcaaaaagatgaaaacgggttaataactttagagaaaaaaaggagagtccctgttcttctccttcctcttttagggagagttgtagaataaaaggttgatttcatactcctaaggtttggaagccaaataaagaaaacaaaactgtgaagttaacatagtagttttggtttcttatttgtagaataaaggtatgatccagccccatggaccaaggcagcaggaggagagttcccagggtttttctaaggtcagaggcatgcagcattttcttccctccttccctgcctcagccacctctccctcccacctttacctcccgctaatgcttcttttgggcttgcttgggccatgttgttttgttttgctgctttttgaactctaaaaatatagg

SEQ ID NO: 122320 - DNA, 2394 bp, Homo sapiens
atctgtggtttaaaaaaaggatctggaaaatacttaatatacactgtcaccctttagggacttcaggatgcgtaccagcagactgaagcccataagtcctgcagtaaagaaacctgttttatattgtttaatccatcatatcccaaacagttgcagctcaaagggatgctttttttttcttttttcttttttttaacagaaaacagttatcagcagaacatactttgggaaataaactgttggactaaataaactagagtcttatctaactctttagagtctgaagtgtggatggtatcttgaaccacaataagcagagaaaatcccaaaggactggagagaaaatttactctggagatggcagcagctaagtgagaacagaacttggccatacagttgtgtcttaacttgtcccaaaagggaagtgccagaatgtgggtgatgccattgggctatgttagagacacatcagctcagaggttgtataagttgtttccatggctagatgagaaagagagccagacctaagagtgtccccttgagccattagaaacagtgtcaccccagagatttactcttttcaacttctctgtccccattaaatccagaagcacaccaggctgagaatgggtaataggcttaagcacaaagaaattgcttatgattctgaatgtggaaggcatctttcttttcagctatgaggatgctcatttaagagaaattgctttcttattaaacagaatgattgtgctttttttttaattggatcagaacatccccatgctgccttgtggtatttgtacctaacaaatggataatgactatgtgaaattatggattctgttggctaaatttaagctgtcaatacagggcaaaagggtactttgattccattacacattgcgttaccagtctccagagtccatggggttaggtactccatgttttaatatgtttcaataacttttttatactgacgtctgcaggctttggtaactcatactgtagacctgtatgtggctgtgtccagctgcagcatgtgaggtagccagagagctatttcaggaacaaacagagctatttcatgtttcctctaatttgtaataagcacttaggtctgcctgactcttgagatgtatcacagagttcatcacacgccacctattgtagtactaaaaggtactaaaattagaattcatgcttttggtgttttaaaattagcgattcttttccctctgttgaagctatatatatttgttaaatagtgtcttttaaacccataaattctaagctagaattgatgaacattcagattaaagcaagcaagaaaaaacttaataaaaacaaaattcctctcacggagtttgaggttccagtgatttagtgggtcatgtgttttccattaaggatatagttcccatgcagttaataatgtacaacactgtgggttctctctgctttaatctttgccttcttcctccctactgtcccctcttccatctccctcaattggggaggggaaaatccctgtgcatctttctgttctttgtagaatttgttccttggtagtttcttcatcaacttgagtcacctcagccctagaggaggaatggattagctgaattctgctgacttgttgctacccagctctgctgatagggacatttgtagggtggggatgacaggggattaccaagcagttgctgagtgataaactgaactgaggcaaccacaagcaggatacataaaaaagaaccactggcacgcactgacccattgctctgaaccagctgtctgtgctgggccctggtgggaaatggagggaaaaaaaatctagagctttctcttgaacaaagttacgcacaacatgagtcagaaacaaaattttaaaaggtctggggctgtacagattttgttgtggggaggggagtgttacacattttatgatgattgacttactggaaattcaccatcatggaaacaaaaatttagggaagaattctgaatgtgttctgggaagcctctcattcatgacattggtttggcagacaaatggcttccaggaatgcctacccagggcattgctttgtatggcaagatgtggatggttgataactccttgacctggtggtcattggagactgcccacccagggcaggggtgtctgtatacccctcacctccttcatgctgacttagcatgatggccggcaaggagtttctctaattcttgtctgggcatattctttctctttcccttttctttttttatgcaactaataaaaagattgctaacacttattacataggaaacttgagatgtatacagagttctagaaaatgggatgagagctgtttttattcctagaccagagtaactttgtgagagcaagct

SEQ ID NO: 122321 - DNA, 1047 bp, Homo sapiens
attataggaacctattttgaagctcttagagctgagagttaagtggtcttttaatggaactgctaagacaaggtagagtaggagatacttttcttccctctttatgctgaagtgttttagtgtttctgtctgtgactaggcagtaactttgaaaggaataagatagggttaataacatatctactaaaacttggaaaatatactatattttctgagataaaaatctttggattgaaaattactttctggtggaatatggcaaactgacattcattcaatgtaagactttttttccctcactttttgtgttttcatctgtagtttttttttttcttttttacctgtggtaccatttttaaggtgaatcaggccagtttcagcaaaaaatggttgtactgttcatcacttcagtagaaggtaggatgacttcgatgaggttgtgctcagtaacttctctggtgctgaattagtgtcctgtgacaaagaaggatcccattcttacaaataaatgaataaaggagactagcagaatctggcatttctctttttaaaagtttataatcaattattcattcagtcattcaagtaccttctacatgtttgcagctaaagactaatgagtgtaattaaacaagtggatcaagtaaagcatcagccatgaaaacttttcactttctcggggatgataaaggaccctcctttttttccttgtcatattttccagtttatcatgattcttatggtattggtgattttaactttaagtgtctagaaaatttacgcacattttggcctaggaaagaaaatacagtattgaagaacaagttgaggatctccaggtattaaatataacctgatttccagaggaacttgatataaagaggataggactctgctaatggggagaggagggaatcattgttggggttttgggtagagcatcttctttgaactaatcctggacagcctttcccaaactgagggtgtgccatcatttccttgagggcagtagaaggccctgagaatctatctgacagcattattgaa

SEQ ID NO: 122322 - DNA, 2350 bp, Homo sapiens
caggaactgacaaacttttctagtccttttgccagcctgttctgcttttaccaagagtttagtgacaggactacctgttttcaatagttaaaatgtatattttgatcacctttagcacatgctaccttgcacagctctttttaaagccttatgtattctagctatttgaccactgttgtgtgtgattttcatttttgatgcctgatgtgacaggagggggtgaggatgggggtcccataaagatgcagagtaagttgaagaagacaatgcttgtcctgccaccagatgtctcttgtttttatttttgtttttgttttgttatgtgtaaaaacaaatgaacccttgggatattaggatatttcggagcaaggtgttgtcactgtttctcagacttggggaatttagaactcatagactttttaattattaacttgtatgttttgtctttcatacctgaaaggtcgtacttaggagatgaaagaatttttatcccaaattgaaatgtcttagaagaataatatttcagctgggcgcagtggctcaagcctgtaatcccagcactttggaaggccaaggagggcagatcacttgagctcaggagttcaagaccagcctgggcaacatggcaaagccccatctctactaaaacaaaaattagctgggtgtggtggcgtgcacctttggatcgcagctacttgggaggctgaggcaggagaattgcttgaacctgggaggcggaggttgcagtgagctgagatcctgccactgcactccagcctgggtgacagagcgagactatctcaaaaaaaaaaaaaaaaaagaagaaggagtttctgtactcccttcagaaacttgcttcactgatattttcttttctgatcctggaaaggttacatgttttgaaaatggaattgtaaaatgtgcttgtttctaaccctgtttttcttgctctgtttagatgtctagatgattatggatacattcttttcagtctctaaagtctgagggagtccctgtatcctaatttttctgccagctgacatgtagtagaatataagcatccttctgcctttagggacttgcagattatattctttggatggcttacttcagatgctaaggacaaaatttattcattcactcaataaatatttattgatgcttactgtgtgccagctcctgttagagggttggggaataaatacatcagtgaacaaaagataaaatccccctgcctaaaggagatcccatcctaatagaaatgtatgttctttaacagtagattattatcctggaagaactaatctttataattaccagattcttacttcagagcagtggcatttggggagttggtggcaggtctaaccttcagtcctgccctatttactgccatttccaaggaccttgggatcatataatggtagagttgaaagacaggtggaaattctagtccagttccctcattttattcatcagaagtaatgtgcaaattcatatgcatactcccagtgggccttaagatcacctcaagtttctctctgtttcaaactgaagtgtctgttctatactcagaatcatctttagaacacttgagtgagatctctagttcagccctttgaaaaactgatgcttggataaattaagtgacgctctcactttatttaaagatgattgagaattggctatcactggcctattttctggtcttacaagtagttctgccaaagaggctaatttctaactgggaattgtcttttgtccccagagggaaatggaacatgaactggattggaggcacagtcctaaagagagggatactcagagaactttgcagaactttttgggttaaaaaaaacaactactcttttctggtgctactgcagtttttctatcaaaaacaaaatccaggaacaaaaatactctggcagaaaccaggaaaccaaatatcagaaaccaaagagccaactctatggtttctgaacagagtgtaccatttaggatcctgtttagctacctttgggtttattggaaaactactccattgtggttacaagtggaaaacaatttaaaggctcttctttggctttggtacttttacagggtttcacatttctaatagtaaacgcttcagaaagtttgaagaaatatcctattctcagagagagggtaggggaaagcttaactttatttttctctatccctcccctcccagagtccagaaaacgggccctaaattcccaggacagatttgtttcaacctcaggacagttgcttaagcagttaatgctcagcagtatagaacttgtttccttttgttaacgctgaggttgctacggtacttggccag

SEQ ID NO: 122323 - DNA, 1001 bp, Homo sapiens
agccctttgtgttagcatctttcacttagtagagtgcatttgagattcatccatgccttttgtcagtggctcattcttttaattgctgagaagtatgccattgttgtatggatattctgttatagaaatataccggaatattttatccattcaccaggggatagacatttgggttgtttccagttttttacagttatgaataaaactgctattaatatctatgttcaggacttttggggatgtatttattcatgtatttgtgataaatgcctaggagtaggactgctgggtggtaagtgcagtgtatgtttaactttataagaaactgccaaactgttttccagagtgaatgtactgttttgcatttctgccagcaatgtatgagagttctagttgtttcacctcctctccaacacatgtaattgccagtatttttacttttctccattgtataatgtagtggtagatacctcattgtaattttaatttgcatttgcttaatgattaataatgttatgcatcttttcatgtgcttatttgtaaattgtatatcttctttggtgacgtgtctattgaaatcttttgccttttttttttttttaaaggattgtattcacaccatttagttaggaatttcttatgtattctgaatacatgtcttttatcagaaataagtattgccagtactttttcttgtttgtggattgcttattcattttgttaacagtgtcctaacaactaaagagctaagttttagctcttaaatttaagactttgatccatttggagataattttaatattttgtatgagtctggattcatttatccattgaacttccttgacaccttcgtgtatttctagaccctctgttctattgattgcatgttttctttcttatactaatactacattggtctttattactgtagctttattttgtcaggtagtataactcttccaatttagttctttttcaaaatcatttgtactgttctagat

SEQ ID NO: 122324 - DNA, 1043 bp, Homo sapiens
tgtaaccgtgggggcaaggcaggaagcattctgtttatgtaacacagacgtggcattctttactttctaacttaggacatttgtgatttgaagaagagacacctgaattttcaatatgttagtctttgttggaataattggctcttctcattctttagtcatcaaataatacttattaaataccaactaagtgctttgtgccctgctaggcattacttctctttattctacttcttaacagttggaatatgccaaacaaatgaaataaaaatagttttcctattctagttacaggttggattcttggatttatctcccaagctttgacattcagaaactgaaagtggaatatagtgtattctcagatgtaaagttgatctcatttcctcactggccatctgtttatttgcgtctaagaataacaaaactttcatagtcatatctgtattttttaattactaaaaataatgaatggactgaaccatgcttgccccacttttgaaacaattccttctatagactgttgcagtaggaagctaatacccctgattaagaataaagaccagacctacataagcatatgttgtattggtgtatctgaagtcatgaggatgtgattaatggtccttaagagttttaatttggcgtgtcttaatgcctaaatctcacttaagcttggttgcaaagcctggcaaatcagtcttctgtacatggcaagctaagatgtggcaccatcttcttgaggtttcatatcctaaacctgtctgtccttacaggttaaattcaaaggatagggccaagcttgatttgctgtagtcatagtgaatcatcacagatccattcttagtgcagaagagttaaataattccttggccaagagcatggtgccttccccagaccaatttctaacagtgtcctctgttagatctttaagttaataaattcttttattagatttttgggtcagaaaaacagactatgcttgtactcaggagcccagaaatacataatataattgactaattcctgtctttgaggtctta

SEQ ID NO: 122325 - DNA, 1081 bp, Homo sapiens
tgaatcagggtgggcagggagagagaagggatctgttcagacatttccttttggggtcaaatgagaggaaggagtccttgccccttggagaattactgcaaggatctggttgagttgagaatttgtttcccccaccagtattgtttttggtgtttttttgttttgttttatttgttttgttttgttttaacatctctgtttccttcccctttctgttgttgctccttcctcctcccactccaactaccacacaaatcctgacaggagcctttctgcccctctagggaaggggcccgtgtgaggaactcttactggacgcccccttccctgttgctgtgctgatcttacacatcagtttccacggatcccatgtgaatcagttgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttagaaaaaaaaaaaaaaaaaagctggaagagttccccttcctgagcttcagtggaagcaacaggagggtgggccacgtccaggacagtgggagagcaaggatggaccctctgtgtccacctccagtgtgtggcactgttttccatctcatcttggacatatcatggggctacagcatgcctcagaagcctgccagaacctagtgatggtttccagcatctgggtttggggaggactgtggtgatgcgctagggatagccatctggaaggggtggggcagagacagcaggagccgtagtcgtctcaggagcctactctgattagcttataagttggcctcttttcatgatttctgggtcattggtgagtggataggagttataggatcctttgtgggtgagtagaagatactgtggcagataggttttactgaacccacctgcacatgtaaatctttcctttttaatgtgtcacctcttcagtttgggtggagaagcttgccacccccaggttcatccctaagca

SEQ ID NO: 122326 - DNA, 1013 bp, Homo sapiens
tagcttttttttttaagtttaagcccatacccattctgcatatttcagagtgaaatgtcctttcgggacaatcttattaaatcactaatctgaaattttatgttccctagttggccatgccagtattttggttagggttttaggtgatttttatatccactgtaaacttggatataacttaccattaaccagatacttaaaaccagggtattttcctaaggtttaacattggaagtggtatgtgagctgagccttgaagggtgacaccaagttttttgacacgaaaaggttggatgagctagctaaagggcttgttttttatcctgtagggcaggagtggttgtagatgccctctcatgtgctgacatactgattgatggtggcttctaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagttaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgcctagctggctcataatactgatggctgaatgggggtatgaaaactggtcctcaagagtatccagtcttattggaggaataatgcaaaaacaaacaaacaaaaaaggataaaataaaagaaacaaaagcccaggtggtaaattttccagtcttcttggagaagtaacacagaaaaaaaggtaaaataaaagaaacaaaagcccaggtagtcattttgcagtagagctcagtgactaagggcagagtaccttgcagaggtgttcagtattttggctt

SEQ ID NO: 122327 - DNA, 1765 bp, Homo sapiens
ttattctctgccctctcatctcagcaagtggctttcatcctcagggtctcctcatggtccatccgaatggaggccaaaaggaggaaaaacagcacgaatgaagagactcatctctcacctgagtagctgcctttaaatagtcttgcatggaactcttccacttccatgtcattctattttcaaagctaagtcacatagccacatctaacttcgaagaaggctgaggaatgtagtctttttgtctgggcccagctaaaaattggcattgtgtgagtaatgaataagagaagaatggagtagtctgttctactaagtcaaaggttgtgtgcagtatcaacagatagtgataaacagtccttcaaaaactttgcacccactttaacactttcaccaaccaatccaaatttttttttcccaaatcttaattaaaaacaaaatgtcctctactgctgtatttgaattgtgttgtctttttgaagcatgagtataacttctaatagaacttaattttctattcagattttaaacttctaaatgcttctgaagtttaaggcagataacctagtttatttaagtttgatagtttattcctgtgacttcgattgctaaaggtaggttttcttggagatgggaaacctgggaaaagagaatgtgtacttctttagtgctggaagaatgtctgcttctttcctcctgcattttattgcagatgctaaccttactcagcatggtttagttcagaagagaaaataaagggagaattcatttatgctttcgagaaaatgtgttgagtcttccacatgccaggcatctccaacataaaagaaagagatgtatctcttttgctatctaactcttcccactttccttcttatgatctgatgtgacttctccatatcttatgtaccttccccccaataacaattgtaataatcatcactaagcgtagtactgcacaaaagagagctatcaggtaaaaggacagaaaaaccacgggagttttaaaatgtccaagtagtatttaaattttaaaccttacttttttctgtttttaaacctcatatatgaatttagacagacaaactaaaacctgtttactatagtaagaatacctcactgtagcttaaattggtgtttttaaaatgatggctttggccaaattctttggcagctaccctagactggaagcattaaaaattgattacttgcaagttgttgctaatagttccttatttctgcaggccttgccactcagcccaaactggggtccctgcataatgtttattgtagctggagtgctgtgctggtgtcctgctgcctaagtggagtgagttgaccctaatttactcctggatgcctgcattcttttccatgcatgtccacaaatagcatcacagcaaattaacagaattttctgattgatgtagggagaaaccaaagaaggcctgtgtttggtggccaaaacaccacacagtatgagcagagtggaactactggcccattttatagcattctaattgataattatcaaagagcacattatttgaccatgtggcaacaatccagtatcatttcagaggtactagacatgtagatgtccgtgaacaccatagtgaatataccccctccttttgccaaaattgaaataggttatccaagaggaaaggggagggaaaagaaaataccaatttcctctttacaaaactgtggcaaatgagatgtcataaaattctgtatttcatgataaagcctcctggctcatcat

SEQ ID NO: 122328 - DNA, 1052 bp, Homo sapiens
aagctagaaaattaactctttttttggaaacttggagagagtctataaatgtcatcgtatgtgtttgctgttggttcacaggcaatgcctagtccattttccttcacagagatctaaagctactaaatactgtcagaagaaagaagaaaatttatgtgggagagctaagtggaaagaggagggaatcctaggtgtctacattcacgacactttacaacagcaaagtcactgtggcgaggggagagacctggaagcacctctgccaaggtaaaattgagggcagtccatagacaagtcgaagaactgaggagaaatgtttcctggcccaggactccataatggaatctgtctggaccctgcagaaactcagtactgttaggactgccttgagatgaggcagcccagttgtcagggagatgggagtaggaatggacataaggtgtctgttcttgtattggtggaagaggaaggtaaaaagaaataaacctaaacctgctgctcacttagctctatttcccacaagcaaaccgcaacattgagtaacagctgaaaaagatggtgactaatgtagatgaaacactgaaaatgactctctgggggtcttctcacccctgctccctttgattaatggtttattgtcgtaaagccttaagggtcgttggcagagccaggtcagagcattcagagtgctggagccatgtatgtctgcctctcttgctttttgtttctcatcctattatcttgtattccttcttattttacataggagaagagaagaaagatggctagagatgatcattgcccaattttatctttcatggttaaggaaataatcagttcacaagctaaagcagtggactgtcaagaatggcaaagtggccaggcacagtggctcacacctgtaatcccagcactttggaaggctgaggtaggaggttcgcttgaggcctggagtttgagaccagcctggaaaacatagtgagaccccatctctacaaaaaaaaataaaaaattagtgaagtgtaggggcgcacacctgtgtttccagcttc

SEQ ID NO: 122329 - DNA, 1095 bp, Homo sapiens
cctgtttcagattaagcctcataatagcaagggccaggcactagcagacatttgcttgatgtttctggcttgaggatccgtaacgtggtgccagctgttttagggcctgaataggcctgccagggacagccaggtgatattggcttgacgtagtcacaggctaattctcccagaacacagaagcctccagacgtgccaccaaggaaagcctggatatgtagaagttcagtttatggctatagtaatatttgggcattccccaaaatagtgatcccagttcaggttaggacatgatagtagtgtccctttgaggtctgtctgagaaaaggtgtcatttctaaaaaattagtgttagcagatgggcagatgtggctccaacaaggcttgcttcatggcttatcatttttccacattttccatccctttcataagcctagggaccacatgctgaacatttaattgaatcacacagattttgtagtctttaaagcttcttattccttggtcacttgttagtggtgcctccctccttggtcagtttggtgacttcagaaggaaatacacagtgcagtggtgagagcttcacttttgaagttagcctcaggcttgatttctagcaccaccacccactagacaaattgcttaacctttctgcacctcagtttcctcctgacaggcttgtttagaaaataaaatgagatcaaatttgtcaagcacagagcattggccctggtaggcaccacatacatgaatttccttcagattgtaggtgaagtagacttgatttgggatttctcttgttacctaggtgcttgtgtagaggagactttagaaccagaatgtgttatttgtggttttgagtgtgcctgggactctgagccaactgaattaccaagtaatgggggccccatggcatcccatgacaggtggagagccggctcttcaccctggatggacctgaaatgcctgctaaggccttgctccaccgagtagcacacaccctatcagtttgcccttctttccatctcttattctagagaccttaaagcctacttgttggtatatattttcaggtttttggaaattgggctgttt

SEQ ID NO: 122330 - DNA, 2187 bp, Homo sapiens
aaaaataataataattaatatgaaaataaaatccaccctagaaaacccaacagaaccgtgtgtggagtatagtggtagtcatctttttcatgctatttaagagaactttcttcctatctaggatttctttttcagttgagggcaggataaattgtgtacccagccctttctccccttgggaaagcctcatatgtctcattttgtttggatagaaaattgattcattattctgatgaccagatgatgattttattctttttatgagggaccagaacctgtcgcttgcttgctgcttgaaaacttaaatgttagtttccaaaggccatctctgtgggtagagggttatcgtcagcagtttaacgggaaatcttgtttctaactggaaatttaattattcagccaagttcccaacaatgtttactttagagcatcgtctttttttttttttttaagtcccttaatggtttaaacttttaagctttaggcaagagtagagtggagctagatttacatatcaggttgtttgtgcaatcttttacatgaaagtttatgttttcttctcaatctgaaaattggttttggccattatagctggtattatatatgacgtaataactctctctgatctcagatacatttttatgctgtcatactttctgcacctgcttttgaacaacatcttagtcccaaagtagataaaatctagcagaagggagtaggcagctaaaaactagattctagcaatatctaaggaaattacaaggatcagttagtgttccattccttccttctttggctatatcaattcctagttttgtgaaagtccacatgccttctttctgtccatgcctgtgcatgctgggtggagaagcatcacagagcagaatgaggtgactgtccccaaggcagggtaaggtcaaggatctttcccctcacctcatgattttcaaaagaaaagcagatctggacctcagttacctaaaataaaataaaattaccctagctcttattctgcacataaaatcacagctttaatctctcatcccagttctcacctttatcttctcaatgatggaaacttggacttaaaggaagttactgtgctatgttaccagatctaaggagactgggaatcattagattggaatcagatcctcagtcaatggaaatataaggaggaaagaccattggttcttggccctaattgcacattagaataatctggggagctgtaaaaatgtacctatatccaggccttaccccatctattgaatcaaaacctctgagactgggatgtgagtgtttaaagtctccccaggtgattctaataggcggggtgaagaactactactgaagggaaattgagggcctcttccagagaattgcctttgaaagatcctgtcattatacaccgaaggcgcccacccgggcctgctcctgaagctagctgtttgcagtgctctcctgtggcacgcagacctctgggtctccctgtgaattggggttccattgggctgttcaaaaaacctttgtcatctgtggttcagcagacgcgtatgttagaattcaggcatttggcaacctcattctgaattgtcagtacccacaagtcaagcagtgagacccacttgaaatgctggtcctgtacacaaagtgggtgagcactgtattgaaagacagtcctttccagtgctttcccctgaaattccttgtaaggaccaggagacgcctgcagtcggcctggtgggaagtagtgggcctggctttggagttaaccataactcattttgctgctccagacagtcctcctcccaccccaccccaccccacctcaaaaaaaaaaagagagaggagggggttgtctttaaagaaaaaaaaaaagcaggggcttttaagagttaaattacacaactcgctttttatttttaaagtgagcagatttcttgttgtcgttgctgagaaagataaattgataccacatgttgcttccagacaaaaacctctctgtgttccaggggaagcacatgcagctggtgtctgggtgagtggacagtctccacaaggtaaacatggtttggaagggctgaagcggacgtagggtacaaaatttaagaaattaccagttacttctgactggcacggcacctctgaaatacttttttaaagtttgaaatcctttcctggaag

SEQ ID NO: 122331 - DNA, 1050 bp, Homo sapiens
ccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcaggtcagtgccgaatgctatggcataaaaataacaatatggggatgaggggggatctctgggggagcctgtcttctctttactttgaactttattccacactgaaaaccatggagcagtggtgcacataatatggctcccagccagttccatctcagggttttacctgcaaaccaaatagggctgtcaggtgccccccttcccccgcacagtttgctgatagttcagaaatctactgctcgtgaagagaacacgtacgcattcagagatcgcattctttttttgcatccagttgtcctcactggcctgtgacgcaggttgccctacttgatggatggatgagaagagaaggagagggatgggaagcttgggtcgtac

SEQ ID NO: 122332 - DNA, 1066 bp, Homo sapiens
ccacaactatgggagactgaagcaggaattgcttgaggctaggagtcagagaccagcatgggcaacatagcaagactctgtctctacagaaaacttaaaaaattagctgggtgtggtgacacatacctgtagcccctgcttctcaggagaatcccttgtgcccaggagtttgaggctgcagtgagtcatgatcgtgccactgcactccatcctgggtggtaaagcaagaacctatctcttagaaaaaaaaaaaaaaaaagccaaaaaattaatttgaaaacacaggtgtttgtatgagggagtacttactcgtgtgcttctgcttgttcaccaaactataaatgatatcagcagtttccaaacatagagtgacacaggttgtgaatggtgatggagattttttcaattgtggcattttaatgttctcagaaccacaaagatcaggcagtgtgatgtaagaaaaagcatttgattgaaatcaggaattgaggttcaggcccacttctaccactttcttgctaccactatggttgtgtcttaggtctctgagtctcaacttccagttttataaaatgaggataatagcccccattacttcacagggttattacaagaatcaaatgcactaaagcatgtgaaactgcagtaggctgaaatatgtaccatgcaactaggtatactgacaaatgggcaagcaggtagcccagagaggttaagtagtttgcccaaggttacagagctaggttgatttctttttttttctttttctttttctttttttttgagatggagtcttgctctgtctcccaggctggagtacagtggcgcgatctcggctcactgcaagctccaccttccaggttcacgccattctcctgcctcagcctcctgagtagctgggactacaggcgcccgccaccacgcctggctaatttttttttttttttaatttttagtagagatggggtttcactgtgttcaccaggatggtctcgatctcctgaccttgtgatccgcccgcctcagcctcccaaagtgctgggattacaggcgtgagccaccgtgc

SEQ ID NO: 122333 - DNA, 1051 bp, Homo sapiens
tggaaggtgaccctaatgtttacctgaaaatgctgcctgcccaccgagtaacaaaagccaaagcactccctgccccactcgtcaggttctactcagactgccctgctggctggagtggggtgccccatgggaggcagccccagccggcacttacaccaaggtgcaggtgcaggccaagctgtaagaagagggccaccggggccacacacgcagattcccctcactaccggaatctgcacacctggccagggcactcctttgtctccctcagttgtggagccaccctggagttcctctcagttcctctgtggcactggtgtgatggttgttacatggccaccatctgtgtcacctgtgtgtcctggtcataccttacaggtggtttggactatttgtagaactcaactagctgattctgtgttttcagtttcagaatcacttggaaaaattagattgtctctcagaatcctgtgtatctaaagcaggaaaagagcgctttagagatcctcccttcagtatttggtagctaaaccctgagatggactggcaattacacctgcatttccacccaccctccagggatctagggcatcccagcctgcacactcctatcattcatccctgccccgccccccacatacacacaccccagtaaatgcagtgaagagtcatacaggatagggtcacacccagcaaacataaacattgtgatatgcaggtcatgtttgatgactgaacatttcctcctgtactacaattccctattgtttttaaaaggtgaatcactttattgacagcagcttgaaacttagagtagcaagactcttaatttgggggctggtggtaaggatatctatggtgggatgtacagaaaggataggagaagataaaccttttattaaatacttgagaattagttgaatgttaaaatcgtgccttgtattgatttcatctgtaagaaataggagttttagaaattgaatgattggaaaccatccttttcacataaagtactgcaaatcctaggtcatatcccaccaggcagtaggtt

SEQ ID NO: 122334 - DNA, 1292 bp, Homo sapiens
cagctttgctgtgctagccctgggctctgaggtgggtgagggagatggaaggccttgacaggtggccctcaggtgcccactattgctgttgcagtgcccttaatgatctctggttttcttttctcctcctttagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattt

SEQ ID NO: 122335 - DNA, 3945 bp, Homo sapiens
tgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctatcttactccaagaagtctctttgttctccctccccctttcttgaaccctaggaataaaatggcagtttctctcaaggtcttcctgtggaattcccccacaggctgggagagccacaaagctgagagactcttatcacaaaatctttaaatgaacctagtaaacgttttctctggcccgcttctgacctccacagacaacagacaacttaataaaggaagatttatggcatagttcatggtggctgatagccacttttggtgtgttctgagtcatgttgcccaggg

SEQ ID NO: 122336 - DNA, 1070 bp, Homo sapiens
atcacctgggcatgtattaggaatgcagaatctcaggccccccccagcactaccgactcagaatctgcattttacaagatccccaggggatgcatgtgcacagtgaagtctgggaaacactgttgtggaagcttcagaaactgtaacacatggcagaatggagattccttctgttcccaggaggaaaataggaaatgggaaccttaataaatgtttaatgattaggtatttaaaataatattgtttaaaacccccagaaaataagcgggcttaagaaaacagaagaacacagcggacaccaggactctaagatagcgtcagttgtaccagtgaaggacaagaaacttctggaggtcaaactgggggagctgccaagctggatcttgatgggggacttcagccctagtggcattttcggagcgtttcaaagaggttactactggtactacaagtacatcaatgtgaagaaggggagcatctcgggggttaccatggtgctggcatgctacgtgctcttcagctactccttttcctacaagcatctcaagcacgagtggctccgcaaataccactgaagaggacacgctctgcacccccccaccccacgaccttggcccgagcccctctgtgaggaacacaatctcgatcgttgctgaattctttcatatcctaatggcaattaacctccaaataaaagatgactggtaaaaaaaaaaaaaaaaaaagaaagaaagaaaacagaagaacatttctatattgatggaaatatatattattcctaatatctggaaatatatttgaattggttgactaccttctactagattgtgagtccttgaggtcaaaaccacaatttattactctttctatatgtagtatgtaggatgtgttccatacttaataaaacttcatgaaaaaaatgaatacaactcactttccttttccccaacaaatcttacatttttagtaaaaagtggcaaaggaaaacaaaacaaaacaaaaccttgtatcagagttttcattaaaacaataagaagaaaaaacaaaaatgaaaacaaagaaaagaaaaa

SEQ ID NO: 122337 - DNA, 1018 bp, Homo sapiens
cccaggttggtttttagcagtctgagtcttacacatggccctgggagacttcaggaatgatcccaccaggagccaactcccctctccaggactgtgtatttaaagacagacagttgctgctggaggtttaggaacacccttgagaataactggaagttagatgagtgtcacctgtgctccctcctttccaccagctgggactctttcactgccgtggagaagcagctgctgcctgggtcaggttttgcagtatctgtcgattgggggagccaactctgggagtggtgggtattggggaacccactgctgtgtgatggataaagccttaggaagaatgagttaagtcccttaacaggggttctgggtttgcaagccactccccgtttccccataccatctgtaaaacaagagacagctgggaatcctgaacttttactggtctgcatttgctctcttccctcgtagtccacaggttcatgatggcgctgctggatgctcagcatcaggatatctgcttttctgcctgtggtgttctcctcaatctcactgtggataaagacaagcgtgtcatcttgaaagaaggaggtggcattaaaaagtaagtttcagggcgtagagtactgactctctcaggatttgaaggacatcattttcttgggagctttggccctttcatcattcctgtggggcaaaggtatttcaacattgggaagcccctaagctgaggctaaagagggggtttagattccactggatacttaaaatagtgcagaagtaggccaggtgtggtggctcgcacctgtaatcccagcattttgggaggccgaggtgggcagatcacttgaggccaggagttcgagagcagcctggccaacatggtgaaaccctgtctctactaaaaagacaaaaattagccaggcgttgtggcacacgcctgtaatcccagctattcaggaggctgaggcaggagaatcgcttgaatccgggatacagaggttgcagtgagtggaggttgcgg

SEQ ID NO: 122338 - DNA, 1028 bp, Homo sapiens
agctggtcacatctggggggctgagtggagagagagtgaaagacataaaggccaatgtgtaaggggaagagactattagtttttttttgttgttgtttttttttgagatgagactattagtttttaaactcactgagttataaaacacaaccttttgcatgttgcagtatgggaattgaaaaaaagattggagtgtaagtgaagctgggagttagggataaaagccagttggattgtcagccaaatgacaatgatttttaccatgctacagagctatagatatagaactgtacttgaccacatttattcacatttgttctattccctgtatttaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataaggttagtcttctttctgtgtttataaagagatgttttcctctgggccaaattattcaagtgcttggagcgcacatgcacatagacacacacataatcaaaacccatcccctccccaataacttatttttatgctatttatgcttcaaagaaccactttattgcagcttagttttttcttctctttcctagctaggcaggagggagagttagggaccttgacaagaattgaatgacagctgcctccaggaaagggaggacaagcaagctggtcctagaacaaagtttgtaactgaacacctttagtatcttttctcttcatataatctatctcttgatacacttatgtttctacctccttggaaatcagtacccttatattgcccctctggctgttcttaggctccttctgaggagtacttgctctcataatacgtaatcaaaatgcaaaactttcatgtccttgctgttaggttttcagccatgttactatgttacattgaaa

SEQ ID NO: 122339 - DNA, 1022 bp, Homo sapiens
ttaacttgcagttgttttgagtgtcaagcatttttcaaccatttgtattttcttttccttgaactgtgttgtttgctcatttttaaaatacgattgttggtcaggtgcggtggctcacacctgtaatcctagcatttgggaggccgaggtgggcgcatcacgaggtcaggagattgagaccatcctggctaacatggtgaaaccctgtctctactaaaaatacaaaaaattagccaggtgtggcggcacacgcctgtggtcctagctactcgggagacaggagaatcacttgaacccaggaggcagaggctgcagtgagccgagatcatgccactgtactccagcctgggtgacacagcgagactctgtctccaaaaaaaaaaaaaaagattgttggggattttcgtattgatttatagtaatctttctttaaaatttagccctttgttatttgagtggcaaatataattcctagctttctgtttacttttgactttgtatatatttatttttcccatgtgaaagtctttatttttatgtcattaaatttatcaatcttatattttatgacttttggcttttgtggtattcttaggcctgctgcactccatgagtgttttcttctagtactataatgttttttgctttttttctaagttttcatttttttcttacatttaactctgatttattgtggggtaaagcatgttatagtgttccagcttcactttttttctgaatggctatccagttgtcccaagatcatttgttgaataattcattttcccccatttgaaatgacaccttttcgtatactaaagtcccaagtctcttagttataaaacagtaataaacccttgaaacaggcattttcctaaaatacattttgtttaagtaagacagttttcaagattaaagaaattagaggggataaatgttaattttagccttagttttgtccaataggtattgtttcaaatgtatgtaattggatgagaaattcagcagttagaaaagctaag

SEQ ID NO: 122340 - DNA, 1054 bp, Homo sapiens
tgaaagttgcctggcataaatttaacacagagagaaggaagattatgtcattattcctgattcccttggtcattcgtcttgtggagaacaattgctacattccagtaacaagttttctgaggcttactaatagctccatgacatattaagtactgatctcatttaattataatttcagtgagattaaattattctatgtagttaaagtagaatcgagcatcctacagatgctgcactaattatagttattgatggcctactttttctgacctaaaaaggtaaatgagggagggaattgtctttgcctttgaggaattttccctctaaaatagattagttcactgtcattgctgtttattttcacctaacacttttctagaatcttcataaaactgcacagtactgaactaatcaatagaaaaggcagatgaatattctcccaaaggaaaaaaggcttggcaggtcaaatcaagcatgtcagatctctcttgccactcccaattagaaattgtaaagttttataaacaggtgctttaagcaaaagatgggatctgtggatcaggaatacatacacaagacactaattttaaaagctattacatttcttaaaatacttatctaaaaattctccttttaaattttttagaatctattctagaaaaaaaactcaacaaattatcctttgttaatgttttatttagtggtgtggctttttccacagattagattgtttactccttaatataaatgtgtgtgtgtgtgtgtgtacgtgtgtgtacacatgtgtttgtcttttttgttgtttgttattgtttattaatgtgtgattaacagaggcctagctttggtgctttcaggctgagaactaaagggatgatttgtagaaaactaaagtaggtcaaagaataccatggtgtagcaaaggggaagtccctgtgtttagtcacattgttttgcctctggtggagttcactttcattgttatagtctaggcctgtcttcctgtgagtggaagaaatcgtcaaattgcagaaaagtctcgggaatattatca

SEQ ID NO: 122341 - DNA, 1287 bp, Homo sapiens
ttctaattatagatagtatcttctattataatagagaaaaggtatagtaataatttcaatattttaaagtaatattaaagtaatttaatattttaaagaaaataatttttttgtattttaataaggggtcagtattttaagacaccaagaatattacaatcacatatgtcagaaagagaaatgtgtgatccagggtcttttctacacctgaacacacatttatcttattttttggcctgcaacctcgtccttattacaatggcccaatatcttgcttttctttgttttttcatcctctagtcatattgttacacatttgaggctatttaagaaagaaaaaggactctgcttcagagttttctccctatgtcttcatgatcaaatagaaaggaatgtgtgagagggacaatcaggtgatttttaaaaccaagtgaatttatattttagttatttcaatcacagtgaattgttacttcttttaatattggaaaaataaaaagaaacaaatctctgaaaattgaatgagtaaatgaaaacaggaaaagaagaaactaaataacaatagttattcttataaatctgagaagcatcataataatagtattaggggaaaataattttttttataaacctataagaacactgatagtgataatgattctcagacatgcctaaagttaaggaaaatatatgcttataaaggttatgataatagatgtgaaaatgggaaataataggaatagagaactgaaaagagttaatgggctattaaattcgggaacttaaggagagagggattggaaataagtgcaaaattttgcaactcaaatagcacagtttcttatgtgacaggtaacctatgttacatacttgatgaggaaaacaagaggacacagtactattcttgataacttttttaaattgtcacagtatgtaatatgaagacatttaggcaactagagggtgtagaaagtaaaacagaggactggttattgttgctgttgttgctgttttgcctctgttacatatgtagagattgctaaattgttactagtttatcaccacacagattttgccaacctgaaagtgtactctcagcgatatagacttgtttatacttcatatactctatgcttgctatccctccctccctccctcccttccttccttcatctctctccctctctctctctcccacccactctcggtctttccctttccctctcccccaccccacctctcctctcccctcccctcccctcccctcccctcccctcccctcccctc

SEQ ID NO: 122342 - DNA, 1029 bp, Homo sapiens
tagtatatatggtccattgttgaccaaaatgttattatgtgacacgtgactgtatgtcccaatactaatagcggttatctctcttggcagtggtttatgcttttcttaatttttccaagatttctataatgagttaatctattataatgagaccaaacacatgtcattaaaaagaaaataagtcaaaacaccactttctattcatagaagagtggcttttaaggtaagtagaacttcagtaaactgtactctctgaaatgtctcttctaatatggtatataccaacttttaaagctgagatttttatttagaaataactttctttcaaacaccttggctgttaatgaagaatattttttcctaatgagttttgcatttgtgggttttttcccctttgtgtttacactgaataaaaatttactcctaattctcagcttttagcttttatgagcgctagatggcactcttgctcaaccaaaatctagtttgttgcccatattttggtgctgtgggtcttaggagaagacgggtttgcaatgtcacaacacttatgtttttaaaggggggttggggaaaagagaccaaagtttccaagtttaaatagccgagcttaactgatttagtgtttccatctattgagaaaataaccatataataacaacgataacagtcattcatttcacaaatattttttgagcacctaccatctttagtactgttctaggtactcatatgcactaaagggaaaaatagataaaaatcactaccctcgtagagcttacattcaaatgcttggatttttttttgcaggtgccactttaaactctgtacatgcattcacccatttaataggaggctgagacacaaagaggttatctaatttgcccctgttcacctagctagtgcagatggcagagcaaggattcaaactcagacatttggtctccagagtttattttgttaatttcaatactatactgcctcttgaaactaaaaaaacaaacaaaaaaacactttattttttattct

SEQ ID NO: 122343 - DNA, 1058 bp, Homo sapiens
aaaccagatcccagaggggcttataggctatttaagggttgtggactttatcatagaaataatggaagccactgggggattttgagcaaggtagtatagtgattgatagtgtgtcagaaggatcactctagagaatggatttccatggtcaaaagtggatgtgtgacatcaattaggaggttgtcctactagcctatgacaaaagtgatagtggactaggatgtgaggtagggcaggagggagtggaaaaaattaaaatgggtctgatagatatcaaggagttagaaaccacaggatatagtatttagttggatttagaagatgaggaaaataacaaaattaagcatggctctaaagtttttggcttgaggtacttggtgaattgtgcaattgttttctgagacaaaagagtggcagggggtcaatttaggggaaaaatgactgctgttttagacatgttgagtttaagttgcctatgagacatccaagtagaaatagctcctaaatgaatttctgcccccgataccgctgttctagttctgtcactgctatgtcttcttctccagattaaactcaccctccacttttatatctatcctccacatagctgtagagccatttatctaaaatgaaaatctatgtaactttactggcaaaagccctttagaatagaattgaatttaaacttcttaatgtcatatagtacccagcattatctggctttcacttacctctccagcttcactgcctaccattttagcatcagcctcacatgagaaagcaaatattaattcaaatgtagcactccataatgctttctgttattcattagtaaagcagcaaaagctgtggtgcatatgcaatttctgcagctgctcctgaaagcccttaattgctataggtcagctaaaagggctgtagttggcaagggagaaacgatgacaaggtggtagaatgaattcaattccaagcagctaaatctgttaaaaaaaaaaaaaatggacacattgggagatagcatcttttgtttataccccagttctcaatttattgattcc

SEQ ID NO: 122344 - DNA, 1059 bp, Homo sapiens
acgttgcctgtgggtgcccgcgaaccaacggttagcggtggcaggggctgactgagagcgtctgcttggtaagcactgtaagctgggttgtcacctttccttgacagggtttttccttcctccatttcctctgggattttggagacaaagccatctagggtggcctcccttagtccaaggactttttccagtgacttgcgtgggaaggactagtccagctgcccaagcgcggggtgtggtgggtgaggcaaggatttgggatcctgatcccaagggtcgcagggagcggcctaagtaaggccaagaaggaaggatgctgtggaaactggagcttcgcgctgctgcctctgattccgcccttttttgtggacacacgcggggtggatttgggatctccgcgcatttgcacctttgtttgcctttgcttagggatgttctgggctttatttgctcagtcaaatgaaatcctaggcagggctttgaaagcaagttgtcaaatccatctcgtaaaagaatccccagtattcctagataggaattcttgcaggctttaaggatacagcaggaaaaagaaagcaaaaccgtaaaagtctccaaaacttagtcgactttttcaaaagattcagtcatttgcttaaaattagtttgcttttaaaaagttattatttgagaaaagtcgaggtttgaacggccatcagtggactgataatcggtgtagattttaattctttacattgcagaattgcattgcactaaattctaaaaatttcgtcttgctaggcactgagtatacaacaatgaaaaagacagtcttactagttagaggaactagttgttagacatacggttacaataatacatgatatcactgggatgtctagaaggagatgacttagcccaatcttggaaagtcagggaaatcttcatcccaggggaaatgaagaccaaaagaacagcatatgctaaggcccagagtgagagatagggtactttcaggaaacgtcagtaagccaaatcatgcatacttggcggtgtggggtgggacgggaagggtgcttt

SEQ ID NO: 122345 - DNA, 1962 bp, Homo sapiens
aattattattactgttgagtgtttttgttttttagaggcagggtctccctaggtcacccaggttggagtgcagtgttgctttcatagatcactgtaacctcaaaccccttggctcaagcagtcctgcctcagcctccgaagtagctagaactacaggcatgcacctccacgctcagcttactattgagttttaagagtgctttgtatattttggacacacaagtcctatatcagacctgcattttgtaaatattttctccaagtctgtggcttgtctgttcattctttaatagtgtcttttgcaaagcagaaatttttaattttagtgaagtccagctttcatgtatcatgcttttcgtgttgtagctaaaaagtcattgccatacccagggtcatgtagattttctcctgtcttccagaacttttacagctttgtgttttgcatataggtttatgatccattttttagttttttttttgtaaaaggtataaggtctgtgcctagatttatgtttttattaaaaagtttctgctggatctgaaattattattttgatcaataatattaaaaggtgaaaaacttttttttaaagaccattatactgaatctgtacaactatattggtgccattcttcaaaactgttccttgagagagagacctgaagtcagcctaaagatgaggccagggagaactttatctggaatgtatcaggaaaccggactaacagttccattttagttatctgttgtcagcatgtgcagttggctgagtgctgtaagtgaaaattgttaggaagactttctacaattaagaatattattctccaattgaattaccttgttacttgtctacattgctggtttttgtttttgtttttttgctacttttttgcctagtcttacaaggttgcaaaaatcaacctgtgatttttccacaatagtttgacccttctctacaatgaaacactgaagccatgtaaacttaaaatatctctttctatgataactgacttcaacttaagtttttaaaggaaattatactaattatttactgtatagtagcataagcagttttgcctctaaatgcttccttagtttttcttttggcttgttgaaaaatgtcttgtcaaccaagtactatatgtgtacttttatgtgtggggtatatgtgtattgcccaaatgaatcataaaggctcttaatttgaatctgtatattttatttttaagttttccttaacaaggtcgatttgaattccttaacaagattgatttgaatgatattcttttcagcccttcaaaaacatattttctgaaacactgtcatacatactattctcagaataccatgccccttttttctatgttattttggttccatctttcaggaataaatgagtaaaccacttaaatcaagtttactcttcagtattttctccagtttttctgtttttggtgtctccaaatttactatagtatgctttgaatgactaaatctctagtatttctgacatatattaatggatagatttttaaaaaccaataattgttgaatctattttcattttgctcttcttgaaagatttgtgagcgagctctagcaatatacgcaacatacaatatgaattttataaaccagtctcactactgattttattcttatttttctacttattttccttatccacattttacatgaatatatacatatataggggtaagatattaaaattatatgtcatttttaaaagcattacatatttcaaacaaaaaataagagtaacaaaataaatacccttttaaactaccccttggaatgaacaaatgttaacattttacctagtttgctttagtttttgtttttttttttttcaatgaaatgaaatatcacataggttgtgaaagtgctcttggcacagtcatatattgtctttgtcttttaaaaaaatgttacatagaaga

SEQ ID NO: 122346 - DNA, 1049 bp, Homo sapiens
gccaatttatcttcataattttctttgtaacatggatcgtcccctcttcccctaacttttcccctcttccggagaaaagcccatgtcctcctcagatcaaaatttttgtgttcatttactcgtttacctcattttattgagcccctgtgaacacatccgagagatacatgatgaataaaatacagttctctctcttgaagatctaatacactgatttgatggaggaggggagccacctatacaggataccccctcatatctttactcatcatgactttgcatttacctatttaatagcatcagaaaaatgctctcaatatatatttttgtaaagacttcttcattaaatctatgatgtcaaagattataagtcacagcattattttatgtatcacaaagaaaaactgctgccaaatatagtttaaatgtgaatcctgattttggagatgttaaatgtgaaaaaatgtatgtattaacatacagtagtaaatatttattaaatattagatgtattttgttgtatgtatttctattacattaattgaatttagttaccaaatgcttattaaatgactgccatgttaaaaagtccagtgtaatagaataatgaataagatgttgtccctgctcttaaggaagtataaaggaaggcaaatgggtacagacattgctagaataaagctttgtttgccatattgttaaaatccattcatctgtaaatggacacttaggttgtttgtatatatttcttggctattgtgaataatgctgcagtgaacatgggagtgcagacacccctttctgtacttattttttttttgctttgggtatatacccagcagtgggattgctggattatatggtaatgctatttttcattttctgaggaacctccatactgttttccaaaataactgtgtcaatttacaataccacctacagagtataagggtttctttttctccacatccttgccaacatttgttgtcattcatctttttgataatagccaatctgacaggtatgagctgatatctcattgtggtttt

SEQ ID NO: 122347 - DNA, 1038 bp, Homo sapiens
aaatagctaaaagagataattttaaatatctcactacaaagagatggtaaatatttgaggtgatggatatgctaattactctgatatgatcattccacaatgtatacatgtattgaaatatcaccttataccccataaatatatacaattattatttgccaattaaaataaaactaataaaaatacaaaatgtaaaactatatttgttaaagcaactaaattaatcagataaaccatgattaatacatacattaaaatatggctaaattaatgatagttgattttgtaaaagttatacattaacaacttcaaaaatcttctattgttaattttttattctttcattgttagaagttaggggtagtagtggataaaagggagaaatggtaggaaatatttatttatgggtatatatgtattttttttttaaaggagagaaaagagagaaatgacactccttcagagtgtcattttaaaggaatttcatgttgttctcagttgtagtctccacactactctatttgtagggaaaacaattctagtagttgtaatgtttgttttctttgggaaatttacaaattagattacgctcagccaaacatgtttctctgtttgtggatttatacaatggaaaaatgttaactttaagctggcatctatgtgctatcagtagttttattagttggcccacccattgtcggtgtgtgcactcagggaatgcaaacttattttaattttggcttaaataaataacgttaagaaaataaatctgttattttttttaaaaaatctgaagccaagtataaagaaaaatttgattatttatgatttatggaaagcagtacagaaatcaaaagggtccacagttagagtccggagacctgggtttgaattctggctttgctattcattttttatacatattcaattagccaagtcacccaatcttttcatctgtttcctaatgtgttaaaaagtgactgtagtaatagtaatagcattctttaaggttgttaagactaaatttagcgtgtaaaa

SEQ ID NO: 122348 - DNA, 1086 bp, Homo sapiens
ctggtggtaattggaaggccctcagcactttcagcatttggcatagtgagatgtaagttaaataagcacattggaaacggatgaaaaattgcaacattaagaggaaagtaatacatatttttgtaggtgcattttaagtaaaatgtatatagttgttgttgttgtttttgagacggagtctcactctgtcgcccaggctggagtgcagtggcacggtctcggctcactgcaacctctgcctcctgagttcaagcaattctcctgcctcagcctccttagtagctggaattacaggcgcccaccaccaactccagctaattttttgtatttttagtagagacagggtttcaccatattggccaggctgatctcaaactcctgatctcaggtagtccacctgccttggcctcccaaagaactgggattacaggcgtgagcctggccagtaaaatatatttttatcaattaacctcccacctcagctagccaggaaaatcagattttgtccttttgccttctgggctatttgacaacgtatgctgttcctcatgttaataccttaacagctgtgccaacaagtctggtttgaaaaaaaagtaaggggcttaatggtgtgtctctgcagcctatcaacatctctgtgcatcagtagattacttgagcctttcaaaacagttgttcacctcagacatgtgggtcaaacgtcactgtagttaacatactgaagcttgctaatacgaataagaattggaattatgacttctgagctctcaataccaaggaaagcaatgttatgacaaacccgtgtttgtgttgcttcgtcacagaataactcagacactacaatcagtagctagcactctctctgatctgaatggtatagacatcttccttttaccttatattgctctgacttttcggtaggttttgtcttggagctccacatagcttttaattcatttcagtttagcaagcctttattaagtattaaattaggtgctgagattgcaaagatgaataagactttgatgaatgaggcgtgcagttcagtggggaagacatgaacagattattatttcaatatat

SEQ ID NO: 122349 - DNA, 1136 bp, Homo sapiens
gttacttcactttctgcagtcttagaaaattcctatacttagacacacgcacacacacacacacacacacacacacacacacacacacacacacagtcactcactcataggcaaacatttgctctgggggtaggatagttttcctgagtgaaagaggtgctctagtggggtgtggcaaggatgagagtcagattagaatttttatatcatttgctctagacaggactgtgttgtgagaaggactcttgaggaccttcacccactaaaaacggggaagttagcagtggttgtttgtataactggtttatttgtaagttacacttttggattatgaaactccccacagtgatcagttggtgtttattttcattctgaagcaattttagtcatctagcaactcatttggatgatgtgcttgctgtacaatgaaatttgcagttttaaaagaccccagagcaactatggtgtgtaatttgtgcagtgttgtactactcttggaatagataggaaatgtatgtttgaattaagaaaagactgcttttctggaaaattacagaagttcttaaataatttttttttcactgtggcattgttaagaagggattaatttttcttaaaaagagccaggatactctggatgtaatgaaaatattaagttagtgtttggcctgtaagcaaaagagggaataccaaatgtcagactaggattgtaaatcatcatctttggcaggaacaaagtttgctgtttgtcttgttatgtctggacagttaccagggcctgtgatgaattttccaatttcattatcaaaatcccagagtgtggaagcatttacatagactctagggtacaggtattagtggtctgatctcactctttggggttcttgttttaaaatggatgagactttttatatttagaggaattataaatatggttaaatgtgatggaaagggaaacaattttataatttttaatagtgtctttgttttatagttattttgaaaacaaatcaacacctgtatgaaattataaagtacatttgagaacccgaaaataaccccactgccaaagattctgagcattcagaatatagcttggtatgcattctatctactgtatttcagtggctttaaga

SEQ ID NO: 122350 - DNA, 1640 bp, Homo sapiens
gtttttacaagatatattagagagaaaatgtgcgcctcttcaaagtgttagtcattatttttcattttttgaagaatatgcattacttgtacatttttctggctcagtaacaaaaatatactgcttatttttcttatgttactttgattgtaagtgttcagaaactttcacttaaaatatcaacaaaattttttttcaacagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaaggtaagaaatgcagtagttctcagaaaccgggggttactggagtttacagttcaaaaataataaacctagtctaagccgatgtactcagatatctttattcttatatatattcaaacttcatgactttgttctcagaccttttgatatttgtgagaaaaagatacagttttgaacttacctctatcatatcttacttatcataattcataaattctagaaattaaaggaaaaattaagattttagacaagttgtgtttaaaaattagaatattttcagaatagccaacaaactccaatttaacccgtaattgaatatttattttttattttatttatttgtatttgcagttaacactaaactttagaatttgaaatacagaacaacactagtaattaaacaatgtaaaaccaataaaaatgaatacaaaagaattttatttaatgagaggaaagcaaggttaattagaagacataggcaaatgggggaggcttctgtggaaattatgaaaaattttagaaatttagaacataagtcttttaagtaatttcacttcaaaacttaagactttctttttcctttttacactacactcatcctcataaacaaggctcaagtttgtgtttcaacttagaagtagaatgaacaaatggggagaaaaatatttctgaggtaattggacaaaagtagaagaaaggggtgaggaaagtaaagagttaaaggattagaaataggttgctttctgctgtggaattaactgttctgccagcagtcaagaacaggggaaaatgagagtggtagatgcatatacttgagtttcctgaaagagaagaaatatattgataggtaagaaactttcagcctctgtttttccagatgatgttatttccatcaacaaccaggatatttatcatcccacaagttactgacatcctcctctttcagaagtgtgccctctgaatttttaggaggagacaatattaaaccagttctgtgtaattaatgagctgtttacaaatgtattttcataactctgggagagtcaatactcagagataaaggaggccttgaacttttagctcttgatgaattcacatagtacatttcttgtgataaccaaatctctgatctatatgataatcaggtaattgactggttattattttgtctttttattttattttattttattattattatactttaagttttagggtacatgtgcacaatgtgcaggttagttacatatgtatacatgtg

SEQ ID NO: 122351 - DNA, 1067 bp, Homo sapiens
aagtcattggtagcttgatggggatggcattgaatctataaattactttgggcagtatggccattttcacgatattgattcttcctacccatgagcatggaatgttcttccatttgtttgtatcctcttttatttcattgagcagtggtttgtagttctccttgaagaggtcctttatgtcccttgtaagttggattcctaggtattttattctctttgaagcaattgtgaatgggagttcactcatgatttggctctctgtttgtctgttattggtgtataagaatgctcgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttcatagatataagtatacagttaagctcagcccagtctcgttgtactcttctagagaagcaactagaatatacaaagagaatggttctcaacgtagagcgagaaaagaacatgatcctagaacaacaggtgagcatattttctataaggaatgataatataattttgtatgtttttgaagaatattttaatttcacgggaaaattcaaaggcaaaggtggcataatgttagaatgaggtctaacttacgtgtaattggagtttcaaaaggaaaggaaaggaaaatggggaaaagcaatatttgaagagataatggctaagaatgttacaaaatgtattaaaaagtaaaattactagcctggccaacatggtgaaaccccatctctactaaaaatacaaaaattagccgggcttggtggcaggcatctgtaatctcagctactcaggaggctgaggcaggagaatcgcttgaacccgggaggcagaggttgcagtgagctgagattgtgccgttgcactgcagcctggacgacagagcaagactctgtctcaaaaaaaaaaaaaaaagtaaaatcttaaaagcatccagaaaaaaaaaattacactcaaagag

SEQ ID NO: 122352 - DNA, 1051 bp, Homo sapiens
tatatgtaatttctatgcttatttcttgtgaatttgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttcaatacttgggctgtatttttcataattttttcattttaaagaattttcaaactacaataacgaacaatatttccccaatatgacttattttggctctttcctttcctaaatatttgttttgtgtcttatttgtgcaatgagattcacagctacaaagccaaatagaaaaatcactataagtaatttgccagtggaacacatactgcccagtatgtatgttttatggcatcctttctctgatgggttaatggaacttttttcagtttacctatttattataaaaatagtgaaggtacagggagaagataaaagaaatgaaggaaagaaaaggtaactactggaagagaagagagtaattaacagcagaatcattttatggaagtacttagttcaaatcccaagttcacggggtatgcaaataatgatgtctctttttaaagatggagggagtgctaaagttgctgaaagtaggatcagatttcaagaagcctctatgagagatctgcttcccatcacactgtttctccatgtcctggacatagttcattcaactcttacatcttgatgtacatagactggtatctctaggtgataaaaagataagacaggaatttgtgagaaacagataaatatataagtataaaacagtataataga

SEQ ID NO: 122353 - DNA, 1037 bp, Homo sapiens
gagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtacaactcttctgaactcttggtttctcactcaaatcctctgaggcaactggggaactagagtcatgaactgaattagaaatagaggacagagagaaaagatataatagaatggaggagctcaaatatagggtagcagtttaagagatggtgattcctaagggacagagttggaagtacatatttactgaattctttgaacccacagctgatggaatgttcaagctatagatgtgaaagaatttttaggtcaggatcttgggaagctaaggagagcaatttttaaaagacagtttttctgttttcctaggaaattcccaagaagcttgtgtaggaaaaagttggtaattatggatcttttggggaggaagagaactataattcattctaatggtgaggagagataccatgttagaataccttccatacctggaagtggggaagtgactgaagatgggcacattgatgcttga

SEQ ID NO: 122354 - DNA, 1068 bp, Homo sapiens
agtggcaccatgaaaattaaaaacctgataataccaccaatgtagtactctttaaaaacatgtcatcttactcagcaatcaacctgattgaatattttaaaatgaataagtggataaatatcttacctgaaagatagcttcattaaataaactaactcctgagaggatttctttggcctttaatatcctatttaatagatttcttataaccatatcagcaaagccactctgctctggacaatggtcagaaggtaggaagaagtgttatagggtaatgagcaataataaggccaccaaatataatcccattgtaatgggattctacccacttgtagaagtttattcaccactacaaattactaaagttaacctaaacaattaaagaaagaaatcttagtctttaagaacagaggattgtaaagtgagccagaccttccaatcagctaaaataatgtaaaataatgtacttttcaacctgacttggcttaatgtagttaagtaaattttaggataggttctaaaaaaccttgagaggcattttgttgttgttgttgttgttgttagtttgccttaaagttaaatgtacattgacctttggtatttcttagaaaaacctgttactgaacctagtacagaatgtgaatcatttcatgcctgaaatacaagattgatgtttacagggcaattgtccagaatcttgctgaattggaaagtatttcactcttcatcactgtagatccgtttaactttacaaatgtgttatttaaaacataaaccattttggtgcacaggaaacccacttaaaattaaattttaaaaagctctcgagaagtctgtggaacatttatggttttataacttacaatttctagcaaaagtatctttaatatcttacaaaatattttcagagatagcttatccaaaatatgtaatacatgtgagagaatagcactgttgaaatgcttgaacacataaaaagcattattgccttcattttccctgaaatgaaccaagctaccaatttaaagctgggaaagtcagtaccagagttaaaaacaagttacttta

SEQ ID NO: 122355 - DNA, 1048 bp, Homo sapiens
atctcagctcactgcaacctccgcctcccaggttcaagcgattcttctgcctcagcctcccaagtagctgggattacaggcatgcgtcaccacacccggctgtttttttttttcgcatttttaatagaaacggggtttcaccgtgttagccaggctggtctcgaactcctgaccttaggtgaactgcccgcctcagcctcccaaagtgctgggattacaggtgtgagccaccgcgccctgcctagagtttgattctcttaaaccgttctactaaaatactatcagtttaaactaccatctacagaaataaaaaacataaaccactaaaagattaaagcatttaggagtttatatgcaaagaagtcttgcaagggagtacaagctttaggaggacaggcttatcaaattaaaaaatgaaaaaacctacaaaattaccaaagtcaccaagtttagttattcttttcatggtggaaaacagtttcctcagataatcatcatatcagaggtcatcatgtatccttagatatcagcattgccaagaccagggatatagttattagtaatttacaggaaaggctcaaggtttcatttacatgggaaatgagaactagacagtgtggtgactgtttttgttgttaaccttacctcagtgttttatctcgggtggtccccaagaccaccttcaggatcagtgattcactggagggactcacagaactcagaaaagctgttaagttatggttatggtatattatagcaaaagaatatatattaaaatcagcagctgaaaaaaggcacatagggcaaagtctgggggacaccaggcacaagcttccagttgtccttcacctgtgaagtcatgtagacagaccataattctctcagcagacagaccataattctctcagcaacaatgtgtgacaacattcttggagaattgctaaccagggaagctccaccaagccttggtgtccagattttttcttgagggttggtcacgtaggcatagcatgactgatagcccatgtggctgaccttcagttttcag

SEQ ID NO: 122356 - DNA, 3797 bp, Homo sapiens
attgacgtttacactcacaattaactaaaagtacatagtctgaagaaattgttgcatattttagaagtgtttgatacattcccagggcacaatttatgtactaggagaatttttcccattgtttttatatttgtactagtacagtagcattgaccactttgtatccttgggtggaatgaaaaatgggatatggttgtcttcctcaattagggataaattctagctgtaaagacttgaggaaatactttatagaatttaacacatggcaaaatagaggctcaggtgcatctttaaattacaatagaggaccatgaaacttaggattgttgtttcttttgtcttatctaacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatcaatagaaattatgctgtagttttccaataatttttgagaggaatactatcttggttttataatctgaaagctagtttgtgactttctgcctttttagttcatattgcatataaagtaaaaaccaagaactatttggtataaattactatcaagccacatgctgtgactttgaagtgtggttcttgttattttgtgggcaaaattatgttctattttatatcagtggacttgaactaagaatttactcctctgtaagccttaaaacctgtaagggtggactgaataattcactttagaaatcatgaattttgggttttgtattagccttaaatatagtcacatttggtttaagtaatacaaaacttgatgctaagcttagtgactctggtaaacattagaaacaattttttttttgagatggagtctcactctgtcgcccaggctggagtgcagtggcgcgatctcagctcactgcagcctccacctcccaggttcaagcgattctcttgcctcagcctcctgggtggctgggattacaggcacccgccaccatggccagctaatttttgtaatttttaatagagatggggtttcgccatgttggccaggctggtctcgaactcctggcctcaggtgatccacatgtcttggcctcccaaagtgctgggattacaggcatgagccactgtgcctggccttgtccagtgttttttagtcattc

SEQ ID NO: 122357 - DNA, 1131 bp, Homo sapiens
aattactttaatatgtgttagataaactaataactgtcagacctgtggttttgtaatattgcttagagacaagattaatgaagatttcattagtattagaacgtttttgaaaactgatttaaaggaaaactgtatttgtactgctgcatatttgatgatgtaccagttagaattagtttcagctatgaaggacataaacccccaaattacaatggcttaagcagtggactgatttacttttctctcatgtaaaggaagtctggactagagttcagctctgcaaccattagggactgaggcttctttaggtttttactctttcacctctcaaaaatggctttgaccctactgtccaaggtgggtccttatgttccagccatcacattgattattttcctgccagcaggatgaagaagggaatgaaagaggcttgtatcttactttaaggatgcttcctagaggttatgcgtgatggcctggaagcactggagactaggaaatgtcttttcaggaggaagggaggtgttgataaaaattggtgattctatttctaaagaagagactggtatttgggggcaactgtcagtctcttccacaggtagtatttaagtgttgtaaaaattgtgaaaagtactcaaatgattgcaggtcaggaactagcgttatagattgtgatattttaaatagctttgatgtatatggtttttcttttttctttttttaatagtttccacggccactccagtgccaacagccaattctacaggtaattcaagatgactgttttcttccttttccttcagtatttttaagctttcttgatggattagttttaaataattatgtaaaagttgttagtataattttaaagatgagtaaaaacttaaaagtcttggaccacagcaattaacgttaatctctaccttttgtgacagtgacacatagctccagtgttttatagtcggtgaatgtgagcagatttgctgaggctgtgtacattgagtctataaagtactttttatagatttagtggaaatcttgggaaatatagaagcctaaagcaaattataattctcatcatccagagcaaccaaaatgttttcagtgattaatttcttctagtctttttta

SEQ ID NO: 122358 - DNA, 1925 bp, Homo sapiens
ataattaaagctcagtcgtttgttttttatgagatggagtctcctgtgttacccaggttggtcttgaaatcctaggctcaagcaatcctccaaccttggcctccctagtagccaagactacagatgcgtgcttcctcacctggctttttttaaagcctgttctaaggattgagagtactttaatacactggaattagctgtgagtgaaggttgtgttgaaaactgtgtcctgcaacatgaaatataaagagaccttatgaaactgttggatgcttaggtgtagagaagaaagaggtagggagagttgacttcctgtgcttttgttaatacaagaggtagagcgctaaagggacgtacattgaaattcaataagattcttattagaaccatattactgcatacattattttaattgttttttaatgtaaagtggttgcacttatcagtaaaacaatctagttgttttggcggttttttttttaagtaaaaacaaaccataagtttttttatttggtaaaaattttaatagttctagaaattatatcactacataaatttcaaaaagctctttaaggtattaactaaattgggccaaattaacttttttgttatagaagtgtctcttttttttaggtcataaaatgggatttaagggcgtactctttcccctttatatgggagtatgtaagagttggtgaattttggagatggaatgctctactttaagatttgttgggaaaggttctccccttactcttgttccaagtctacctatccaggaaagttgttttagaaagtatagaagactaaagcagtgagatttggaatagagtttctacagtgttatggggtgcctcatctgtttactaacctcttaatacagaccctgaccacttcaacttactgtctccgcctttttttttttccctgagacagagttctgtatttttggtagaggcagggtctcaccatattggtcaggctgatctcgaactcctgacctcaggtgatcttcccaccctggcctcccaaagtgctgagattataggcgtgagccacctgcccactttttagatgatggctgcctttcttgattgtacagtagtcttcccacaattctgagatctaagtgttgcagatttattttttcagtatattaatgtggatttttaatggataaaagttagaaggatcctgcgtaatctctaagtcagtgggaaaaggagaatgacagggtttggtctgtgggtttaactttaggtcaaaacacctaaagtggttccccctgcccacttctaaagtgtttgggtttgatttcatagagcttagtagcagagtcaaagataatacaaatgggtggttgatgctgtttgtctcttttcccctgccccccaacagatgagagctattgttcacataactcaacagttagtgattgtcaagtggggaacacgacagacttctgttccggtaagtattcatattggctgcttggaagctgaccgcagagaggtgaggaagatcattgcctcagaaagccttgtttcagtgctttgtttgaagcattgccataattctcatcttgttagaattggaatatgaatagtatattcatattgattgattaaaggatgatatttgaagcttggtttagtgatttagctatagtgtggatgctgtaagtgtggatgcgttgtctgcccccacacttttttttttttttttaaacttttctaggaattcatcacagtttagccgctatgtttgcatcttgcaggtctgggaaacctcattctggcacttttggtgttgcgatactggggattgttgattgataaatttattctgcagcatagttggtgctgtggttaaatgagcttttctatacccatccattttctgtattttaatctgagtaacttgat

SEQ ID NO: 122359 - DNA, 1871 bp, Homo sapiens
gagagccgcacaaaaccaacttccgccccagtggagttgcgtccggaaggcgcggccccggaggtcacgtgggcccgcggaattacagcctggcggggcgctcaggtggaagcagtaggccacattatgtcgactgttccatgcaagtcagggtgggggccgtccctatcgcaggcatgagacaagtccagctgcgtcgtgtctggtaatctgagggcaagaagaacgatttgcagaagctcccagttttcttggctgtggcacagtcgctttgagggccaggttccttcggcttcctcccgactcccctgcttccccccgtaggattcccgttggtatcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccaggtgggcgcgggccctgtgggcttcccgccctcccctgcccagccgagccgcactgcctcctcgccgtgcgggcggggcccgggttcgggccacggtcgggcgggcgggccgcgctcggggtgcggcggcgactccggcaacatggcggccagcctggagtccactcgtggccgggccgggtggggagcgcgctggggggaagcggacgcgcggttcccagtggctgcggggctggggcccccctcgaagtgttgcaagtcgaggtgccttttaaaagtgcatcgtaattcctagcctcacttggggtcggaaatggggacgtggcttccttccgcgggggcagcggtggggttgaggatggggccgggcgtcgcgcctctgaggttggcggtggggccgagctgcctctccctgccactggttgttcaccctcccggcgcctctctccggaggtagccttctccggaagtccgggaaagagaaacttaaagacggtaatgctcgttcgtgtctcagacttgagtctgagaaggtcgcttgagatttaattacattggttttgcagataggaatagaatgtagctgacgtttgagcacgtagttagtgaaaacttcacacttcaaagtatgcgaaaaggaagaaaagtacccatgtatgtaccgggtgttttgcgtacgtatcctaaggctaaactggaaggtaggtagtgaaacctaggaggtagatgcagagacggagatgagtaaactctcctgacattgtatgtttattcttttttcaattgtttttaaaattttcttaactatgtcctgtgctcagatagcgtatgtttagtaggtcgtggaacgggggtttgtgcccaggtctgtgggttttctaaaacccgatcaggagcgtgtcttttgttatgtgcagtcgcatagggctggttaaggcatacatacattttaaagcagaaattgccatataccgtgacaacacaaaagagagaaggaagataagtttgaggtaataagcgggagaaacactagaggtttaaaacctgcagtctcgtatgattggttattctagttaacattagttaaggagtaatgtttacgtagttaacattggcttcttgaccgaagaatgccgaagtgtaatgatttttatcacggcattcatattctacaaattc

SEQ ID NO: 122360 - DNA, 1013 bp, Homo sapiens
acacaggcttgattcagacatacccctgggaccctcagtcttatctgctgtgatctcatctatcttgctcagctccatgccgaatacaatcgacagaaggacatctacctagcacatcgtgtggcccaagcttgggaattggcccagttcatccagtgtgtgagcctgggcttgaaatgggaagtgggatgggacccaggggctgagggtgaacaaggccccagtcatggggaagagctggtgatggaagaactcccgcctcaccaacctggttcccccagccacacatccaagaaggcagacgtggttctgttgtgtggagacctcaacatgcacccagaagacctgggctgctgcctgctgaaggagtggacagggcttcatgatgcctatcttgaaactcgggacttcaaggtgaggacttgcctgttacttccccacctatatccccagcttctctccctccttctcccccacatcctagcatgagccaatgattcccttagggctctgaggaaggcaacacaatggtacccaagaactgctacgtcagccagcaggagctgaagccatttccctttggtgtccgcattgactacgtgctttacaaggtcaggctcctcccttcaacatgctttcatatgctgtgtctctttgtctactaacctgtgtagatcctttgctcagctagtctagtcttggaccactgatgggtggaaagtggggtagccgggagctggttctctgggaagaggccctcatatataagcttctctctggcccttacttttcctaggcagtttctgggttttacatctcctgtaagagttttgaaaccactacaggctttgaccctcacaggggcacccccctctctgatcatgaagccctgatggctactctgtttgtgaggcacagccccccacagcagaaccccagctctacccacggtgagtcacccccaccctttccttggcccttgccccgcttgaagcagcccttccactcttgac

SEQ ID NO: 122361 - DNA, 1051 bp, Homo sapiens
ttcaagaccagcctggccaacatggtgaaaccccgtctctactaaaagtacaaaaattagctgggcttgttggcgggcgcctgtaatcccagctactagggaggctgaggcaggagaatcatttgaacctgggaggcggaagttgcagtgagccaagattgtgccactgcactccagcctcggcaacaaagtgaaactctgtctcaaaaaaaaaaaaaaaaaaagttctcccctgggatttacaaggcagcaggaatcatattctgggctaaacaccttataccagccacagtagatgtgtgtcagctccatgagggcaggcatttctgtctctttgtctgttgcttgctgctaattgccagtacctggaacagtgccaaatacatagtaagcgctcggtatgtatttgctgaatgaatgaactagttgagtgcctaccatgtgctagatactgtgttgagagttaaatttgcatctcccatctaattctcatgagtaccctgataaattaggcatgttgtctctaagtgatggacaaactaaagctcttgagtttgtggcaagtatatgacagtaatgatatgggcagaacagagcctgggacacccagcagcagggtgaatgttgaagaaagggctttgagaattccaggctgctggaattctagtcccagctcagccttcaactgctgtgtagtctagggcagccccttccttctctgggccccaggatgtgcaccttctgcgcccaagggggtggcactggcccactgaccctgctctcagaggtctctgaggttctgctctgttgaccatacaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgg

SEQ ID NO: 122362 - DNA, 1466 bp, Homo sapiens
aggctaagaattcctaccccagggcttggagatccctggacagggaggctgaactggaggctcccctggtgtcccatgtgccctctgtgcccaagactaatgtttttcacttccaaatttggcaaatttcacttggagtggactggatagcagctgtctctggagcagatgctggcaggggaatgggctgggaggagcagagccaatcactggtgaatcccgagctccctggggacaccagcctgctctcttcgcctccccttcctttttatttcttctgttctccagcctcttccccttctttttccacctctccagccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaaggtggatacacggtgcctgggatggggtgtggagcatgcggggagtcagaggacggacaggatgccatgccctcactgccctgtgtgttcacagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagtgagcaccacgtggtggcctggaggggcgggtgagcttgggcctagaggcaggccagtggggaaatgctgggacagccaaatgtcgaagtggacaagatccgtatcagccaggtgaccttgaagattcaggtcccccatctataagtgggcttttgggctgagtgattgctaaggccttttccagtctgaccctgaccaggcacacactggtacatggggagcttgtgctgccctagggtccctgttcctaatgtcctctcccttccaggcatcaggcagctccagctgcttctgctgaaggtagcattgctgctgggggtggaaattcactggggtgtcactttcactggcctccagccccctcctaggaagggtaagtatttctatgctccctggaatctccccctcccccatcaagaacttggccagtgtctgaaaaaggatgggccaggagtgtccttttctgtttttgttttgagacagagtctcgttctgtcacccaggctggagtgcagtggcatgatctcggctcactgcaacctct

SEQ ID NO: 122363 - DNA, 1032 bp, Homo sapiens
cttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttcc

SEQ ID NO: 122364 - DNA, 1079 bp, Homo sapiens
aagtgatccaccctcccagcctcccaaagcgctgggattacaggcgtgagccactgtgcctggcctggatgttgttttttaaatacaagtttttcttcttaaattcagtaaacatctcataggatatggattttaacacatgtactgagcacttactgggaaccagacattgttttaggctttgaggatacagcagtgaatgagatggacaggcccctgccttaaggggccaacattcaatagggaagacagagtacagacaagtatataacacatttggtgttgtgagtgcgttgaagaataaaatgcaaggtaagggggcgggatgccggaaagagagttgctcttttatgcatggactggtttgggaaggtctcacagatgaggtggcatcttggatggagatgagaatgcagtgggggagtgagccagccggccattgaagatgtccaggagagagcattctaggcagggggagccctgggcacagggccctcaggcaggaataaatgtttttgacaagctggagacgtgctgggaggagcatcaaggcagccagagagctgggagtaggaagtcatagtgtaggtggatgttctcaatttagctgcatgctttttaccacctgggaagctttaaaaaaaagccttgtcccagctgccaagattctgattgacttcacctgggcagagcctgggaattggtgttttttaaagtacccctcaacagttgtagggtgcactcgggctgaagtactttgaaggccacagtaaagattggattttattctgagggagatggctttactgagatgagtgacatggcatgacttagggttgtaatagggtcactctagccaccctgtgaggtgggggcgaggccagggtggaggcagagagacccatcaggaggctgtgcagtagtggggctcggaacagcacagtagcagcagaggtggtgtcaggtggtccagttctggagatagtccagggaagaattcatgtgattcgctcatgattggatgtgggagttgaaagaggaggcaaaagccactgtgaggaggaaaagctagggaagac

SEQ ID NO: 122365 - DNA, 1023 bp, Homo sapiens
gctgagctagtgatgtctttgctttctgatggttcagtgtacacaaactttgtttcatgcacaaaattatttaagacattgtgtaaaactacctttaggctatgtctataaggtgtatatgaaacataaatgaattttatgtttagattgggtcccatccccaggatagctcattatgtatattttcaaaatctaagaaaacagaaaatctgatttacttctggttccaagcatttcagataagggacactctacctttaattagttataaaggaattaggagacacattaagaagcaaaagagccagtggacaagatgggctgtctcttgtcctgagccttcatttagaaatataattgggtagacttgctctggaggcgaagttcaggtcgttattgttctctgtgtatagaggtggattttgaggaatatttggagaggaaagggagctgtgttggcagatgacatgcaggaagtgtagttctagcttgtgagggttggccctttcccaaactaacctattctttttggcacctagcaccttcaatatgctccttagctcttgtgactcgtctgtggtcctaatatgccttgtggcccaggcctaacgcagcactaacagtcatacagcccagtgcaactaggagtttccagcagagattcagcaacctgaagttatcctgggtgaaattgcagtttgcctttacaagaaggtgcccttgcttaatatgtgatgacatagggaccttagcatcacaataagtgaccatttcataacaaagaaatgaacacataatagttgacgttaaaattggtagctaaacagaactaggtctgcatgtgtctatttagcaggggacggggagatgaaagttgttaggataatttttactcttacttgttcaagattgttagcatatatgtatgcatttattgcctgccttgttccaaaaggatttaaggaagctccctcccacccccatcacagaaagtagaataaaacaagaaccacatggtgagga

SEQ ID NO: 122366 - DNA, 1011 bp, Homo sapiens
attctagattaaaagatttaaaaagatgtaacataactttacataaagataggtagtacatgatccttgattagattctggctttatcaaatccagctatagagggtattatagggagatggggggaaaattggaatataaattgtacatatatattgtattgatgatattatgattatgtgttacgatacctgcaactcatttccagaggttcagaggaagaaagcatctatcaggagtgggggagggagaaaacaaatgcaacaaaatgttaacagttggtgagtctagatgaagggtatatgggtgttcgttgtactgttctgttgtctttgaagatttttttaaattaaaaattgggaaaaaaatcaacagtggagaaaaatttagtggagggaaactttagggaaatttttaatccccaaaatgctgaggtccattttgaagcatactattaaatgtaacaaaggctgaggatatacagtgttgatatattcaataggaaggaaataagaacgagtagaaacaaggcctttctggaagttacctcttaaaaaattggtgtgaaagtggatggtcagctgcccaccagagggcagtgcaggcagtgattccgcggtctacagtaggccagctgaaaagcaggggttttctttccctcataactggctccacatgaggtcgctattctctgcacaaaacgtttttaggattcttagactgtttgagaagagagagaatgcgggtaggtatagtgcttcccatttctttccctccactctgatctatttccagattctgtgggttttagcctttggctcctctgattcatggattctttggaaggatctagatattggaagtacagatctgccttcctaagtatgtgtttcgaagtccaataatgcatttgcccatgagcatgtcaggatttatatctgtttttaaaatcacaaactgccaaagtatcatcccattgcaattaatctttaggtttcgtaggatttatta

SEQ ID NO: 122367 - DNA, 1036 bp, Homo sapiens
ttccctctgaagatctgttaggagtgctccagttgtcctggtcccttggtggcagctgttccgcctggctgcctctagtcagccatcttgcccagcaccccttcagtatttatttaataagactaatgtgattgtgtttagtcagaacgctccaaggaactgttttaggaaagaaagaatgatgataatttcttgtagcttatctataaaaggtcatttgggaaggacaaccattttaatcatttatgggacttttgggtagattttatagttactatattaaagacatttgcagacatttatgaaaatttgtaagtagttttttgataagctgtcagtactttagtagctataattgcctaagcgttcctaattatatgttgagctttagaatttttaccagagcttcttcctggtaaagcttaaacatcagcctccaatcagttagattaatctctaaatttatgacaattaaattcatctgacctggttactgggcacatttcagacatcagactgatctttatcatgaaaccactaggaatattttaattttaaaattgaccttttggagtcagcttttctttaatctgccagttatacataacagaaatatttctttaaaaagtaacctgactttattaatgtatttaatttcaaaaactaaagtggtataaaatgtgtatagggcaaaatgctttgataaactaatgacattcctttttatttatagagatactttctagttgggagcaataatgcagaaacgaaatatcgtgtcttgaagattgatagaacagaaccaaaagatttggtcataattgatgacagggtaagtatcctccaaacctgactgcaaaaaaactttcatacctgttgtttaaaggacatgaaatatccttacagtttttagtgatatattatttttatcataaatctaaaagtttccgttatttttcttggttggctagaatttgaatctccaatctgatttctagaaatcactggtgtcaagaagtacgccagaattatactt

SEQ ID NO: 122368 - DNA, 1058 bp, Homo sapiens
aattcctgatctgttcctttgttatttgacagccagcaggaagtttgggaaaccactggatgggatcgtgagcatccatcactaagttgttttatgtggtcctagggcacatgaatggaatgacctatagttcatactactcagttctgttatcatcccagctccttttgatacacagcccttaggtacgtgtcctttttctgccactgtcgtctgtcagacgacactcttctaagcctctagtatgttgaaggggagtggcaaaataagaagtatcaatacggtacactgtgatggactaagctattgtttaaaacaatacccttacaaatagactgcagatccaagataacagtgaaaacaccaaaaaagtgtgagtctcagactagttagggggcagtatgatttggtagtagagatgtcactttggttccagagagctctgttgtacaaaggcactgggtaccttgcggggggttttgtccttctctgctggagtgctgttctcagtggaggctttcaagataatagctggctggcatggtgaccccccatacaggatattacactattccctgttagtgggctgatgagggtcctctccagccaccagaattgcatactactccattctctcatattgtcctttttaatatactttgcttggcttccctctcaagtgacacagccttttttattttggagagagaaatcacttttgcatgacgaccatcatcttgtcttctggaaagtactcagtgaaattggtctggggtcagaagtacatagaatgaagatgaagaaacttgttctggtgttcatcatgttagaaggatgaacaggctgattcttggtggatgtctatgccaagctgaagcctttaattgttgagagacatttccaattggtagtaacaaggaagtggaaaataatctcatttataatatactgaagccatttgtgctggaagaagagtgtctcttttgtgcagtatgtttactttcccttatacaaattatgaagggaagtgtagaatgatataaatagcctggtgctaa

SEQ ID NO: 122369 - DNA, 1050 bp, Homo sapiens
agagatacttagatttttatcttcagatgaaattagacctccgttcagctgtgtaccttgcctgcattcttctagtttgtaaagaatgacatttattgaattgtgccttggcatatgaaacagcattgagaaatgtgtgcttgacatcgctggagaattctcctgaggttgttctctacagcacatatctttttatgtggactcactctgaaattgtctcccagttcttgtaactgctgtagcttctccaagtagtggtttagtttttatctttcagccactgtgcatggtataattggatgtgtgttcctctttgcattatctgttagaaaatggagagccaaatgtggggaatagtacataggatcttaagatgcattcttatgtacaacttttatttttggactcatcttactatgtttttaaacattatttcctttactgtaatttcctcttcatttttataatcctttgtgtgtgtgtgtgtgtgtgtgtgtgtgtacatatatatatatatatttaattttggtaaaaaacagaatttaccgtcacaatcatttttaagtgcacagtacagcagtgttaactgtatgcatcttgtgcaacagatcttgagaattttttcatctatgcaaaactaaagctctatacccatggaacaacaactcctcttaatcttatatctatttgtgcttaaggcacctcagtcctatttgcagtgagactaagaggaatgaatgaattaaattgtttagagtaatttttttttaaaatttaagttctgggatacatgtgcagaatgtgcaggtttgttacataggtatacacacatgctgtggtggtttgctgtacctatcaacccaccatctaggttttgagccccacatgcgttaggtatttgtcctaatgctcttcctctccttgcccccacccctcgacaggccctggtgtgtgatgttcccctccctatgtctatgtgttctcattgttcagctcccacttatgagtgagaacatgcggtatttggttttctgttcctgtgtcagtttg

SEQ ID NO: 122370 - DNA, 1035 bp, Homo sapiens
tggtagcttgatgagaatagcattgaatctataaatactttgggcagtatgggcattttcacaatattgattcttcttatccatgagcatagaatgttttttcatttgtttgtgtcctctcttacttccttgagcagtggtttgtagttctcctttaagaggtctttcacgtgccttgtaagttgtattcctaggtattttattctctttgtagcaattgtgaatgggagatcactcatgatttggctctgtttagagtaatatttttaagtgaggtaaatgtcagtatagatagtcttagagaataatcctaagacacctgaaaatttgtatggctataaatcatagaaataataaagtgagaaatgtatcaaaggtctttggccttttaaataggcatctaaaagccattactaagtttataaagcatatttctctttattttttgttgcataggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatgtatggtggtaactacctttttttttttggagacaaggtcttgccctgttgcccaggctggaaggctggaatataatggcatggtcatagcttgctgtagccttggcctcccaggctcaagtacttttttttaatgtcgtagatcaggtagaaaataaaatacagtttagatattatgaatgttatgtaaaaagatcaaatgttggctcagaattttagaatttttgttaagagctgttaaagactccattatagcaattggcaagaatcaacaatggctactattaggtgagaggttgttattgaggaatagaataatcacatagtcccaacattttaaactccatggatctctttgttatttacagaggaataagtatttttatgatgaaaaaaacagcagacattcttatccaaa

SEQ ID NO: 122371 - DNA, 1012 bp, Homo sapiens
cactgcagctttgaactcctgggctcaagtggtcctcccacctcagcctccccagtagctgggactacagacacatgccaccacgcctgactaatttttgtattttcggcagaaatagggtctttctgtgttgaccaggcaggttttgaactcctgggctcaaacagttctcccacctcggcctcccaaagtcctgggattacagacatgagccacagggcctggccagtttataaatttaatgtaacattgatccagattccaagaggatgttttgagaatggaacttgacatgattttaaaagtcatatggaaaagcaaatgtctaagcatggtccagacaattgaaacaagaaaaacaagaagggataaagtcaacaagatggtaagacctataataattaagataatcaggtagtaagctatagtaaataagactgctaagtattggtggaggaattgatgggggtcaatgaacagtgttgagaaagcctagaaaaagatccattttatgtggcaaactggaatatgatagagtgagcattacaagtcattgggggaaaagatgggataaatagtgttggttttccagttggacaaaaatgaaatttgattccattctctgataatattcaggaagcaattccagaagtacaaagataattttaagaaaataaaggtaaatatttttataatcctggtatggaaaaggattttacaaacaaaatacaaaatgcataaaccataaggcaaacaatgctatatttgatactgtaaatattcaaaatgtatttataatctagacaaattttaggaaacaagcagcagtctgaaagtagatatttgtaacatataacaatgattattatttagaatgtgggaagaatttctacaaatcagtgagaaaaaaatacaacataactgagaaatgattaaaaggaacaggcagctcacagtagagattctgaaccttacctagtaatttgggaaatgcaaattaaaaaggtaccat

SEQ ID NO: 122372 - DNA, 1035 bp, Homo sapiens
ccagggacgtcccaaatattgataattgaagaacaggcaagtagattattacagcatcatgataagtattttactaccattgacgtgaccagtatgtgggcctgatagatgcaattattgtgatagatggaaaattctatcagctataatatccaaaataaaaatagaacacagtaaggacttgagtcataaagactaaaggaggacctagagcatttgtagctgttggtgttacatactactgacagggtgctttgcattaaaaattattttaaattattaatatagttaaccatttctttatgaaacaaagaaaaacatgtctactacatggggtgaattatgtctttattgatgcaaacctgaaggaagttgattattttaacagaaatggagtgaagggctcctaaagaaatagtttttacttccacacacgtttattgaatgtatattttcattgtatttttcgccatcttctagttttcagtctttatgcctaactttttagtgtttgtgaattattattgaagctcagtgctattgttagaaatggccttcttcttcatatttctcagttttgtctgtatttttatactgagttgtgatcaagtcattctataagtaaatacatgtaggttaaagtttttgtgcctcataagtaggcttttaaaaaggttataatatattcttaagactctctagaaaaaaggaattgttttaaatagaaataattgattgttaaaaatcagaaaccaacttcttaatatagcttttatccctttgagattagatgctgttaaaatgaatggatccatcaagcaaaaatgatacaattgaacttcacagatgaaacaaatcaatttcaatcaaattatatgaataaataataattaaaataatgtgtgtgactctccagacacaattgtaccattttaaaatatgactaaaatactttaaaaacaaatttgtataaaatattcaaaataccttctgaaattctgtgctaaaaatatatagctaggctcctttagagtt

SEQ ID NO: 122373 - DNA, 1053 bp, Homo sapiens
tcaaataacgtaggttactgacattgtattgtatatttccagtcatgcagatgcctagtcatgcagtgaggtttttatttccaattacatttatattttgctgtgttttacagtgcttatttgaatagcattgcttccaaataaagtaataggtgctaagtaatttagttcacagattttaattctatatgggcgccaagaccatgaaatatgctttgcttttgtaattcttattaagtttcaattctgttctcagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggtaggtggtcttgatatatctaatgtatattaatgtggtatccatgaagtgatatcttattaaattcactcacatttccctcatatttgtccatccctctttgctgtttgtccttacgtggggttgttttggatatgtgaagttgatcaattcatttttatagagatattaatcaccatgtgatttcatttgtaggccaaccacaaaattgtatgctgacattttctagcaattattcacgtactttttattgaatacattcaagcctagacttttacatggtgtgcagaggtgaagtttacatggataattttttttaatattaggtaatacacactacttattttccttcacagagaccagtttgttatggtctgagttttgaaaaagagttaccatgggttgcctattatgtgctagacatttacatgtaatatctctaatcctcataaaaactctgcttagtaggtataatgctagttttatagaattaaagactaagtaggaaatggaggcctggaaatgaagatcatacagccatgtcagggaatcaatgcagcaagtcagaggtcgttattactttgatcggtcccagcttgacccatcagtcctgcataggtcttgcctctgcaggactgctgtgggacc

SEQ ID NO: 122374 - DNA, 1426 bp, Homo sapiens
tcgtgtaatgcattgaaagggcagagaaagtttagcttttatgaatcaaatctaagtgtggtatagtgtataaacaaatactcttaacagatcatgttttgagaaaaaaatggtctttattaactgctattcagaaccattacagtcttttaagctattatcttataaacatacttttaatttttcacttcatgtaagttttgtaaaactcattgctgtttaatacatttatctggatatgctaaaattatgtttgatgaaattaatttattcatagagaaaaggcctgacatcataataactgccacctattggaagtatttgtaatacactaggcttattctaggccccttacgtgccttattaattcatttcgtccttaaaacaaccacgtggtacaggtgagggagcagaggtgccgtgctccctaagtaacactcttgattgtgcctgaccctgctgatgagaggcagagccaggagttggatccaggaactttgacctcatagccctgtgctcaaccgctacttcctgccacctcttgactttatttatatatttgtaacatgtcctcaatttccttgtcattttcttttctctcaagaactctcacaagtcagaaaagggatttctttgactttttacagaatcaacacaatgttctggacatgaaaggaatgatatccactgaaaatggcaatgctattaaccaagcatgttactttgaagttaaaaacagaagttaacttaaaaatgagttgaatgtcagccaatttccatatctttctgataccaaccttttttttaattgatacaaaatattttgtgtatttatggactgatacagacttttatttttcaggggtatttgggatctgtagtgagccttatatgaaatatgtatggaatggtgaacttctggatataattaaaagtactgtgcatcgtgactggcttttgtatattattcatgggttctgtgggcagtcaagtatcctttctgaagaaaaagtaagatacatattactaaacttatgatgtatcaatttgtagacagctacatatgaattatatgattataataccactctgtgcaccccaacaggaaaacctgcccatgatactatgtagcagaaatacaaagaagaatgcagactatttgaacaggcctgttatatacacataaagatgaataaataacaaggaagaaaatgcaatgtgatataggtaataagtgtcatgcttatctgggagaaggaggagaattactgatagttggagaggatgggacaggcccatgggaatagttgaacttggcctgggccctaaacaaaagtcagtgccttagcagcgagagagatcaggccgagcagagagagagagatcacagcctgggaaacactgtgtgtgtagaggtggaaaaaca

SEQ ID NO: 122375 - DNA, 1410 bp, Homo sapiens
aggtgtatgatcttggaagactaaggaaggtgtattagtccattctcacacagctatgaagaactacctgagactgggtaatttatgaagaaaagaggtttaattgactgtaggcttaacaggaagcatgactgggaggcctcaggaaacttacaatcatggtggaaggtgaaggggaagcacgcatgtcttcacaatggcagagcagaagagagagcgagcaaagggggaagtgccacacacttgcaaacaaccagatcttgtgagaactcactgtcacaaaaacagcaagggggacgtccgcctccatgatgcaatcacctcccaccagaccctaccctgacacgtggggattacaattcgaaatgagagttggctggggacacagagcgaaaccatatcagaaggattagttgtacttgtttacatccttacttggccatagggctttccttggccagtaaccctacacctggttaccattttctctgaaatttatggaaagcactccttagtcaggttggatattgccttccctttgtagctgcactgcaattctgaagaaccattagatcaagtgctgttccattcttgggtggagcttttggtgttctttaagccattggacaagctgtatctaaatgtttatttaaggaataatgactctcttggtcttatgtgacagtcatgaatgctaaacaaccttaacttgatttccaagagctgttgatctatggacgaccagtgtatgtcactctaatagctagaagatccagtaaatttgctggcacccgttttcttaaaagaggtgcaaactgtgaggtaagatgacaaacagtatcttcactgaccttttaaccttttatatcagctttgctgatgtagaagcacagtgaaattttaagaagtggtatttcttagtttgggatattatcaagagaatacagttgccttttagtatcaacaagggattggttctaggaaccctcttcccatccaaaatccacagatgctgaagtctcttacataatatggcctagtgcttgcatataacctatgtacatccatctgtatactttaaatcatctctagattacttctaatatctaatatgatgtaaatgctatgcaaatagttctaatactgtattgttaagggaataatgacaataaaaaaggtctgcacgtattcagttcagatgcaaccatcgtaggcctaactacattttctgtctgagattggttgactctgtggagggaacccatggatgtggggggctgacaataattaatactccagtgcatctgaaacatgtgagaaatatgactaatatgcagatgttctgaaaagtcagctatcttagagttatgcagtgctttgaggaattataaaatgtctaatgttgtggag

SEQ ID NO: 122376 - DNA, 10042 bp, Homo sapiens
ttgagcatgatgcacacctgtagtcccagctacttggaggctgaagttggaggatcacttgagtccaggagttccaggatgcagtgagctatgattgcaccattgcgttccagcctgggcgacagagtgagaccctgtctctttataaaaaaagaaaaaagaaatgttatgcaaaatcacttgtgtagtagttttcctttacttgttaggggtctgtggctctaaagaggttgactaacaacccactaacactattacactatggacagacaatgcatacagcagattcttcacacagagatgatacgaaggttgctcaaacaacatttcctctccatcccacgaaatgtcagatttgatataagcatttcaaaaagattttgtttccctagttgattttaaatgcttttgagaaaaatttcagatatataatttaattttctccgatatataaataagcaaaatttattttcatcctaaactgatttaacactgttcttaattcttatctaattatttcatttgatgtattcagctgtgctcaatagctacccctttttgtttctacagtagttatctcattaaattcatgacaattgaaaagtaatctccatgattgaaaacagcacaatctaattttgatgccaacaatagtgccttaacaccatttcagtctcactattgtgaaattaattgtttttctttgtttctaagtgaaggcttgatcagggtgataatgaaaatggcaaatttttataagttacttcccatatgccagctgttctataaaaactcaccatgctctgctgctggattcggtttgccagtattttattgaggattttcgcctcgatgttcatcagggatattggcctgaaattttctttttttgttgtgtctctgccaggttttggtatcaagatgatgctggcctcataaaatgagttagggaggagtccctctttttctgttgtttggaatagtttcagaaggaatggtaccagctcctctttgtacctctggtagaatttggctgtgaatctatctggtactgggctttttttggtttgtagcctattaactattgcctcagtttcataacttgttattggtttattcagggatttgacctcttcctggtttagtcttgggagggtgtatgtgtgcaggaatttatctatttcttctagattttctagtttatttgcatagaggtgtttatagtaatctctggtggtattttgtatttctgtgggatcagtgatgatctaccctttaacattttttattgtgtctatttgattcttctctctttttttcttttttttttaagtattttttttctttttttttattattattatactttaagttttagggtacgtgtgcacaatgtgccgattagttacatatgtatacatgtgccatgctggtgtgctgcacccattaactcgtcgtttagcattaggtatatctcctaatgctatccctcccccctccccccaccccacaacagtccccagagtgtgatgttccccttcctgtgtccatgtgttctcattgttcagttcccacctatgagtgagaacatgcggtgtttggttttttgttcttgcgatagtttactgagaatgatgatttccaatttcatccatgcccctacaaaggacatgaattcatcattttttatggctgcatagtattccatggtgtatatgtgccacattttcttaatccagtctatcactgttggacatttgggttggttccaagtctttgctattgtgaatagtgccacaataaacatacgtgtgcatgtgtctttatagcagcatgatttgtagtcctttgggtatatacccagtaatgggatggctgggtcaaatggtatttctagttctagatccctgaggaatcgccacagtgacttccacaatggttgaactagtttacagtcccaccaacagtgtaaaagtgttcctatttctccacatcctctccagtacctgttgtttcctgacattttaatgatcgccattctaactggtgtgagatggtatctcattgtggttttgatttgcgtttctctgatgaccagtgatgatgagcattttttcatgtgtctgttggctgcataaatgtcttcttttgagaagtgtctgttcatatccttttcccactttttgatggggctgtttgtttttttcttgtaaatttgtttgagttcattgtagattctagatattagcccttagtcagatgagtaggttgcggagaatttctcccattttgtaggttgcctgttcactctgatggtagtttcttttgctgtgcagaagctctttagtttaattagatcccatttgtcaattttggcttttgttgccattgcttttggtgttctagacatgaagtccttgcccatgcctatgtcctgaatggtaatgcctaggttttcttctagggtttttatggttttaggtctaatgtttagtctttaatccatcttgaattaatttttgtataaggtgtaaggaagggatccattttcagctttctacatatggctagccagttttcccagcaccatttattaaatagggaatcctttccccattgcttgtttttgtcagatttgtcaaagatcagatagttgtagatatgcggtgttatttctcccatccaagtactaaccaggcccgaccctgcttagcttccgagatcagacgagatcgggcgtgttcagggtggtatggccgtagacgatgcggtgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcaatagggccattttcacaatattgattgttcctacccgtgagcatggaatgttcttccatttgtttgtatcctctttaattccgttaagcagtggtttgtagtcctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgagctgagacaatagggttttctagatatacaatcatgtcatctgcaaacagggacaatttgacttcctcttttccgaattgaataccctttatttccttctcctgcctgattgccctagccagaacttccaacactatgttgaataggagtggtgagagagggcatccctgtcttgtgccagttttcaaagggaatgcttccagtttttgcccattcagtatgatattggctgtgggtttgacacagatagctcttattattttgagatatgtcccatcaatacctaatttattgagagtttttagcatgaagcgttgttgaattttctcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgttgctggattcagtttgccagtattttattgaggatttttgcatcagtgttcatcaaggatattgggctaaaattctcttttttggttgtgtctctgcccagctttggtatcaggatgatgctggcctcataaaatgagttagggaggattacctctttttctattgattggaatagtttcagaaggaatggtaccagttcctccttgtacctctggtagaattttgctgtgaatccatctggtcctggactctttttagttggtaagctattgattattgccacaatttcagatcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatctcctttatcgttttttattgcatctatttgattcttcttttttctttattagtcttgctagcagtctatcaattttgttgatcctttcaaaaaaccagctcctggattcattaattttttgaaggatttttttttgtctctatttccttcagttctgctctgattttagttatttcttgccttcttctagcttttgaatgtgtttgctcttgcttttctagttcttttaattgtgatgttagggtgtcaattttggatctttccttctttctcttgtgggcatttagtgctataaatttcactctgcacactgctttgaatgtgtcccagagattctggtatgttgtgtctttgttctcgttggtttcaaagaacatctttatttctgccttcatttcgttatgtacccagtagtcattcaggagctggttgttcagtttccatgtagttgagcggttttgagtgagtttcttaatcctgaattctagtttgattgcactgtggtctgagagacagcttgttataatttctgttcttttacatttgctgaggagaactttgcttccacctatgtggtcaattttggaataggtgtggtgtggtgctgaaaaaaatgtatattctgttgatttggggtggagagttctgtagatgtcttttaggtccgcttggtgcagagctgagttcaattcctgggtatccttgttaactttctgtgacgttgatctgtctaatgttgacagtggggtgttgaagtttcccattattattgtgtgggagtcaaagtctctttgtaggtcactcaggacttgcttaatgaatcttggtgctcctgtattgggtgcatatatatttaggatagttagctcttcttgttgaattgatcccttaccattatgtaatggcctcctttgtctcttttgatctttgttggtttcaaatctgttttatcagagactaggattgcaacccctgcctttttttgttttccatttgcttggtagatcttcctccatccttttattttgagcctatgtgtgtctctgcacatgagatgggtctcctgaatacagcacactgatgggtctttactctttatccaatttgccagtctgtgtcttttaattggagcatttagtccatttacatttaacgttaatattgttatgtgtgaatttgatcctgtcattatgatgttagttggttattttgctcgttagttgatgcagtttcttcctagtctcaatggtctttacattttgacatgattttgcagcggctggtgccggttgttcctttccatgtttagtgcttccttcaggagctcttttagggcaggcctggtggtgacaaaatctctcagcatttgcttgtctgtaaagtattttatttctcctttacttatgaagcttagtttggctggatatgaaattctgggttgaaaattcttttctttaagaatgttgaatattggcccccactctcttctggcttgtagagtttctgccaagagatccactgttagtctgttgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagagcagatttggtcttttcacatagtcccatatttcttggagtctttgttcgtttctttttattcttttttctctaaacttcccttctcgcttcatttcattcatttcatcttccatcactgataccctttcttccagttgatcacatcgtctcctgaggcttctgcattcttgacgtagttctcaagacttggctttcagctccatcagctcctttaagcacttctctgtattggttattctagttatacattcgtttaaatttttttcaaagttttcaacttctttgtgtttggtttgaatttcctcctatagcttggagtaatttgatcgtctgaagctttcctttctcaactcgtcaaagtcattctccgtccagctttgttccattgctggtgaggaactgcattcctcagatggaaatgcagaaatcacccgtcttctgcgtcgctcacgctgggagctgtagaccggagctgttcctattcggccatcttggctcctccccctctctttttttctttattagtctggctaacagtctattttgttagtcttttcaaacaaacagctcctggattcattgattttttgaagagtttttcatgtctgtatctccttcagttctgctctgatcttagttatttcttgttttctgctagcttttgaatttatttgctcttccactatgatcaagtcagcttcatccttgggatgcaaggctggttcaacatatgcgaatcaataaacgtaatccatcacataaccagaaccaatgacaaaaactacatgattatctcagcagatgcagaaaaggcctgcaataaaattgaacacccattcatgctaaaaactctcaactaggtattgatggaacatatctcaaaataataagagctatttgtaacaaacccacagccaatatcatactgaatgggcaaaagctggaagcattccctttgaaaatcaacacaagacaaggatgccctctctcaccactcctcttcaacatggtatgggaagttctggccagaacaatcaggcaagagaaagaaataaggggtattcagataggaagagaggaagtcaaattatctctgtttgcagaggacatgattgtatatttagaaaaccccatcatctcagcccaaaaactccttaagctgataagcaacttcagcaaagtctcaggatacaaaatcaatgtgcaaaaatcacaagcattcctatacaccaataatagacagagagtcaaatcatgaatgaactcccattcagaattgctacaaagagaataaaataacttaaaaatacaacttaaaagggatatgaaggacctcttcaaggagaactacaaaccactgcccagtgaaataagagagggcacaaacagatggaaaaacattccatgctcattgataggaagaatcaatattgtgaaaatggccatactgcccaaagtaatttatagattcagtgctatccccatcaagctaccattgactttcttcacagaattagaaaaaactttaaatttcatatggaaccaaaaaagagcccgtatagccaagacaatcctaagcaaaaagaacaaagctgtaggcatcatgctacctgacttcagactatactacaaggctacagtaaccaaaacagcatggtactggtaccaaaacacatacatagaccaatggaacagaacagaggcctcagaaatgacaccacacatctacaaccatctgatctttgacaaacttgacaaaagcaagtaatggggagaggattccttatttaataaatggtgctgggaaaactggctagccatatgcagaaaacagaaactggatcctttccttgcaccttatataaaaattaactccagatggattaaacacttaaatgtaagacctaaaaccaaaaaagccctagaagaaaacctaggcaatactattcaggacataggcataggcaaagacttcatgactaaaacaccaaaagcaatggcaacaaaagccaaaattgacaaataggatctgattaaactaaagagcttctgcacagtaaaagaaactatcatcagagtgaacaggcagcctacagaatgggagaaaattgttgcaatctctccatctcacaaagggctactatccagaatctacaaggaacttaaacaaacttacaagaaaataccccatcaaaaagtaggcgaaggatatgaacagacacttctcaaaaggacacatttatatgtggccaacaaacatatgaaaaaaggctcatcatcactggtcattagaaaaatgcaaatcaaaaccacaatgagataccatctcacgccagttagaatggcgattatttaagtcaggaaacaacagatgctggagaggacttggagaagtaggaacgcttttacactgttgggagtgtaaattagttcaaccattgtggaagacagtgtggtgattcctcaaggatctagaaccagaaatgccatttgacccagcaatcccattactgggtatatactcaaaggattataaatcatgctactataaagacacatgcacacatgtttattgcagcactattcacaatagcaaagacttgaaaccaacccaacggcccatcaatgatggactggataaagaaaatgtggtacatatataccatggaatactatgcagccataaaaaaggatgagttcatgtcgttgagagtgatggaactacctaatgtagatattgggctgatggatgcaggaaaccaccatggcatgtgtatacctatgtaacaaacttgcacgttctgcacatgtatcccataacttaaagtattaagaaaaaaaaagaaaaaaaactcaccatgctctgtctcatttaagtctcacattgatgttgtaaggaagatactgtttttaccctattttatagatgaaaaaatggaggcctagggaaattgagaacattgcccaaggtcacatggctagtgagtggcagagtcaccattccaaccacagaactgtacagtaaagtactagcttctcttgaatgagaggcagtgcagtgtctaactaaagagatgccccaggcaaggaggcagaaggcaaggtttagttccatgaatgcctctccacctcaattcattcaaccacagtgtaaaaagaaaaagaaatgcctgttttggttatctcacagagtatttgcaagtctaatttatgaagtcctgtgaaggctgagaagctgctttctgctgtgctagtttgggaattgttcatccagactagttgatttctttctggcctccagctggttaaagttgggggctcccttcttctggtccttgggagggatctcctctgtcagagtcaggtgtggagtgtgtgggccatggcccacgttgggtaagctgggtttctcagggtgcagggagagtaccaggaagaaacctgatctcctagaatcttcaaagttcattagctgttcactttaatacaatggagcatttatttctttgtgtttttattatttctgattattgtagctaggtttcattttagtatatttaagacttggatttttttgtcttagcttagcttaaaagtaaacatgttgagcctgttcctctgatttaaggaaattagaacactgaaaatgtttaatttttgataaaggaacgagagaaaagaaagcatgaaagaattctgagtgaagaacttgttgctgctgtgacctatctcaaccaatttttgcctcctgagcacactattgtttatattccctgggacatggccaagtataccaaaaggtgaatgatactcatctgtctggctatgatcgtttccttttcttgtgatgagaaataacaggaagctgacctctgtggtaaagtaaatgttaccctgttaatttccttcatgaacctgttgaggggctgttttgagtgcatcaagaaact

SEQ ID NO: 122377 - DNA, 1120 bp, Homo sapiens
tgctttaagaatgatatggccctaaccactgaatatttacactgtataataaggagataggtcagaaaaaagcccatattttgctaactggtaaattagcaaattgtcagctatttgttttattttgttaaactaacaaagtaaattcaaatatagaccagaagatttaacggtgctgttacagcaatgtataaccttatgcaactttaaacatgttctttattattttgactttacataaaactgaataatatttgttcaggaataatacctgcccacagactttttttgtttttgtttttgtttttgtttttgtttttgtttcttaaagaaatctaaagtagtatggaagttctttggtgatggaataatgattgaaaatcttaaggtatttctctttagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggtaagtcttattttttgctatttgaatgctgataatggcagaaggcaaacctggttactaataagatttttttatgaaagcgtttctacttttagcttctcaaaaattatgttgctagaaaacattattcaaactcgttctgtttttcttatattttcttctagtagttttatagtttttggtcttatgtttaagtctttaatctgtcttgagttggtttttgtatacgttaagagacgggttcagtttcattcttcagcatatgaatatccaattttcccagcacccatttgttgaagagggtgtcctttccccagtggatgttcttggtgtcttagaataaatatttctattaaaaatttgtgtattcttgccatggtttgggctttgggtttttcttctgttgttgttgttgtttttgcttgtgttaattatgaataaacaccacattctttagataaatccaaagtacttagacaaactagtgggcattgttttaaaacaaatccagatggcattttaaaaaagagtactgtgtcttcatacatactaaaaatctaagatgtata

SEQ ID NO: 122378 - DNA, 1002 bp, Homo sapiens
tgttaggttgtttttgcgttgctataaagaaatacctgagactgagtaatttcataaagaagagaggttgaattggcccatgattttgcaggttgtacaggaaacatcgtgccattatcttctcagtttctaggtggggcctcagggaacttttaatcctggcagaagaagggggagcaggtgtctcacatggcaaggggtgaggggaaggaggtgccacacacttttaaacaaccagatctcttgagaactcactatcgcaaggagtgcatcaacccaaacaccttccgccagactccatctccaaaattgtggattacatttcaacaccagagttcggcagagacaaatatccaaacgatatcacagggtcagggtttcaaagcttatcacgtgtggaagacagtgatcccagaagatggtgctgaggtggcttcacctggcattatgatagtactctaaaggactgccagcagtttcttcccctttctgctcactgctgaaagagggacatcaaagggaacatgctgagaacattttaatttatcaagaatagtgagatagccttctgaggttatccttcaaacagcagattgtgagtgaataagctgtatttggcaatagcagaaataaaacagttggaaaaatgttttgttttaataacgtttgttttaatacccttggtaacttttgttaaagcccaactcttcacctcttctgcaaccaaagcagttgtacatggcaagagaaaagtttgtaatttattactcttaaacagactacagttctccaaaggacaacggactgtcctgtgacatttccatagtaagttcattcttcccctctccaaaatgactatttcataacttgtcctctctccttaaaactacaacacctcagtctcatctgatgaccttgcttcgtgcttcagtgagaaaataagttattgaaagggaacttcctctaattctttttttttttttttttttttttttgagacag

SEQ ID NO: 122379 - DNA, 1523 bp, Homo sapiens
aatatatattttgctttttagatgccgatagacaagattccattaatctcttcctgggagttttccatcccactgaagggaaacctcatctctgggagctcccaacagatttttatttgcatcacaaaaataccatgagacttttgccaacaagaagaaggtatttttcttcctagtctgtaatataaactcccatttggtgttattttgaatatgagatacttttcattttgagaaatcataggctaaaatagtcagttttattttattttttaaaatttttaaaattttttgtgggtacgtagtaggtgtatatttttatggggtacatgaagtgttttgatacaggcatgcaatgggaaggaagtacatcatggagaatggggtatccatcctctgatgcataaagcagtcagtctggccacatgcttgccatgagttccgtactattgatgtcctgatagtaggttggggaaaatgtggctagcaattgttgttttgtattttctctaagatatgaagtttcagaacttccttgttaaacagaagttgtagctccactaaagcaaaccaacagtatcatctttgagtgtttcctacaaacttgaaactctcaaggactctaagatgcagagagtcagtcttagatttttcaagtgtgacagctaagcagcatgtaccttgtaattccaatattctctcctccaggaaacaaccagtctcagtgacactgggaagacgggaagctagagcagtgctactagctagcgtcagataaccactttcatgtccccaccactcacatgcttgagtcacttgccagtacaggttattttgagtacagttaaattggtaatataatattctcagaagaaacaaacagtttacctgaagcagtttagtgtgatgctctgtggtgtgagcctcaggatcaggtagagttgagttggaatctctgcagttctgtgacctgggtcgagtaatttaaactctctaagccttattttccttatctgaaaatgtaaatgcctggacacacctcacagagtcattgtgaggacttaatgaggaggctttttagtgtttttaactgaggagtcatgtactataataatataatcaattttgccacatgaacaaaattttttacataccatacatgaagttagagcctagtccattgcactcaaaggcctctaatgtcaagttctcccatcgtgcttttctcttacagcatcagtttgatagagccctaattttgcgcaaagatacctaccaggccgggcgtggtggctcatgcctgtaatcccaacactttgggaggccaaggcgggaggattacctgaggtcagcagttcgagaccagcctggtcaacatggtgaaaccccatctctactaaaaaaaaaaaaaatacaaaaaatagctgggcatggtggtacgtgcctgtaatcccagctactcgggagtctgaggcaggagaaccgcttgagcccaggaggcagaggttgtcatgagccgagat

SEQ ID NO: 122380 - DNA, 1555 bp, Homo sapiens
aactgttttaactatacacacaggtgtgtactatacagcagagtagattctaactatcagataactacacgcaagggaatcctggttgtaggacttgggtcaaggtcccactactcacctggtggcagagtaagtcactgtaggcacagtccctgggagaagttaacagcagttcatagagtcagcttattaccttctaatcctttttagctaaaagtaaataatatcagagcatcttgactctcaggtgtattcatggcatttttgtagatctgcaacatagttgaaggaagaaagcagttgggaagggaattaccatgttgaagacctactgtgtcaaaagctttgcaaacatgttttaaaaagaaaaatattaactttgaagtaggaacatgttactatagaccatataaattattttatccagtaaattttagaaaaccaacatttacatttggttcatctttttttttaatttttattttatagttatacttactggtggacaccagaggtgataaagcatttaccattgccctatgatgaaggtaggtaactgtttgtgttttagtttttacactaacatattttggcattataccttaatgaacttgaagcattaaatcctttgcacatagtattttattagaaacaaatgaatggctgttcagtattatgttgctgctttaatagataggatattataacatctcttagctttttaaagggcaggaattatattatacttctttttatctatgtaggccaataccttgtattgtgtcttacaattattatgtgtctgtcaaatatttagtcagtaaaatatgatatatcggctcatcactttaaactaatacagtttatatttctacatattttgggagaatgcggaggaagtaaggacctattcacaaggagaacttaaaacttttttcctgtgctaataagcagtgaaaaaaggtacagatgcatgtataaaagtacattttagtcacatttaaattaaatttcattaatttgtcagaggggcaggaaacattctatattaaaggaaaaccttcaagtgtataatacattagaatgatgtttccaaatttaaataattgccaaattttaaataaagcttagttctggctttgttactaactcccctgaccttgagcaagctcattttccatttggtaaagggttcctagcaagatctcctgcgaatctggaatgctccaattgaggactccatctagtcatgcttcagcatcccaactttgggtggggaaggccataaagtaagattacaaagtatttttggttcttattaagttataaattcattttggaaggtatttgtaacttgaaattctgggcaaaatcattactcatattgctgaaaaggtttagttgttctgggagaaaggaaagggttttaactaacagtggctattaacagaatttgaaatataaagggaaacttagggaaaaagctgtacaatttttagctaaaacacaaagggcatttatttaagagcaaaaaggaatttaaagaacctcctct

SEQ ID NO: 122381 - DNA, 2176 bp, Homo sapiens
agacagagacatagaaaaacctgcaagggaaacagagatggctaatcagagaagtggaaagaaccccagaccatattttatcacagccttcaaaaatgctgtttatccttctttctctccccaacactattttttctttttttcctcttttttttttgtttggcatataagcccctattaatttagagaccactttgtgttgttataactatttagcatatggaactatgggctctcaaatgaattgaaatagatatgtccaaggaaggaaactatttaaatgtgctagtaaaataagagactctattaaccaaattgtattatacaaagtgattattccactaaaataatatgatacaacttaggaggagatgatgaaatgaacatagcatacaaaataaaaacaaaacatttcccccgttttcttaacattatttctgatttgatctgtaattgatcttacagttactacttgtgcattctttttcttaaaatatttagtatttgcctgtgagtcctagcacagatgaaaaccacgtggatctagaattctttaaccttttccacttaattagtaaagaatctgtcataatggtgtttttacacagcatcttcagcaagataacaaagagcttggtagctcagcattacattgtcatggcaactgcccaagaatgtttttggtgtttttggggtgtgtgtgtgtgcacgcacgtgtgcacagggacgtgctttaaattgaaactgtagtcaggttcttaaaatgtcgactattcatttttagatttctaaagctatgtccaaaccaagagaaattacatttatttgggattcttgaaattctcctcttgctatgttttattttctagtatatttaagagtcataataagttcaagttcatacacatatgcatctacccatctctggatagttcataatcttactcagtttttcttgaaatcatgaagaaaccatttttttcttttctaaatatgagatatttataacaccaaatgtaaaaaatattgacagtaaataattggcaagaagccagtggaacaggggctcttgaaatgagcgtgcagagacatgaatgggcagctggacactttcaaccacggtcttgcaggactttgcttagaagtggatgttaaaccccaaactggtcaatgtctgtactgtcagcccaggcaccctaagctgtagtttgtgtgagtgggacccctccctgtgagtcataaccactccctgagtgtaggggtggtgatcagggagaaagggcatcagccaacattgaccgaacacactgtgtgatgggcactgttctgtgtaccatagcctgttctaagttctcacaataaccctataaagtacatcttattatcatctccattttacagatggggaaactgaggcacagagaagttatgtaacttgcccaaggtgatacagctagcaagtagaggaaccaggatttaaacccacacaggatggctccagagcccatgatctccatcactaagctatcaatgcccgttgttgccagctgctttccaatcactggggtagcaatgctttattattagcattaacagacctcattttgggcatctgacatgacctggatttttagacacctctatattcagaaatattcagaaattctaatatttctgctctgtcgatcttgagttttaaaaaatacttaaggagaacatacctttattctttcctcagtacctagcatactgtccctaatgtagacacacttaagtttcctgggcaagcatactttgcttgactgatttggtaacatggcatggaggttgtttagccaccactggaacagtgttgctgacattattgtaatcttacaaggttatacatttttagagggcaacccatctttgtgtctctagaacagtaacttaaattgagtgctcagtaaatatttactgaaatgcactgactctcatcccccatcacacccatgaccatcagggcctggttgaggccccatgagcatccctagaatgctccctccatgtcccactggttttcaagggggcatccttgaacactttttagttctttctctattgtgttttttccttataaaccctttgcccctcctgcttttttgttcccctactgccttctgagagagagaaaaaa

SEQ ID NO: 122382 - DNA, 1046 bp, Homo sapiens
aaacaaaaaatgtaattttagatgtctttttgacagctctacataaaattatattgaagcttcttaagcccagtaactttgttttgcacatgcttatctgttcattattattcctattggcctaaagattttgcttttacttgttttaaacagttttaactcttcttagactttgtcatgctataacagaatcagttactggtttgtttataaatcatgtaggtgatttaatttagtttattgtttgttaggtttattgttcaacctttaattttatttttgtttatctggaaccttggatatgtttccctgcagacccataataagaaactcaatcggtgtaatctgaattattcacatacttatttattcccaaagcccctctataatgacttctagagatacaaagggataatcacacttgtgtggagaggtgcaagatggcattttcaggatgccccataatgtgcacacatgtgtgcacacacgagtgtgtgtgtgtgtgcatgtgcttgtgtagtgtattaagactatgaaatctgagaactggaagatgattagggatcatctgattccatcctctgattttataaggagtcctggagagggtcagtagttcattcaggttactttttttttttttaattatacttttaagttctgggatacatgtacagaatgcataggtttgttacataggtatacatgtgccatggtggtttgctgcacccatcaacccatcatctacattaggtatttctcttaatgctatccctcccctagttccccaacccgcaacaggccctccctgtgtccatgtgttctcattgttcaactcccacttctgagtgagaacatgcagtgtttggttttctgttcctgtgttagttgctgagaatgattgtttccagcatcatccatgtccctgcaaaggacatgaactcatcctttttatggctgcatagtattccatggtgtatttgtgccacattttctttatccagtctatcattgataggcatttggtttggttccaagtctttgct

SEQ ID NO: 122383 - DNA, 1045 bp, Homo sapiens
tgtcttctattaagccagatatagaaaagattcgcaagctgtgaaacattgcttcttttgccactaagttttttgttttaaaaattgttatttttcattaagaagttgtttatgctatcatgtgttgggtttgttattttaataattattttttaacttctgtcttaatgtcttatatggtaaatatcactagatataacccatattaaccaaagctaattggggtcttcagtaatgcttttaagagtgtgaagggattctgagactgaaaagtttgagaacttgttcgcatagggtagttgattatttatgtcaatatgcattactaaggcaaccagggacgttattatgttacagccttgctcagtatttgccagcaggatgatatctgtgactggttgaagaaatcttattttctatgatttatgattttttaaggaattcaggaagcaaatgttctctttttaaagggttctatcaaaaactgtctgaacttcttaggatgctttcagctccaaataacagaacctctaactcaactggtttaaacagtaagataatttattatcttacttccctgaaagattgcagatgggcaagctccagagctggtggattcaggggcttcgtgtgatcatgaagtgcccaggtttttccatctctctgctcccccattgtcagtattgccccatcttcagaccagtaggaagatggccacagcagttccaggtgccacagtcagacacagtagtgcccagggcagaagggaaacactgactctgtgtctcctccttaggggcaaggagtcccagaacctgctcagcaaatttctcatgtcaaatggccaggattgggtcacaggctaacccctaagtatgttactgccaggctatgtatgggctgatggtgattggcttagaatactcattcagggtgcatggatgtagggaagttgatcacagtgacttagttattaaaaacaaaatccttcgtacttttccagttaactggaaattcatttgcacaggtgcccaaaaagagaggt

SEQ ID NO: 122384 - DNA, 1035 bp, Homo sapiens
ctttccctcatttaatctttttaacattaggataaggtaggaaaaggtattatctccattttgcagaggagaactgaagtttggagaagttgtaacttggcccatgtctcacagcttctatggagtaagggctggataaggcctgaattttaatccaggtctgtctgactccacagcacatgtctgaagtcagtgttgttaccgaaagcgactatgaatttctctgacttttaaaaaagaatattctgtatgtgatttccatttaaaaaatgatactaatgtagcatttattaaaatgtattataaccccatctctactgaaaatacaataattagcccagcatggtggcccacgcctgcagtcccagctactcgggaggctgaggcaggagaatcacttgaacccaggaggtggaggttgcagtgagccaagatcgcaccactgcactccagcctgggtgacagagcgagattccatctaaaaaaaaaaaaaaaacattgtttatattactgtttccaattagactgtgaaaatcttgagctgtatcttgttcgtttttgggttcccaaccttcagtataggctgtagtttataggaggtctacacgtttgttaaaataatgaaagaatgaatgaatcagcgtcatgattatcagaattagttactgtgaggtgctaaaaatacagaagcagaaatagataaagattattgtggccaggcatggtggcacatgtctgtaatcccagcatgttggaaggctgaggctggagggtcccttgcaccaaggagtttgagaccagcctggggaagatggcaataccttgtttctacaaaaacaaaacaaaacgaattactgtgtttcaaaaagttaaatgggtagtgtttccatccttactcttgaaccttgctttctttgagaaaagttccaggtgtcatttttctttttcgctcattaatttcattcatttaactaatatttactaataattattatatgccaggcacataaggctacttatgtagtcttatgtaac

SEQ ID NO: 122385 - DNA, 1357 bp, Homo sapiens
tcttactgaagccaaacagaatgcataggacccttggaatacaaataagttttttcctccctttattcactgctgtactaagagcaaatttatgtcctccatgatttggccctagaatgcatcagtaatctctgttgcttttcaagcctgacaaccaggctctgaataaagaatgaataccagccttgaatgaacatttcaggcacttttttttagaaggctagtcatcaatacctttttctcattattgtaaggccagctgctgtgtttttcctttagaaaaaaaaaacataactgagcatgtattgaagtcatctttcgcaagatatttatagtttctttttgtatatttgtttagtggtaatgattttgaatattttatagtatctgtataaatgtaatccttgtgtatatgtatgtgttatactcaaagactttttgatagatttcttatttatcctgcctttaagctagctttttcaatactactcttctgacaccagtgtctccaggagtattaaaattccatatcttcctttctggcctggaaacaatataaaagacacaaaagccattaagtcacagtatgttttccattgtaacagcttccaatattacttaaagcgtccatttcattcttacctatgcaaaccatgaaatgttatacttctaattttaatgaaaatctataggaactgtttataccattccagataaaggagcacatctcctattattgatggtttatttaatctttttattatatatttattatatttcttttcatttattcagcagcatttgttgatgcctgcagagttttgagactgctgggtattggggccacaacagtgaatagacagagccctactttctgagtatacagataaattaacaaagaacaatgaatgttgtcaagtagctcataggaaagagaacagtcctagtctaggaagtcaggaaaggcctctaaaaggaaatgacactgaaggtttgagatcaacctagacagataaatgttgaagtgagtgtggagtctcccaggcaaaggaaacagatgcgtgtgaatgtaagcaaatgcttggtgcagagcatacaagcaatgcaatagctggaaatacattagaaagataagcaggagcaaatcatgagaggatcttaggaaacatagtaaggagtttgtattttattccatgggcaataaaactgaagaagtgagttaccagtgcagcattttggaaagatagctgatggctacaaagtggttaatggattagagagaagtcagcttggaggtcaagagaccactcaggctgttagaatgggtggacagatgatagttataatggtggcagag

SEQ ID NO: 122386 - DNA, 1010 bp, Homo sapiens
ttttgatttaaatgaatggtttggattcactgtatcaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttcatcagtgttgctctttgaataaaatgatttatcataatttatcaaatactgtatggtaggctttaaatagtgaatgaaaatttgaaaaacacttaggctacataatttcc

SEQ ID NO: 122387 - DNA, 1059 bp, Homo sapiens
cagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtaattttctcagctccatgaaaagcattgctatagtagcattggaaactttctaaatatttaagacaaaaatgtgttccttatctataaaattttaggtgatcatgtttgtgtacaaatggcctttagaaagtaaagctatatccaacttatatttaaaattattttccagaaaatatatcacatttgaccattttattttcatgctttgtaggtatccttaaaatgtttattgagtgaatgagaaatttaatatatcagacttaaatgttatagaacatttaattaaaaccctttatattatgcttaatgtgtatattaactcctttaaaaatggtattttcttcaatgttaaggctgttcattttgggtatccatgacacttgctctaccagatgcctttagaggagtgagtttcctcccttagtaacaaaggaaagacttctcatattcattcatttattgtcattatttcctaagcaatgactataggccaggcactgagcatatagaatgaataatagtgcctttccctcaaatacaatggataatgaagccacagaaaatatattcaacaatgtttaatttatttgaccattgaggtgatagaagaaatgtaccacctcattaattttttagggggtggtgagc

SEQ ID NO: 122388 - DNA, 1050 bp, Homo sapiens
tagtgttgttatcaagcatatcatgtgcagtgtattaagaaaaattaaggattttttggaatgtgggtaacagtctaagaaatgggaaccaaagatgtgattattaatactaatttggtattaaggaaaatacttaaagaatttcagagaggattggcagttgcttataataatctttcagtaaagctattttgaagtttaatcttgtcagttattatccaaatgataaatttctaatagagaaatattagggaaattttctaatagagatatagagatcagctttacaattttcagttaaaaatccaattttctatcactgactcatttggtgttccatcctcaggaaaagagagagctgtaaatttctttttgtggtttgtaattagctgtcattgatttaactgaaatagcatatgatgagacttcatagtttcagtataaatatagcattgtattggccacatgtattgccacaaaattgcattatgatcaatgttgagtcattatagagactcctgtcagtatagaattgagcattttatttattaaagtaagcataaaatatctgagtggatgccaaagttgcatgagagaatgagactatttagactattacaaaccaaagcaccactcattaatttttttattgatgtgcttttagttctttttttttttctaaatactgttgaagatgttaaatttctataggagcatgttattggatccattttgatataattactgatagtcatttatagtttgtgtggttagattttctctttaggcttttctcttttaataacttgctagaatctctttgtcatttcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccac

SEQ ID NO: 122389 - DNA, 1135 bp, Homo sapiens
ggcatatatatatatatatatatatatatatatatatagagagagagagagagagagagagagagagagagagagaggagagagaggagagagaggagagagagagagagagagagagagacgctgatggggctgggttccctatttgtatgaggcacagattactggtggcttcaccacatttccctagtgcacatgcaggcccttagtctgctgtgggcatgtttaagcaagccccctgtgcaagttcccttatctgcacaaagcatctggtgtaagcccttgtggggtgggtcagaggttctctggggacccttcccttactgtctgcctaaagcaagctagctaactcctttcattaacaaccactgggattctgaatacctaagggatctcttcccctggcttttctcttatggaatatagtcagttcttattgccaagattagtcttttccatctctgtatctacacctagcatttgtatccctaccaattgttgaataaatgagtaactttatacctgctttttcttccatttgggatgcttcccttatctgccagagaaactgtctctggaagtatcttgatcaccaaataacttttgacacctgaaagtgaggtgcttctatctctgctgtgttgctcttaccttatattaagagctgcctgttattgggctcctctgtatgaggtgcacttcaaggctcttttcttgcttcttttagagacagatgtttttattcctattttacagataaggaaattgataccaaggtctcacagtgaatagaacaaatattaggacttatctattaaattgctttaaatatttgcttaaatgtctggttctccctctgctcaaaattcagtaatggcagggatcttcttcaagttattttggcttactcttttcagtaataagaacttacacaactagaggaatacagtgattttagatttatgatttttttttttcagaagttgtaacaagagggtgtaaaagatctcctaaatttctgaatctatatcttgggcatccctgggacagataatcttctaggtctttgatgaatcttgggttctgctacttggcctaaaatttatttctagctaatataaatgctgattatata

SEQ ID NO: 122390 - DNA, 1033 bp, Homo sapiens
ccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggtaagcacttttgctactaatgcagtgtgggaattgttggcttcagctccagaactgccagccgcttgttaggtaccgggttacctctttctcagtgctcagagataagttgctaacgtttgaatttcttctccttcccacatgcatcctcgggagaggcagaattggaagttcggaatagccctccgatgctctctgcccttgcctcccgccatcagaaagcaagtggaaggaggggatgaaatttgaatttgtggattagggacatagcctggaaagtgcaggtgtaatctcggaacataagtgaaattagatcaggacttcccaaactagagtattgtgtgagcagtggcctcgatttgtcttatttttgaagaactaggttctaatcctggcaccaccacttgtgtgaacttggacaagttatgcagcctcctttctttcctcacctgtacagtggagatcattttcaaaacatctgtctacatgaaaagatgagtgtgaaaattgagtgaaattacacaaataaagcatatagcacagagccaactagtgagagtgcagtaaatgttttatgattgtgtgtgttaatacagtgagaaaaaggccttggatttgagaaacagctgcatgatctcaatggaggaagctgattaataaggcaagagtttccaggcagaggtgacaggcaagcctgagaacgcaaagagcctagtgggtttgaagaactgaggaaaagctgatgtgtctggagcctgatgagagcatctaccaattggtagtgtaggcccagtagagcccgaggtaggtgatcagctcaagatgtgaagaggggaggc

SEQ ID NO: 122391 - DNA, 1019 bp, Homo sapiens
taagatcagtcttgtctaagctttaacaactgtctctttaaaccttagttttaacactgtctgttttttctttgcccccaggtactgagcaagtatatgacttctattagtttgtcctataattttcttatagaaagttcttatctgacttctgatagtaattcctataccagattcctatcaacttttgttgttgttgttcttgttttttaatctttccacatgaaatgtaaggctgtgagacctttccgttaccttccctcatttgcaaagtgcaaggaagcaaacctttcttataccttgtagtggtgttatctaacagacatacaggaggtgacacatgaattcagttttacctcaatctcataaccctgggctatcactgctggaatataatacaaatatttattttaattttcttcccatttttaaaagttgtaagattgttataatctcagtgaattatttctggaagatttatattctacaatgcagttagtttatcatagagcccacctgtagagtccttatcactgaaaatagtctcatttactgtgtcatcccgtttacttactctacagttttgcttttagcttgcatttatggtatttctcctgacttctcagcccctcagtggttgtgtgaattttgtcctgttttctgcctgctcccctgccagtcttacttggggcttctcaatgaagtttcttccttttgttcgactttcatctagaattttctctacacccacctacagaagtggaaaatagaattttaaataaatacttttagtctcacaataattattaacatgagttttaacttcaatatttgaaatcctttattaacatttttattttattttttttgagacagtctcactctcttgcccaggctggagtgcagtggcgcgatctcagctcactgcaagctccgcctcctgggttcaacgccattctcctgcctcagcctccctagtagctgggactacaggcacccgccaccacgcctggctaatt

SEQ ID NO: 122392 - DNA, 1134 bp, Homo sapiens
ctctcctctggttaagaacatattttaatgctgaaaaaaactatatgcaaatcagctaatagccaggtggttggttctgttatagcatatcatgagggtgagttcagcacttacatccttagcttgtttgaaaagcatgcttcatgatgaatctttttctgttccccaaaagaagttccctatattctgtttttttgtgtgtgtgtgtgagatggagtctcgctctgtcgcccaggctggagtgcagtggcgcgatctcagctcactgcaagctacacctccccggttcacaccattctcctgcctcagcctcccgagtagctgggactactttggatgaaaaatgaaaataataagtctatcctctaggatgtgccctttagaaaaaatgggcttagtacttttttatgtattctattatcgtacacatgagttgtaggccataaagtgatcagtgatttagcactcttgtgaatataccagactaatgttaccaaacatttactgtgctagcacacccatttgagaaaaaaactgatttgagctaacttaggtagactttctttccttaaattcccatggaccactgaagaccacatttatatgtagctacatactttataattagtttaaaaagcacattcgtatgctggtagatatccttccttctcttaaggaaatataaagaatgattgatgaaatagaaatatattaagattgggaaggaagactgtccttactgcaaatggtattttcaaaataatagctagattttatgtaatcttcttacccttttttatttaataatttacataatttgataaacttagccctgcaatatctattaccaagaagaaaaggaaaatggtttctagatttccaagtgcatcatgtacatgtattttcaagctcttagaatatttaaaactaaagtttgatgtgttggccagagaggctcttagtaatgtaatgtcagtatgcaaaattcatcctataagaaacatattatgctggagtctagcctgagctttgggttctaaatagaaaaatatagctttgggttctaaatagaaatatagctcaggggccgggagtggtggctcacacctgtaatgccagcactttgggaggcca

SEQ ID NO: 122393 - DNA, 1050 bp, Homo sapiens
ttctctcatgcttttttattaaaatacaatattgaacaattttcataaagatttccttgatattgctattaagctgccatggtagctactcttctgatactagacattcagatagtaactacaaaatcagccttctgtgacactagaattgattataaattttattgatttatgaatttatttaaaattttcaacaaattttatctctatatatatcttaaaaactactataaagtttgtaaagtaaatgctctgccgttcccttcctcacctcctaatctcactgtctccatgagccagagagtgttctaggtcccaggcatacagcagtggacaagatcaagaaaatcatgacctcatgaagcttatattctagctgttacttacatccagtaaatccatgtttatagtaatagaaataaacaggtgatatctaagatgaataaacttattctactattttttattttagattttatctgttgacttgttattatagatagagatttactactaccccatcttctgtccccagctcctcccaaaaaaattgtgtcacaaatgtatagctatcacttatatccttaggagtatgtaaaaacaattaactgaaaaacaacattatgtgctaaaattcagtttccattctgaaactagattttctgattgccttgtctttttacttgtataactagtataacatgttaaaatttatttctaggtgtcacagaaggataagttttgaaaactgattttatatagttgaaaagtattatctagtatccattatgtatttagtaccatttcataatttgtggaagaggtaatcagtctctgcttatagaagacttgagcttggccgggcctgtaagcccagcactttgggaggccgaggcgggcgcattgccagagctcaggagttcgagaccagcctgggcaacacagtaaaaccctgtctctactaaaacagaaaaaattagccaggcgtggtagtgtgcaccgagtagtcccagctactcgggaggctgaggcaggagaattgcttgaact

SEQ ID NO: 122394 - DNA, 1042 bp, Homo sapiens
catcagatatttaggtttgatgaagccatatttggttcttcaagcttcagttttatctccaaggagtctatttagtactatggtacttaaaactataataacaataatataaaaataacatttattgagtacttactctgtgccaggcatgctgctaattgctgtatatatactatgtcatttaattctcacaggtgactttattgtaaaatttgtgatgaaagtgggaaaagataaatgaaaaggaactggaagggcataagagaggaaagcaggggaaaaggatagttgatatattttgttttgttttaacttccttcttaacctgttttatttctgcttctttaccagtgactaacaaggcccaagtattatcttcccttgctataattatgccacagtgaagtctttatagatcactaagatgtgtaagtgatgaaaagaagtatagatattatctaaaggtctataatctctggatatttaggaatttcgaaatactacctctagttgtaaatgatagcagttattttaagcacttaaatcttagctgactcatgatcttgacatcattggagtgttattacctaaaccttaatatggaatgatatacctgtgaataaaatgttattttaagaatgttaggtttcatgactatgggttgtatttgtttattgattttctttgcctttttgtttcagttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaaggtaagcaagttggttgtttctgtttgctgtaatgttataataatgaagccaacgtaaagttttagctgttgatgtggaacatttagtatttctggtaaaggtacagggaagtcaaattgaatgtaagcctgagttatgctttggagatgcccacacatccatcacaagtgactaatcagtcttcaaggccatctgaattgg

SEQ ID NO: 122395 - DNA, 1087 bp, Homo sapiens
cagagagagaaaagaaaggaactacgtattagagttaaagtcagtgagatttagtaacggcatgtgaatgatcacagtgagacaggaatctagagtgactcccatgaggctggatgaacgatggtgccattcaccaagaaggaacataagatgatggtaaggttttagatacaccaaatttgagctgcctttgggatattgaggtaaaaatgttcagtaagcaattagatagccagaggtcgagctttgaagagagactgggaattgacagctaaagcataaaaaaaggatgagattgagagaactccttgaagaaagaaagaaggccaaagggaggacagctttgtgacaaaccagatttttggtagagaaaggtttattgtctttgtcagatttcatgtgaaggctagttactcattccaaatttaactgtaccacgttgaaacggtgtgactcgtagtggctctgtttttagattaaagtgggagtctgttcagcagtgctttatgattttaaggcctccctgcacaaattaatactgcctaagatgtcaccgcagcctaaaggaagacttgtggaaggctctcagctgtgtacaggggaacaaaatgtctccatcagatagagtggatttggtccgcatctgtctcccctctactggcagaccatttttctgtggaaaactgaaattttcctcctgaaggagatgatagaagctctgactgggactccagctgtagaaaaggatgcctaattaccatgacacgtacctcctgatgggagttcactggaggtgatggtttagagctgctgcatgtggttaacaatttgtgccatgctcattttgcacaattgtacgtgtcttggtcatggtggggtggcaaaaataggaacatttttgcttttgtttagccacattttatttttccctgtaacttttaaaagagttgagtgaactggcaatattcatttttaagtaaagtataataatcagcaccttaaaattagtgtattatcaaaatatcatcttaaagcaaaagaaggtagcctgggcaacatggcaaaaccctgtctctacagaaaatac

SEQ ID NO: 122396 - DNA, 1056 bp, Homo sapiens
ttaagtaattgctatggcagacttaaaagaaaagttaaaccttttcctcttggttcttaaccaagatgttatgcatcagaatcacctgaggagcttcttcaaggggaaaaaaacgcccacattctgaagcccacacataacatattctaagtcagtaaatcaggcggtggcattccagtgatcttgactcacagctgagaaccactgcttagtgctgtttgtctttatggtgttaatgttttaagagaagaagatatatgatacttcacctcattgctgtttctgttgactccacctttaggtcacagtaaggctgttagggatatctgcttcaatactgcaggaacacagttcctcagtgcagcctatgacaggtatcttaagctctgggacactgagacaggtaagagttcacttatgctaatacacattcatcttacaagttatttatatttgaaatggtgtgagtagtcttttgtggcaaaatggcaccttctctaactgctgattctcataccattcactgtcagcaaatatcacaaaatacatttgtaagtcgaaactgagcatgagtagctctttcactgtgaaacttgtttccaccagatagattttataaagcaaacgtactgacaaataagcaaagtggaaatcttgtataggccatctaattgatttttttgttcccctacatcacctagcactgtgcattgcacataacagaagtgcaataaatgtctaatgaacaaaattaaatgtatttgcgcaaattgattaaaatgtaggtctcaactttcacaggccagttggttttatatattcacagccatactaattgctgtttattaattgattcacattaatatgttgtggctagtataattttatgtaattataaaaattatcttactatcttattgtcttactgtcattacccttactgcatctgaagggtaatgataatagttaatgtttattaaacatcatttaacaggcataattgctaagcactgatattcagtgtctccttcaatcttaatttatccctatgaggta

SEQ ID NO: 122397 - DNA, 1263 bp, Homo sapiens
tttgtcatcattttcctcttcatttttcctcttcttaaacttcttataaacgaaatcataccattttttctcttttgtttctagctccagcataatatctgagattccctcatggcttgtaccagtagtttgttcttttttattgcttgcactattccattatatgaatgaagttataatttatttattctacaattggtagtaccgatttacttttgaaaaaattatttttaatcattaaaaatctgtgaaaaagaacaaatgtagtttacagtaaagagcaagcaggcagcccttcctcaaaatgtattaagcaggtgacctctagatcttaatctcacagtcatctttaagtggtcaaatttattttacctatttaatttgagtctttggttttaggacagtgtatatcaagatttacaaaccgaaaagtaccttattgtgtcaaattcaatcctgatgaagataagcaaaatctctttgtggctgggatgtctgataagaagattgtgcaagtaagtctttcacagtattttgttaagactcctaagctttatgttgtataaggggatggaataagttaataagctaatattactcatttaatgtttgctacttttagggacggctaatgcaccattcttagcagaaaaatttacatttataaaaatatcgtgttgaagatcttctccttctccactttccagaattatggtctttcataaatccactctacttctgtctttaccttttttcttgcctgatacacagtgggacattcgaagtggagaaattgtgcaggaatatgatcggcatttgggagctgtcaacaccattgtttttgtggatgagaataggagatttgtgagcacatctgatgataaaagcctaagagtttgggaatggtgagtttccatcagtagaaaatctgatttacataaagcaagcagttaaaaattatatagacaaagatgaagcctgataatatgcaaccatttgaatattttttgcaactgtgatcctggcttgccaatcaaactgttttaactatttaagtactgacaatatgcagattaaatccaaacatgctaccatttataatctttggatagtctttccaaaggatgtgtatcttgagttgtttttcttatacggatgacagatttgtattttgctgtcttacattctttattaggtaccttattcatctctgtaaaataactggcaagcagtagggggactgagcataagatcatggcccta

SEQ ID NO: 122398 - DNA, 1026 bp, Homo sapiens
tcaccctaccatggtacatttttaatttaatttttggttttatttcaacagcttttggagtaaaagtgggttttggttacatggatgaattatatagtggtgaattctgagattttagtgtatccatcaccatggtacattattaaagaactttctttcagtaacagattttttaacataaaggccaaagtttaaatgaaatagaaaacaaaatcaccaccactgttataatgatcatggaaagtgatttatgaagtacaggatttaccataagcagtacagtgtcatcttgtgatttttcttcttccagaaagtttcatgaaagatttattaaatatataatatcaagagtttgcttttatttgcatattattcctttgttccagagataattctgaaggtactttttaaaagttgcttattctgatatgctatttaaaatttttagggatatccctgtggatttcaagtacatagcagaacccagtatgcactcaatgcctgcagtgactttgtctccaaatggtgagttagtatgtagattgtatttttaaatgagcttctaagatacagtgtgatttctttattcaaaagaactttggccccttccttcttggggaagtttgtcactgtgccattatttgtataaggtaatctttacaatattagaaagaattactggttttcatatgcaagtcacctcacctacttttctgtgtctctttttaaataaaaataaaagaaacaatgatttacagctaacattgattgaacatcagatttttatttaacaatcagttttcttttcttttttcttttcccctcctctcccctcctctcctctcccctcccctcttttcttttcttttcttcttttcgagacagggtctccctttgttgcccaggctagtctcaaactcctgggctcaagtgatcttccctcctcagcctcccaaggtgctgggattacaggcctaagccactatgcccggccagagttttcttttctaattctccttccaaaca

SEQ ID NO: 122399 - DNA, 1461 bp, Homo sapiens
tcctaacaacaagggtacttctgagaaatgcagtgttaggtgattttgtcattttgtgaacatcacacagagtacttacacaaacctagatggtatagtctacttaccctaggctgtatggtatagcctgttgctcctaggctttacccctgtatggcatgttgctgttctgaataatgtagtcagtggtaagcatttgtgtatctaaacatagaaaaggtacagtaaaatctcagcatagaaaaggtacagttaaaatttagcactataatcttatgggaccactgtcatacgtgcggtccatcattgaccaaaacattgttaagtggtgcatgactatagacgctgcagtttaggctctaggggctttgatgaatcctaagtagagaaaagcattgtagccttttaaaaagttactataatttttaatatatctttttttgtatagttttatttaataaccctaggctttctcaccccttaatctttctttattctgtaattaccacagataagtctctttctcctatttcccatagttctgttgtctatacttactataaattaatttcatttcacaacttttagcttatttctttaacattaagcttggaatttctatatttccttatttttttaaaaacttttatatgagagtgctcaatgatataggatcgtatatgcaaaagccattagtttatatattaatacctcttgccagtgacatatttataacattttacaggtggtatagtaaatttattttttagtattataaagtatttgggagcaaaacttatattaatcacagtgaacatatttaaaataaaaagttttaaaaattgttttagtcttcctctaaaatacctcatttattgaatttacaggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgaggtaagtttaaatcttctaatccattctcgtattcaaatatgattatataaactgttgttgtacaaataacacttgacacatcactctcacataatatgtttttatgagaactcgatgatctgtcaaaattgtcaaaatgctggatataaaggcaagaacaaattaggaaaattacattttgctttttttaggttcttgcttcagtatattcccttctattacttaggcttatgccctttagccacctaataaatccctgtctatataaccaatgccttattttctctgcttttctaagcaagactagaagtgctataatcactgtattgctatgattgaatgaacaccagaagaattaattgtgtattacagtgttgcagttacagcttcactacagcttgtctgtgctgaaacctcaaatccagcttt

SEQ ID NO: 122400 - DNA, 1021 bp, Homo sapiens
ttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaac

SEQ ID NO: 122401 - DNA, 1018 bp, Homo sapiens
aggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggttt

SEQ ID NO: 122402 - DNA, 1075 bp, Homo sapiens
ttttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctg

SEQ ID NO: 122403 - DNA, 1646 bp, Homo sapiens
ctggagtgcaatggcgcgatcttggctcactgcaacctccgcctcctgggttcaagcaattctccctgcctcagtctcccaagtagctgggactacaggctcccgccaccacgcctggctaatttttttgtgtatttagtagagatggggtttcaccatgttggccaggctggtctcgaactcctgacctcaggtgatctgcctgccttggcttcccaaagtgctgggattacaggcatgagccaccacgctaggcctattctggtttcttttactagaaattatatttattgaaagttgaatgctttttagaaatatgttaaaatgtgttaatcagcctggtttctttgctattagaatataccatgctaaaggtgatgcaaaattgtgctcacttgacccactacaaattcatgctgccctatttcaagcccaccctgctgtttagttttctactttttcagttaactccctagcccagttgctaaataagctgttctaaaccaacttccttttctttaaacacctctagcctaagtttgctgagattatcagattcattcagaagtttgttgatgttaattaagtagctggtagctttccttctcttccctcccccacttccaccataatttctcacttgtctatttttattttactcttgcactccttttcttagaggcatttattgagtgcctactttttgccagatacaggcgaaagggagataaaggatggtcccttctgtgagagacagtaaaatgaacagtttactatacattgcaatatgtactttgatgttaccgcatttattttacacaaccaccctctgaaaataaggaagacaagatttagagaggttgtagcttcctcagcctgtcaaagctagaacttgaattctaagtcctgaggctctttccctacaaacatccctgcctagtgatatcagagctgtctggtgtgatctcactgacctctactctttggctgtacagccctgcccttgagaaagcctctgtgaaagacagactttcctttcctaagtcctatctactagtgcccttcctagcttctaaatgtcttcctacctcatagtacaatattgctatttccccttctcaagtttctctttttcacctttaaaccttcatcgtccttttcccaatttaaaatacatcttatatccatcttgtttttctttagcacttgctctattcatttccctttttgttcctctacttttagaacacatgatgttcactctttggttccacttactctaatttgttataacctggcctctaattccatccctctatcaaaagtcctctctgaaaggacacctgtgacctctactttaccaaatcaagtggcctgtattaatcaactttctcctttactgcagtaaaccatttgttcttctgacagtcctggctttgagggtgtcttctccgctggtctatatggcataccataattccatttttctgcctcccacttttgctgtgactttgccttctgttcattcttgcctcttacttctactaacctattgtttcaaggcactggcttaggacatggcttccctctaaaattacttctttaggaaattgataagttatggcctcaggatcatggatttatga

SEQ ID NO: 122404 - DNA, 1054 bp, Homo sapiens
tttcctgggaatgtatgtttgtatcaaatgtgaggaaagttgtgtcaccactaacaatatttaaataaaagtatagttgtagccattaatatcaagccggcactgttcattgtttcagaaactactccaattgatattctgattgtctctgttcctattattcaggattgtagacaattgtgtttgtctttttctctctttattggtactgataagagtcatattatgagtttcatatttttgtcccaaatgtcttggggtgggagaaagcaaatgtagtaggaagattgtgtatctttaggctgtgctactcataatgtgccaattaactgaaatatatttaaccctgtgaaaaaattgattctatagaaggaaaaagcaaatctggagtacatgttaagtatcatgaatataaattaaagcattaagtaaattctgctaaaatgcagatatttcaggagtagcttctgagtaatcatattacttatcacattatttccctgacttttgcctttaaaatacaatttaactaaaatgaaccctgggcattggtttatctatctgattttattgccgataacttaaatgtgaggcatccaactcttgccatttctactgtttctatggtaaccaaagtgtgcaaacccagcagtatcactttctttcacagctggcattttgtgttcacagtaagaagaggagttttagtaaagcatagtctgtgttacttgggatgtaactaggtcagaacaattttggtatcctttcttcatccttttaggttttttatgtgggtgaaggtgtgtatgcatgaactgtagttttcttttttttaaaaaagagcatatactttcactaaaattaatcaccattagtcttttgaaaattaagcataacatctgcaaacacaacttaatatagaatcttgaggattggatggagttgccctgagacttgacccatagccttgtatacccttgaatatttccattaagaaagatgaaatgatggatgtgaaatgctttgaaaaattaaacacactttgatggtgatt

SEQ ID NO: 122405 - DNA, 1285 bp, Homo sapiens
ttaatggcctttatttcccctatcttaaaaccccttatccctgtctcaacatattcaaatactatctgtctttcagggcccaacacaaatgttaattaaaacttaccctcatatccatgtctacttggaaccaatctcttcttgttgttggttcctgttgtactgcatctttacttctgttatggcatttatctattagtattatagcagtttagagatctcttagaacatctcgtagcctgtgaacttcttgagagagcaagatctatgtctgactctttttgtacactactgcccctgtacacaataggtgttgaggaagtatttcctcagtgaatgagtattagggagaatagtactgacattttggggatcaggcatttgaatacactatccttaatgaacattttttgttttcttgtatgtgtaaagcacagagggatgggaacaacacaaatatgaccatgtcaaacaccttcttctcaaggagccttgaagaaatatgacatacacacaaacaattatactataagatagatgagagagaatgtgattgtagctacatgagaagtacagactgaatctatgcaaggccagaagagcttctgagtaggggataagggtaagtttgaaagagcaggttgcatttgagctggactttgaaggatgactagaatttaaatagagacttgggtgatgagggtaacccaagggagttttagatgtaaaacttctgaggtaaagaagcacttggattatctcagaaaggatgtgcagttctggttggctcaaatatggataagctgaattgcagtaatgtgaggtcatgctcagaagatatgggttggagcctactagagttagagagtttttggggtctttttgtttgtttaagtactgacagtttgtgagcaacagaatgattttttcccccactagaaaagccaccactgattattattacctcatcaatggcatgaacacaatgttgaaaatgcattctgaatatggttcttacgtagtatagcactggtttatattttacccacacatttactgaatgcctccaactcctcaagtgagtaactctaataagatttgaaattttgaactgactgggcatggtggctcatgcttgtaatttcagcatgttcggaggccaaggcaggaggatcacttgagcccaggagttcaagagtagcctgagcaacatagtgagtccccatcgctacaaaaaataaaaaattaactgggtgtggtggtgcatacctgtagtttcagctac

SEQ ID NO: 122406 - DNA, 1084 bp, Homo sapiens
aatatattctaatttattctgtgccaaagatgaaacttttccaataattcaaatatacacctgatcagtgatgttacccaagtgtactaagtgctaactttttatagaaagtgaagatttacagtttttctttcttttttaaatctttcattctgtcagtagagaatataatactcttcttcagcagctgtttcaatatcagtcctttttaccttttggtcctatttaatgaaaatcttaatggtttcagtaaatttagtcattataacccctcattaacatggtcacagtcaccctcaaaatagattgttttggttgaacttattactcaaattatttttctttgtgtcattattggcctttaataagtaattttaaaatatagagcatttgttacagcattgattgtgttttattggcatagatattagcaaagactatattattatgtttttttttaatttttagcatattattaagtttcaccgtgcatcaaaagcaaataaaaagcccatgcagttgccaagatctatggttaaatccttactttaccagattcttgatggtatccattacctccatgcaaattgggtgcttcacagagacttggtaagtatttttcttttaaattcatcaatatgtttttccctactcttttaaaaaatatattttcttcttggtaccattataataaaacattaattatagaaaaacttgaaaatatacataagcaaaaaagaagataaaaatcacccataaacctataataaaaagattaacactatttaacatttggtgggtatcattccattatatttatgcatagctgtaaaatatcagtgtgattttgaacaaatgattactgtacaattttaatggagtagtcacatgtgaagcatgcacatttcaatccaatttgttcttcatattattgctcatcattagtaaaaatgtaattaatactgagttctcatttttctttcccttaagatctaaactgaaataatgacattgcatctagtaaaaagaatgttatcaatattaataaacaaatgaataaataaatctaacaggtggtatatac

SEQ ID NO: 122407 - DNA, 1008 bp, Homo sapiens
gaggggaaagattgatggtcaaatgaatcacactgttacttaaaagagatcaaaaaagaatagaaaattggatttactttgagataagtgagtaattgaagtataagaggatctttccattcagaatgcccttgaaaaaggagtcagggacccatgagggcatcatagacttggagaacagaaagtgaaaagggaagaaagatgtatacataaaaatacgaatggattctggaatttttagtctagtacagactctctaaattgagtcaggatctagagaaagtttagaattctaactgtagattattttacatttaggacagtgaaaagtggacactttaaaaatagctacttacatgctttgaaaggagctcagataaaatattggcatgttcattgaacattcttcattaggctccagtgggatcatgttactatgctgtgagtatctggcatggaagatgttatcatataatatgagacacaggaaaataatggtctacttaattgctgtttaagtatgattacacgtatttgtagttgtatgatgtcatgttgaacaaacatttgttagacaagagattaaagtccgttggtaaaatctgattttgccaagagatggggaaagtacaagtatggccatctcctttcactgtgtcccttctcagataaccatgtaaaaagaagctgagatagtatgatagtgtcttattttggtaggtggatttctggaaagttctgtcttctggtgtgtgtatgtatttgtttttaaattataagagtaatgctcattgaagaaaacttgtaaaatagaaaaaatagaaatataaattatgcataatctcacacccagaaataactattgttaatgttttggcatatttctgtttgttttttgtttttttgagacagagtctcactctggtgcccaggctgaagtgcagtggtgcgatcttggctcactgcaacctctgtctcccgggttcaagcgattgtcctgccttagtc

SEQ ID NO: 122408 - DNA, 1061 bp, Homo sapiens
aggctggtttttaatgcctgggctcaagtagtcctccttatttggcctggtaaagtgctgggactagatgtgtgaaccactgtgcctggcaggttcattttttcagtttcattcaaatcagtgtatgttgtatagctgtccttttagagttttgcctctgaattttcagaaattatgtattttctccattatcatttcaattaatagtattttttgaaattggtcatactaagaattgacatataaaaactccatttaacataaaatcattcttggttttgaaatattaattataacataattaatatatttccctaagcaccctattcaaagtactgctaacataatatcttagagcagtggttttcaaactttgagtcagcttgcctattcttggtctggctctttcttgctcataatctatgatgtgcactggtgttttcaattattttctattttagtccagttcaggttatttcacttgccgggggtagggtgggggaaatgctggtttcaactgaatagatggatttcatgattcactaatgggtcataagatgcagtttgaaaaacaataccttagagtagacttttacaaaaaataatttgaaaaatacagagcaacataaagtagcaaaccaaatttgattcaccagttaactcctgttgacatttcagaaatagaaatatatgcataataagaattcaaacaatatcacaattgctatttgttatattaatacagaaagatacaaaatgaaaaatgttaaacctttgtcttctttaacacctggtcattctgcacaaaagtagctagtaaaaatggcttcttataatgacgttttttgtgcatgtaccattacatatgtatcttttaaaaataccaaagagatagatatatatattcttttccatctttatcacttaatattatgtcttagtgatctttccatatcgacaatacagatcttatttttttaacccccaagtcaaaggtcattttttaaatttatttttatttttggtcagagtctttctctgtctcccaggctaaagtgcag

SEQ ID NO: 122409 - DNA, 1097 bp, Homo sapiens
ctcattgcttccagaattagccttggcctatgatcccacagtcctggggcacgtgtagattacctgaatctatatagttgtagaacacatgccctgaacaacttttgacttctgggttatatgagaacttaaaaagataactaaaaagatttgttgatattgactgcattcataacatggaatgactttacactttaccaaatagttaatataagtgtatgtaaaaataggttatgtataaaaaagataaataatacaagagatcatttgctgacttccaaatgagtggtatagataatccccatagggatttggaagagtgagagatcattaagagtaatggatttaatgaatggaaaggaacaaaggaagtaaaaagcagacaagggttggtggggaggaggggtggagagttggataaaagggagaaaaagataatgtaaggtaagtagtaaagatacatgacattggggttcatgaaattaaaaaaagatagggcttcccaaggctgctctgactgcaaaatacacagtacatggtttggttgctgtgttaatgaaaataaagtcttttgatttcatactccactagtcctttaattttacttaattattgactgaactatgttcccaatcctggctagtcattttggagttatctgtcttgaccaaacaggagattgggcaatagattgtgttgtaatcagaacaaacacatcctttgacaccaaaaacaacaacttaaaatgcatgccctgattattgttgtatgtatatttgaactatgtggtcttctgtcaatattctggaattttcagatagcctagcattttaaaaatttattattttggtgacctcttcataggtaaacactctaactttaatttcaagcttatctattccaaagacatgaatgtgtataatttataatgtgggactattctaaatatatgtatataggttcatttttaatttttattttttagaaacagggtcttgctctgtcaatgaggctagagtgcagtggtgtgatcatagctcactgcagccttgaacttctgggttcaagcaatcctcccacttcagcctcccgagttg

SEQ ID NO: 122410 - DNA, 1031 bp, Homo sapiens
gttgatatcttagccttcaagatgatgatattaggaggtgaagcctttgggagatgattaagtcactacagcttcacactcatgaatgagattggtgccgttataaacaggaccacagaaagaccctttcccattccaccatgtgaggttacagtgagaagatggcagtctctgaggaagtggccctcaccagacagcaaatctcctggtgccttgatcttggacttcctgatctacagaaatgtgagaaataaatttcttttgtttataagctaaccgttctatggtaatttgccatagcagcccaaacagactgagacaaagggtattattatatttccatttaggcttgctatgtcttttgactgatgatcccaggttctttcatagttgtttctgtgtttggctcctgatcctttagacaagtcagccaattctggcagtgatagaacataatggtttcagagcctctcccacataagacaaaaatgactccccggtgagttgctgaagagccagaacagatcttctctcacatgagtcttgacacttcgacaaagcatgaagtgaaggctcatataacaaaactgtgtttggttgagttggcttcaagattagtttgttataaatgactacttttctattgcttttactttttcttgtcatgagccgcctttcttcttaaatggtgtttagtactttgcattgttatgtgtgatctaccagttatataccatactttcaattctgtatatattttattgactgaaaagagggagtttgagtatgaaattataattgatactatagtcttttttgtgatgataaatttctaaagtcaaacctatttattagcttgggaaaataatacatagtgatattcagatgtgtcactaacacatagatgatttgtgtataagaagttttattttaattttattaggttagattctacccttgtatatatattttgatggtgtgtaaacatttcaagaatactacagcttcttaaagtagggtttctagcatga

SEQ ID NO: 122411 - DNA, 1036 bp, Homo sapiens
gttggtcaggctggtgtcaaactgctgacctcaggtgatctgcccaccttggtctcccaaagtgctgggattacaggtgtgggccaccacgcctgaccccaaatcaaggttttacaggaattggcaactgtgacatttgacgtgtatagcatgtaaccaaatgaaattttttttttttttttttttgagacagagtctagccctgttattcaggctggagtgccagtcgtgtgatctcagctcactgcagcctctgcttcccgggttcaagcgattctcctgtctcagcctcccaagtagctgggactacaggtgtgcaccaccacaccctgctaagttttgtacttttgttagagacagggtttcaccatgttggccagactggtctcgaattcctgacctcaggtaatctgcctgccttggcctcccaaagtgttgggattacagacatgagccacccttgcctggcccaaatgaaattctgatgtatcttagtgaagctagcttctcttttttgtcgtttaacagcatgctaatgccatcaaataattactgttttgtgaacacattttggaaactggaaagaccattgagacgtaaaacagtgaaaagtggcttgccagcaaaactgattgagtacctgacagcacatctggttttgctgctttggtgaagggagaagctccacgagccactatgaatcattgcttttacattggcatcaaagactctgccaaagatcgtgaaagaagtcttgtctaaggtctctaaagtcacattttaacctagtcagggctttgaatcactgccttgtcaagaacttctcttgagaaataggagaggattatgaggttattttctattgcagagaagttcattgattctgtaaagaacaagtatcaaagtactgggaattctggttctctttgctgctacatgacttcatgaatcagggttttcagaacacttggggcaatcagttggattgttaaacccactgccatggcagagcacagtggctcatgcctgtaatccc

SEQ ID NO: 122412 - DNA, 1060 bp, Homo sapiens
taactgcagtatcaactgaatctcatgaaatgttttggcgaagcacttctttccaaggatgtcaaaaatcttctgagttaccaggaggaagtggttgcctgtcagggcagagtcttactcttgcatatattttagtgatatatactatatataaactcttggattacaatatggatgagttctacttttattctagtttgttcttcaggctacttattctgcttaatttcggtttggaattaaatatctcagtctgtgcaacctgttttttagtttcttgatttagaagaattattaatcccataagcaactgtcaatagaatgtatctaattcctgtgaatcttagtttcttcatgtctaaaatgggggatttttggcatagattcactatgacttcatgaaatttagctcagagtttgtatctgatatattcactattgaatccttggaatctgtctatatggtgcttggaacaaagtgggctgttaataaattattaaataaatgcaagaatttacttgaaattgttactttaacaatattagtaacattataagggagtggtatttgttttgataaagtttttttttgtagtagaagattttaaactttgtgttcaggcatattcttatttgaaatataaaattaaaatttgtgtgctgggcgtggtggctgatgcctgtaaacccagcactttgggaggctgaggcaagaggatcgcttgagctcaggagtttgagaccagcctgggcaaaatagcaagacccagtctcattaaataaaaaaaaaaaagaagattaaaaattaaattttgtggactattatctaaaatttttgatccattctgattttcctttccataaccatgtgtgatttaatgaataaggggtggaaaatagtcatttgaatatacattacttgaataggaatttgaggtcattactaatcaagtaattatttgaataatatttactattgtaccaattactattcaagtaatttaattttgcatttaatatttgagtatctattataatctaggcattgtgctaaatgctg

SEQ ID NO: 122413 - DNA, 1046 bp, Homo sapiens
agtgccaagaagtcccatatgccctctgggaccttgcaacttcttcatatggtgaaccttagagatgctgcatcatcacttaccatctgacagttagtttacaaagagaaatagtaatgatatatgtactttctttcattctcaatttaaatgttgcaaataaatcttaaaattgcaaattttttagtattttattttagcaggtggaagttatatttaaacttattaagtgaaataattactgggtttgttccttgttcctgtccacataatttagagtaaaaggcctatgctcagtctcttctgttcaagctttcaaattcctttgacagcctggatgtgaaattcaaaagccattaatttgatgtgttaattttgcactttttgacttactgcaaagatcttatagtttccatagcaactataacctatccagattgtgtaatattctttacagtattaaaaataaaactatgcaattacatgagcttctggactactttgtctaggggaactgaggattgaaatgtttctgttgaaaaaattatagtttcatgtgaaaaattttttagaaagcttttataattttgtttcaagaatacatcaaacttaaatatttagcaatagatacctgatagataacttaattattaaatgtataaaatttacatcgtaagcattgtgttgagcttctcaggcacatgtgctctcactctgtacccacaaatacatttaaggcacaggagggacacttggctttgattacattcaatcacctgcagtttatgcttcttaatggcttctgagtggtctgaaaaagtctggttttatgtctgggcaaaaaacaggatggagaaaaaggaaaaaatgatcatttaaactttccttatttttgactttgctttttaaaacatgcctgagctatcactttgaaaatactaaagattgttttagtaggtattctcagagtatcaatttattttggctttttaaaggcaatataatattagcactaaagttagttgacataacttcctatatcttaa

SEQ ID NO: 122414 - DNA, 1036 bp, Homo sapiens
ctgctactatcctaatttagactatagccacctctcatttaaattatttgcaaaggcctcttaaccagttgcctgtgctatcttcacaccttcagactacaaaaatcacagattgtgtgctgggcagggtagcatgtacctgtggtccctgctactctggaggctgaggcaggaggatgacttgagccaaggcattcgagaccagcctgggcaacaaaatgagaccccctcctatcaaaaaacaaacgaaaacaccaacccagattgcttaaaatccttacctgtgttcctacttgttctgcttcatctggccttcttgcttctccagctttaacttgctttcccctacttgaaaccagccttactgaacttcagatgtatcgtgctgtcttgcctgtgagactggacaggcatattccccgtctgagaagggaaataatcactatagcgattaaagcacagactctttagccagactacttaagtttgaattctggatcgccacttaatgagctttgtgatatagagcgagttacttagtctacctgctttcagtttcctcatctgtataatggggatggttaatagtacctgcttcatagcacgttgtagggattgtaagagttttgtatgctttgagacaaggtctcgccctgtcgcccaggctggagtacaatgatgtgatcacagctcactgcagccttgacctctcagttcaagctgttctcccacctcagcctcctgagtcactgggactacaggcatgtgccaccatgtccaactcatttttgtatttttttgtagcgacagggtctcattgtgttgcccaggctagtcttgaactcttgggctcaagtaatcctcccgcctcagcctcccaaagttttgaattaacaggcatgagccactgtgcccagcctaaaagagttaatatagttgaggctttttttttttttttttttttttttgagacaaagccttgctctgtggcccaggctggaatgcagtggcacaatcttggctctctgcaaactcc

SEQ ID NO: 122415 - DNA, 1051 bp, Homo sapiens
aattgttactttcagtgtatataaattcatactttattgctgcattagtttttccaatagtataaattggttcttttcgtaagaatataattagttaaggctcaacttttggtcttttcatacaataagctgcattatatataattaattgtgaatgttacctatatattgttgatatgctcattgtcaaatctaaaatctgagttccttggcagatatgtagacttgtgataggcatttggcattttatgttttgggcagtgtaactttaaatctacataaacttctctgccttttgcctctgctgtgttcatagattccaggagggcttcgtgtatggacctcaagcgttggaggtagcagacttttcagcagaaggtaaagcagagtattgccttctggtgtcattgtgtgtgtgtgctggggtgggtatgtgacaggtgagagcttttcacaagtgtaatcactaagtaatttataatgatgcattaaatgattcactttcataaaatttaaaaccaagataatacccgtacaattgtattcagtattactaaaattcattaaaaaaagtaacatttagatagaactaaagactctaaatttcacttctttgccattaagaaatagtaggagtgagtaggaaaacagcattagtataatgtatgctatataccatgtaattttctcagacctagctttactctgatttcttcgtgggaacttgtccaagtcataattcatatgctgctccttttactgaaaaattgcttcacaatagaggggcagcctaatccatgactcatgactggaagataggcattcatgctataggtcccatttgccagaaatgttagtttccaatatgctagttacctgtctcttgataacttgttttttttttttttttgagacagagtcttgctctgttgccaggctggagtgcagtggtgcgatcttggctcactgcaacctccacctcctgggttcaagtgattctcctgcctcagcctcccaagtagctggaactacagacacgcaccatcacgcc

SEQ ID NO: 122416 - DNA, 1049 bp, Homo sapiens
tttggccattatttctgatttggatagtagctggttggtctctcactatagtccaagatccaaattgctgctagtgtcattttcctataaaatcaatcatgtcatatctctttttggaaagctatacgtttgctatggcttatactatcagatccaatctcatctctttctcttctctccttgcatgattcatacttgagacttagatccaattttaattccttagtttgtcatgtaaagacatttacattcagaccctgaagtctgtagtctttatacctgccaccatttcttttttccagttgcatttaagctatatacttctgtagcattgaactcgtattttctggtacttaagtcctttcatgtctcattttctttgttctacattcactttagaatggtgttgctgtgccattcttccctcccccttttcccttatccttacaaacctgtaaaactcatacttcaatacccaactcaaatagctttcctccttgaagccttctcttaatcactcggtgtactcctcagctgtgtttctacccctttgttcttacatatgtaaagtcactgtaagtgatactaatatgcctcataaattactagctgcaaaaggatcatcattctgtccagtgccttgtacagagttggtcacataatacacaaaattatattcaattaaaaatgcctttaattggtaaagatgctccactgattttaaaagcagaccaaattcctttaaaaacgcaagtttatttacttttcttaaaaaacgaagtttttagtaattgctttgaaagcctgaaatacagtaatgttatatgaaataggtggttagatgtaaatacttctaatgtattttttctaagaaatgtactgcttttccaaacagttgataaatttcttttttcatttttttcacttgagactgtctcactctatcaccaaggctggagtgctgtcgtgcagtcgtagctgactgtagccttgaactcctgggctcaagtgatcctcctgcctcaggctcttgcgtagctaggaccaca

SEQ ID NO: 122417 - DNA, 1550 bp, Homo sapiens
cgccggggagcctgtcgggcgaacgcggcctggggtcctcgccagccccacggctctgacccgctgggcaccgccgcccccagcagcgatctccgcccttcgggctggccggcccgttggcttctctatgcagtcctcccatccctgttgtatgcccggcgtcccgggtttctcattctcacattctgaattgcgtaccttcccccttcgaaggagacctgatgggctagctgcgtttcgcaagcggcaacttaagagttggctgaattctctgctacccaccctttaccttgcagccccttgggtatcttgggtattatgtcctccactccatcctctgccagatgactgtgggctggggcttatggagtacctatattatcaagaacggaatacgaagtgacagagctgggcctgaacctttgttttcctaggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccacaatgacattagtaaaatttgaagtgccgcttatctttgtgcgtgctgttataatttgatgtggttggtatatgaactctaggactaaagtacgttgtgtgcgtatgcactaacttcataaaacaactctattataaagtgttttgtcataaggtatcgtgaaaattgcaaagtgctatccaagtgtaaaggattattattattgcagaattttttttttcttttgtaactgaacaggccttaaggtactcagttgtttctcataattcctttaattaccaggtgtccttgaatgcttatcatggaatgtgagatactataattaacatattttggttttggaatatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaatacacttcctttttgagtgaaatttgttaattagaattaataaagcttctttactagagtaagattagtttgtgtgtcttcaaaatataatgctttttttctaaaaaaaaaaaaaacctctcaggatctgaaagcattagtttaaatcactgta

SEQ ID NO: 122418 - DNA, 2025 bp, Homo sapiens
gggaatggagggcgggagcggcgcttgttcttgcctcgggcgcggataggaggggccctcccggccttgtctgaggggctggcgaagaggcctcccacccgcggcggccgcgggcagcatgtggcgttcgggcggcggggattgggcgggagcagttatgtcgcagtggcggggccccaccgctcccctaacatgctctgcgccagagccttttcggggcggctgggcagacggcgcagtccccggggccgccctcgacacggccgctgaggccgctgggggctgctccccaatctcttgaccttgggttgtgtaacctgctacggagccggcggagcggggcgggagaggtgcgggtggagggaggcccgcctgccccaggacataatgcctctaatgccttaagcttgagcaaaggaatctggggcccactcccactgcgggccgtcacgcgagagatacttgggctgaccgcgccgaagaggcgttttagttggtattgctgtggaaatccatgcttatataaaagcccagagatcccgtggatgcttaggccttgttcctggcggcggtcgcaccggtggccaccaatggccttcctaggccctgccaccggatccctggctcctctgcgcacgagtgcggctagggtggcggtgcagcggagtaactggcgtggccagcttcattgagaggcggcgaccaatgggctcctgggccgcactcagagcctggccccagggtgtggaccaatgggcgttttaggagtgttagctgttcttggagctgtcccttgacaaaaagcaactggaaaagggaatccaggcagacacgtgctaccgagactttaaggcacgacgggaaacccggtttctagcagtgtatcttgaacgattccattgtagaaaaaaatactagtcatagctaaaatgtcacacgtctcatttttttcaagcttcgtgtgacacttaaaatgtctatagcgcttactacgtgccaggctcacgtgagattataggaagcggactttggtcatggagaagcttagtatttccttcatttcacagatgagaaagatggtatttgtgatagacgtttggtaaaacgattgtgatcaggataattaacctagaaaatcttggcaagaacctagaaaatcttgggtaagaacagtcctagaaaacgaataacagaagttgtcactttggctttttaaatgtttgagcccttaaataatagtaagtacatgttcttaataaagggaagaagattttgttctccccaagttcttggcggtttggctgtttagagcttcctgagtcaaagtggagagaggaggaagaggctttttacaaagcagcctgctttctttaaatgtttaagaaccctttttactttgtactttaatcagcccaaattgttttactgctccagtgtggcttttaaaatcatggccaaagttaaactttgaaggacaaaatattcccttgtgtagatgatttagtgccatccattttgtggacatgtaacattcattgaacaactattggtagtacactgccacattgtaactgttgtagataaagcaagttaagcaagaactgaaaaatatgttgatttaactaaggtcccgtgataaccttcgttggaacatttttcagtgaccactcaagtggttaggttatttaccaggatgtttaaaaaagcctgaaatagtaggtgttccttgaatcacctaaaatcaacagcctagcaaagagagtatcatggacggagtccggtcggtggggacatggggccagccccagagaccccagggaaggataatcggtcatctagaagaataaagcgtgacatgttttactcaaatgacgtgattaagtgcatagcctctggaataacaagatttgaattcaaacagcatttaatagctgtgtgagctgtttcctcatctgtaaaatggagacaataatggtacatagctcatggaagttgtgaagaataaataagttaatatgttatatg

SEQ ID NO: 122419 - DNA, 1042 bp, Homo sapiens
atcttctaggtatgcttgtaattggcagtcattccagttttttgtgagtgctataagagtaacatcactcactgtgtcccgacagacaggcttttaaatttctatgccaattagattggtaaaattatgctcttctttttttttaagtgtttcttaaggttaaaaatctgcacattttatagacaaagtatcccattgaatttctgtaatcattgattagttaatggtttaccttggtttatggacctttgaacatttttttgcctatttttctttaagtaatttgtaaatacatagtataatgaccaatttttgtttcatatatagcataatatacctatcatttatctgggtgtgtcaatatagattattttgaaagaaactaaaagttggtgtacaatattaattaaaaatgtggtcttcatgagaaaaagtgtgagctttgtaatttttatgagtaggtgggtactattgtggattaatcgtaacttttttgttaaatgatagatctgagtgggacatacttttgaaggatgtgcaatgttcaatcataagtgtgacaaaaactgacaagcaggaagcttatgtactcaggtaagtcctgtaaaacaagtgttaggtagctaatttcagtcctaatcataatgtgaaacagttaagttcctctcagttgtagttctgggggtttttttgttttgttttgtttttttgagacggagtttcagtcacccaggctggagtgcaatggcgccatgtcagctcactgcaacctccgcctccttggttcaagcaattctccggcctaagcctcctgaggagctgggattacaggcaccttccatcatgcccggctaatttttgtatttttagtagagacggggtttcaccatgttggccaggctggtcttgaactcctgacctcaggtgatccatccacctcggcctcccaaagtgctgggattatacacgtgagccaccgcgcccagccttttttttacattattcttaaaaatatggtataaaaggaaacatttagtgtaac

SEQ ID NO: 122420 - DNA, 1052 bp, Homo sapiens
cgggtaatcagtcagccagatcaaaccttggaaattctgatgagtgagcttgacccagcagttatggaccagttctacatgaaagatggtgttactgcaaaggatgtcactcgtgtaagcatttttagtaataattgttgctggactcttctgcgtggggactaaattttatttttcattctgtaacttttaagttcagggtaacaagtgctagtttgttacataggtaaacttgtgtcatgggggtttgtcgtacacagtatttcgtcacccaggtgttaagcctagtacccattagttatttttcctggtcctctcccttctcccaccctgggactaaattttggactcaattgaagtttatttgtcaaacccttgttaaactcggtctttttccccccccaggagagtggaattcgtgacctgataccaggttctgtcattgatgccacaatgttcaatccttgtgggtattcgatgaatggaatgaaatcggatgtgagtagttatatattgcttcaataattatttaaatgtgaatagtctttccattcttaacactgtgaactttttctctcagggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcaggtaattttatattttattattaatcaggttatttgatttttaaaatcttaaaggaaatgagacagtgaggcctaagatgtattctgagatagcacatataccagccactcagatatccagaagtaatattgtttgaggttactggtagctgagaagctttgtttcattagacctgtgtcagtccttgttttctgtctagccaaactgatgggttcctcctgtcttgctattgacaggcctctggtgggaggaaccataagatgccctggcccctccagcacataagaaggcagctaaaataactcagatgtcttag

SEQ ID NO: 122421 - DNA, 1913 bp, Homo sapiens
caaaaacaaaaccaaaccagacctcaagtcaacaaatctattgggatattgtttacgaacaaagtccaccttaagcattggtcctcaaaacagagctcctcaaaatattaggtgctgtgctcattacagaatcaaactgatcacactgattgaaaacttcctcaatgaaattttcaatcaacaacatgcttcaaataaaagtcaaacagtgttccaaccacttgatttcaaaccaagtagattttaggtttagaaacactaaaaaaaggtgtttcatttataaatacggaaggaacaaaaacatcactgcatcaatccagaaattatcaaaatatttagaggacaagaaatataaaatttagtcaactttgctgttttctcagttccttaaaatcccagagaatctgcaaatatagctaaaaggtaccaactcttgaaagcctatattactagtcatttcccattgagtattttggaattttattattctatttattcatattctacttatttataatgtattctgctttatgatgtttatctgaataatctggacaaattctcattctgggcagtcattcatttcatcctatgaatgccatggtaagggaaacaccgtagttaagaggaacagatgaagtcggaacactcacatgcatcacagtcacagaactttaagtcacgagatggaaaagacattgattctgctttggatcaaagtttatagaacactacttaatggaaactagtggaaatggctgctaaaggaaaagttaaggtgaatgatccaagctgacttgatttactgaatccagaacaaaattatgctaaatctctctggtaattaactaaataaaaatgattttatactactactaagttagtaaaggggtgctactcattagacgctaatctcatttactgaggaacacagaattgtatgttttccacagttcagccagtacaccctaatctcaatctacaactctgggtcttccctgctaaccaactattttccaaaagagcacattacaataaaagagaggctaaattcccatgccctttaaagaatattaagcccagggaccatctcccccattccccatctggggtatagaattagtatataaacccacagtgttaacagtgtattgctttatttggggtcttgggggagacaccagggagagggaagaaatcaaaggactataaatgcagggtccaataatgttaaaatagcaaatatgcaaaatgagtaactggaatcattttcttaaggactcaactcatggaagaaaaactttaattgctgtttccaaaaacatcagtatgaagtagaaattggtttcaataacattagtaaagaatatgttctagaaagtggaggtaactggatgtaaaattctggcagcaatttaatagaacagtcctagagggttaggctgaggccaacacctaatgaggacgaaagccttgtctgtggggaattttggatgatacttggagaaatattacactgtgcataaaccaaattgagttgctttcacaagtgttgtaaagtttcatatagtaaaaggttttttctacatgcacttcaatttcacagcaagagtggcagagaatacctaaacacagaagagagcattcatgcaagatatctaactccttgatataataatgcatacaattcaaaatgattacactatcattacatctagggctttctgcaactacacagtggtggttatggaaagcactgcccccagcatcgacatctagaaagcatccaccaccttctacatgtgttctctttttgcgttttttcttcatttttcttaatcaactctgctgttgttgctgcttcttagcaaaactggtaaaaacaaaattgtaatcattgaacatagcactct

SEQ ID NO: 122422 - DNA, 1034 bp, Homo sapiens
tgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaacttttctgttgccctgttttttaagtagcctacttgaccaaatactacatgtctgaagtttaaaatcaatacaacaatgtgtatttatgagtttggagttagacaga

SEQ ID NO: 122423 - DNA, 1023 bp, Homo sapiens
gccgcgggaccatggcggcggcggcggacgagcggagtccagaggacggagaagacgaggaagaggaggtagtaagcgctacgccaaaagcctgcaccgcagtggcggtgatgcctgtgctggctgtgtgtggggaagggagttggggagctgcgggccggagggaggccccactgctcctcaccggcttcttgctcctgggcgcgaggagccgggcagcttgggaccttagccctaatcgtcaccccgtacttgggatgggaagtaccgggaagttaccttaggtagcgtagtttcctcttgctgaaaacagggtccggttttcacaaatgtgggaaatttggcttcttttgctaattgctccctcttggccgctcgcgtgctagcatgttaacccctctttctttcaccaggagcagttggttctggtggaattatcaggaattattgattcagacttcctctcaaaatgtgaaaataaatgcaaggttttggtgagttttctagacttggggggattgttctagagtgtcttaaatgtaaaacaagaatcaatggtgaaatacctatccgcaagtattgatatatttatttcaccttacaaagtagtgaactctaaggataagaagtatactaagtataattaattaatatgtaattaagtataatgtagaagtacagcggggactatgggagcagataggagaaaatggctaactttgcttgcctgtttgaatgtgtggctgaagagaaagttacagatttggaggaagtaacattgtgatatggaaccgtacatatattcctgtattctcagcactttgggaggcagaggtgggaggatcacttgagcccaggaattggagaccatcctaggcaacataacgagaccccttctctaaaataataataaaaaaaaatggccaggcgcggtggctcacgcctgtaatcccaatactgggaggccgaggcgggtagatcacgagcccaggagttcgagaccagcctggccaacatggtgta

SEQ ID NO: 122424 - DNA, 1005 bp, Homo sapiens
aagcagttctcctgcctcagcctcccgagtagctgggattacaggcgcctgccaccacgcctaggtaatttttctatttttggtagagacagggtttcgccatgttggccaggctgatctcaaactcctgacctcaagtgatctgcctgcctcggcctctcaaagtgctgggattacaggtgtgagccaccactcctggccaaggaataaaagaagggctacttcataggcagagcagcctactttctaaagtatggtatcaatttatactcacagtagcaatgtatggaagtgtctgtgcttcatatccttggctcaagggccttatcctccgtcctgcctaggcatacagttttctgaaagtttcaactccaggcagcaggttggcagcaatttttttcctcaggctttcatgattgagaatgtccctactccatactttggcttcaggtagtaagtctgactttggtccttaatttgattggtagaattttagatcccaatacgctgtagggtaaaattcctggccccaatttccatttcaaggatgaagcctgttagacctatgggtttaatctcactcataactctgtgtttctgtcccttgaagatgtttgttacttttgaatccagttgtgctttcaactgttaacgtatttttttttttttcttgagacagttttgcttttgttgcccaggctggagtgcagtggcacaatctctgctcactgcaacctccgcctcctgggttcaagcatttctcctgtctcagcctcccgagtagctgggattacaggcgtgtgccaccatgcccagcgaattttttgtatctttagtagagacgggatttcatcatgttggccaggctggtctcaaactcccgacctcaggtgaaccactcgcctcggcctcccaaagtgcagggattacaggtgtgagccaccgtgcccagcctgttaatgtattttatctatcatttttctatgcttggagcaggagggatga

SEQ ID NO: 122425 - DNA, 1054 bp, Homo sapiens
aaatatcttttactaatatctaccaaaaaagtgagattttggccggcccttgtggctcgcacctgtaatcccagcactttgggagccgaggtgagcggatcacctgaggtcagtagttcgagaatagcctgaccaacatggcgaaaccctgtctctgctaaaaatacaaaaattacccaggcgtggtggtgtgtgcctgtaattctagctactcgggaggctgaggcaggagaattgcttgaactcaggaggtggatgttgcagtgagccaagattgtgccatcactctccagcctgggtgacagagtgagactccatctcaaaaacaaacaaaaaaaaacaaacaaaaaaaagaaagtgagattttttttaagggtggaaccctaagtgacaaatatgtttttaagaattttcatattagttaagtcatggctttgcaatgtgaggaaaatgtttaaatagttatgaattgtgcttttctgaacagaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtggtaagtatatatacttaatctttaaaaggtattgaagtcattttagaattttcagcatgctaggatgggctgtcggagaaatacgtagataagcttgccttaccataagaactactagtcttagagaagagctaaagttgggggtttatttaccttgcgtggcaccttttcttaaagcaactagttctcttagtaaattttattattgttttttaggagcacaggtgggtctggtagagtgaaggtctcccttagtaaatttaaactgttttcaattactagaatttggcttacttacattttaggaaaaaatctaatttgtaaagagaagtaactgcatattgctgtatatttagtcattcaacaacaccggttactgtgcctctgctgggaattaataggtgagacacagttctttcagtgagcttagagag

SEQ ID NO: 122426 - DNA, 1007 bp, Homo sapiens
cttataatatctaatataatgtaaatgctatgtaaatagttataatgctgtattttctggtttatcctgctttttattgttcctttttctttttatttcttaactttttttttagagacggggtctcactgttacccaggctggagtgcagtggcacgatcatatttcactgttgtaagccactgtgctcggcgccccctgcttttttttttttttttaacacactttctttgtctattgaatactgtcaatccgtggttggtcaaatcaatccatggatgcagaaggatgcagaatccatatgtacagaggactacttattttccacgagcctataaactccatgaaagcaagcatcttgtttaatgtagtagtatagtatcactagctcctagaatggtagcctggcatataacaggcactgaataaatatttgaatgaatgaatatcctttcaattgttttatcatctgaatataaaattaccttaatatattaattgtatatacttatttagattattaaaattgtcacttttttgatattcttaggaaaaatattacaagaccttttgaggatcagacatcactggtaagtataataatctttatgatttaagaaagcatataagtagtaattattcagactaattcatttgtactccaaatttgtgatttttttaaacattagaagtcatcctgtgtgagggaattttgtgtaaaatggagaggaaatactttaaaaaatatctatagagctttcatttcactatggctgggaaatgtgtttttcattgcctgcaaatatattgataaaatttttaaaacttggccgggcgcggtggctcacgcctgtaatcctagcactttgggaggccaaggcaggtggatcacctgagattgggagttcaagaccagcctgaccaacatggagaaaccccgtctctactaaaaatacaaaaaaaattagccgggcgtgatggcacatgcctgtaatcccagctactaa

SEQ ID NO: 122427 - DNA, 1050 bp, Homo sapiens
gggtgatttgaatctatcggatatgccatgagctgttttgaattgacaagttttctaactagctgaaaattagcagttttaagtggaagaaaaaattttagttgaaaattaaaatacatgtccctgatttctttttttgtttgtttgtttttgagacggagtctcgccctgtcgcccagactggagtgcagtggcgcgatctcggctcactgcaacctccgcctcctgggtttaagcgattctcctgcctcagcctcccgagtagctgggactacaggcatgtgccaccacgcctggctaattttttgtgtctttagtagagatgaggtttcaccatgttggccagctggtctggagctcctgacctcaggtgatctgcctgccttagcctcccaaagtgctgggactacaggcgtgagccaccacgcctggctgctccaccatcactttatcctgcctgtattccccagttctcctccaccagtgtttccagatccagagctgtttagacatagggtattcagaaagttgtggttttgttattttaagattttaaagttcacttcaatgtaaggaagttagtaaatgtctgtgctatgaggaaaagttgattctgaatgggttggtttaactcctacagtcttagataagaacttgttaatcgtataaacatactgtttcaaagaaaaagccaattataattacttttatacatacataaatctatgagtaagatgaagaagtcaaatcaaaggattttatttcatttctgagaataattttgtatctcacttgctgtttctcaataatattgtataattttatttctgatttttaaaaataagcaaactgcccttgacctcaaagagaaaaaaaaaatttttaatttgatatttgtgtgaccctttagctcaaaaagggataaaagacttataaagaaaagccgggcatggtggctcatgcctgtaatcccagtactttgggaggccgaggcaggaggatcatgaggtcaggagagcgagaccatcctggctaacacggtgaaacccc

SEQ ID NO: 122428 - DNA, 1071 bp, Homo sapiens
tacctgtgggttttttgtagaagccctatattaggttgaagaaattctcatctattcctactttgttgagtgtttttttttcatcatgaaagggtgttaaattttgtcaaatgctttttctgcatctattgaaatgatcctgtggattttgacgtttattctgtgtgtgtgtgtgtgtgtgtgtgtgtgtgtgtgtgttttaggctttacttggatcaggtaggcttaaggcaggggccatgctgcaggagaagggcctgtaaaccagtcagtactgctctttcatgcagccctgggacctcagggctgagctccacaggcaaggggcccgttaggcccctcaaagcagacacaaccactaacaggaaggaaggtcaggctggctttagtgcagggaagggtaatgttgggagggagacgttcatgaaggaaaatgggtagctgaggctttaaagggcttggatgggacacgggtttaggggaagtgaagaaggccaataaagtcttgggggtaaagaagggaataaacaggagaaaggaacaagaaggcaggtgctggggtgtagagtccagctgctctccacagcctgggcaacaggctgagtatgggcaactcaatcccacctcctggccttcaaggcactacttgttgccccagacagccatctttgtgaacacaggtctcaggaggaagcagctggatttcatgtaggcagagatctccaagccctcaaatcgggagatgaagtccttcaggtttgggaaggcgtccaaccacttgggctcaaatacttggtttctctcaaggatgccatacgcgatgaaatccacaagtgtgatcttgtccccaagaaacaatagctgcttccccagaaactgtgagtagagcttcagcattgcagggagtgcctccaggtattctggcttcagtttcttaaaatctgggttgtagcagagtctggccagctgcacgtggttgtccacaagctggttctccaaaatgtcttcccaaatcttctccccttctgtctccccacacaggttgtgcttgtaggcaatgcagcccaggat

SEQ ID NO: 122429 - DNA, 1015 bp, Homo sapiens
cgcccgccgaggccagcctgggcgacccgcgtggggcccccgagcgcatcccgcgtgtgggctgtgtctgcctccgagtgtgcatgtcggtgggtccctgtgccagagggtgcgagcaggggggtctttcgagttgcagacagagcctgccgcttctggggcctcggggtgcccgtctttatatggaatccagctgcagagctgtgtgtttgcaagcaggtcgcagaacttacttgccgagatcgtcctcctttcccctcagcagagcagacgctaacagtccacaggagcccttccttttattgtttgaaaacaaacagaaccccagaaccttcaaccccagtcatcgccctgtcatttttgtggtctctttcgtgactatgccagttatgtagttcttcacctgcctccctgggccgcagaggggtgtgcgtatgttggcggggcggggggtggagtttggaggaatgaaagagatttgtacgaaggtcactggagttccaaagggggccctgcaagagtcacggttccgtgcgttcccgtccccccgcctttttttgccctctgggttaaatgtagaaaacacgggaggcagccggattagggactaggatgaggaaggtgaagggttgcttcttccctcttcctgttgtgttttttgacatttttttttaaccatatagtaaattagatacaaaaggtgcagattcagcgttttctccctgtagagcattattatgactttttggctggttaggcaaaaaacaaatctaagaccttctgcatgacactttaacataaattctttcactttatcctgcaaggtgagcgcggtcaaccccatttgggtgagaaaactgtagctcagtgaaagtgtcttggtgggtagtagaatggcaataaaacacatatcaactgacttcaagggctaagtgatttccattactaaatcaacctccctccccatcatttggggtaactttatatgattaatagtctttttttttaaccttga

SEQ ID NO: 122430 - DNA, 1049 bp, Homo sapiens
accagctacttcggaggctgaggcaggaggatcacctgagcccagaaagttgaggctgtggtcagctctgattatgccactgcaccccagcttgggtgatacagtgagaccctgtcttaaacaaacaaaagagattgtattgtgttttgaaaaacatagtttttagagaaattctgtgttattcttctatttccattacagcttggtttaaagaaactatggaaagctacagactaacctccttttcctttggttttttttccatgttatagcagagaaccagccagggccagattcctgggcttgtgtcctctgcagttgcacagggctctgctcagaagggtcccatacttggcttaatgctctgctgtcagcatcttgaaaatttttaataattttatatttcatcttgttttgtaagttataagcccagtgggccagtggaggctgttctaggggtctgggtttggctcatgagaggtacatccttcccacctccccaggatgggctctcagcagctggctttctgtaccctggcaccccaggcccttcttggcccctaccccgtgttcactgttgccctcaccttgggtgatgactgggtcacatgggagaggaggaaacccatgttctgctgtcaccctccacctcttgctgggtcctgggtacaagctcagggagggttgggatcaggcgtctgtgactcacagtgttgtggggagtgatggtggtcattttatcccaggctggcagcgtgctggcatattgatgagcagctgctggcatgatgatttgtcctgaccctggaccggactctgtatcttggctttagtctagtccacttctcagcattccttggaagcccacctaaactgcagagacaaagaagaatatgctttgggattttaaagatggaaccccatatgctatcaattggaaaggagttcagattctggctgggctgaatcactgattttccaggcaagtggaactttaatgacccactagtgccctttgttcactgtgggctggctggggaggaaccctt

SEQ ID NO: 122431 - DNA, 1014 bp, Homo sapiens
aggtgtcaaaccgcattattgaggggagtgggggtggtaaagcagtggtgaggacgatgagaagcgacctccttagccaggccaggagctcacctcccagaccctgcccttcaggcactgaaaactgttttaggcttttctgcatggttggagtttactcttagttgctgacagtcactcatcccctggagaggggtactgagcataatcactgttggtattttatttactaccagttcttcatcattaccgagactcattccatttggaaaataaacattgcctcatctgttcatggtatatttttacacttgcctttcactcacatgttgcatattaactgaaaagatcagcatgatcttggagcctaatgtgatctggatcttattaccatgtatgtttttatcgtcaggtgctgctttggactctggcccattcctcccacctgtcttcatcctgtcggggttgatctctgcctggttccatagtcacttggcttttggagttttatttcttctctaacccactcttcccttccctgtcaaatataattctctcatgagcaactgtgcctgataatcccagtgtataggccatagctcaggttgttttaatgcttgcaaggaagtctcttcagattactacagggtaaaagaatccattccctttcaacctctcattacttactgaatcaattatttatttacttgtgtaattcacatccatgctcaggtatgtgtttagtttacctctgagactgtggctccctctagacaagggtctttgtctggtattagtccacttcctcagtgtctaatttcatgaggacagaatcagggcaagacctactggctaagacttgctgctgcctcagttatttggtttactgtttaagcccttgagccaggaggtgacagtatcttttgtgttccaagtcagataaccagtaacagtaatattctgatgtaggtctaaggggcaataggagcctgaatctgagccccttggcaggga

SEQ ID NO: 122432 - DNA, 1039 bp, Homo sapiens
tttccttactataagcctgtcaagtctagtgagatgacatggttattaatatattacaaatgaagaactctgacttggaggtagtatagcactgtggttaataatagaagttcttatatttttatatgaattatatattatgaaccagaccagaatactagctctaccaattacctagctgagtgatggtgcagcaacttaatctctcaaagccctggttttctcattgtaaaatggaggaccttataggattgttgggtagcttaaatgagataataggtagaattaaaagtaacggcaaaaaccgcaattacttttgcaccaacctgatatttagaacagtggaggcatatagtaggcattcaataaatattggtagtattattttcagaggttattactcatttaactcaacaaaaattgagagcccctttctatacgctagtcattgtgctaggcatcaggagcacagggcaaacctggtagggtgcttactctgatggaatttacattttagtggtagaaatggtaaatgagtcaacaagaattttatggagtgacaaggactttgaggaaagtaaaacgggacaatgcttgagaagggtgctagttgggaagtcctatcacacgaagtggtatttgatctgagacctgagtgaccatagccacatgaatacctgggggaatcacttcccaggaggaaacagaagcacagaagccgaaaggcaggatcacaggcggcacattttattggtgcagtgtggaggtagagggactggattgtgtagggtttgtaggccagggtaaagagcttggatttcttctgagtgtaggattttgagcaggggagtgatgtgtcttattttgggcgggcgctaggccaggtactgtgaaggaaataatggtatagaagaaatatgtctttcttgctagaatcttatgtgacatacaactagtggtggctgatcagcaattagaactgcagtgttcttgctggtgtactcctaatctgatcattggatgatatttatcacgtatt

SEQ ID NO: 122433 - DNA, 1048 bp, Homo sapiens
gcctgtgggtttggcattcatgggctgcatgaagtaagtggaggactaaggagatggaaagggagtggccagataggcagggggaaaacagggatgagagtgtttctaggggcaggagtggtcagcagtgtcagtagctagtgacaaagaggctgaaaggttttcattgaatttagaatagggaggctatgagtgagcttacagagaatggtttctacaggtgcagaaaattgatcatgatcatttgaacaaatggaaatatagacaactttgtccaaatgcttggctgtggaaggaaggtaaaggcaagccacaagggggggtcttaggttttgaggattaagcctgtctaattatattatacatgagaggcagtatttgagcagggccttgaaaaagaggtgaaatttggacacaggaaaatgattggaaaaggcattacagataaagttaacttccattaattgacttgaagtaataacagtcaaccatttattgaggactttcatgtgccagacaatgaactaagggctctacatgcattatctcattgatccttgccccagccctttaagagaggaggtaccattgttatttccacttagagatgtgaacactgaggaactgagaggctacctcactgtgggtgtctgtgtgtatagaggtccaggcagtcacaggacagtctggtcacacagctagaaggaagtgaagagagttggtaatgtgctgcttttaaaaatgtatttattgtatcatgatcactttgtcagtacttcactgtggacatcctcatctaacatttagttttgttctctagtgtcaagggagccctctaatggacatttattgcactacagactttcagctttcatacattcaaaaattgagtgcctcctgtgccccaagcaccagctcagatgctgttagggtgatgcaaacaagacagacatggtccctgagttcctaaagcaagcctgaggcaggaagaagccgaatgtgtgtggaaacccaagaagatggggaaagtggcatgggaagggactgg

SEQ ID NO: 122434 - DNA, 1134 bp, Homo sapiens
tcttatgttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatga

SEQ ID NO: 122435 - DNA, 1613 bp, Homo sapiens
aaattaatgaaagtttctgtaatgtatgtctgccagtaatctgtggtagtctagaaagtagggattataaaaatttgttgtttgcatacacgcataaaaactttcctattattttttgtatttctcttatgctttcagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatatagcagtgtgacttcatcttttttataagcctgtattggttacatctttcttaccctacccttttctgagttttaatgaagtaaattatttaacatatttttatatcctgtttgatattgcaatttccttaccaaaacttcttcagggttaaaacaaaaaaaaaaataaaaaaagggcagcaaaaatgggaaaatttaatttagcactcatccttttagagagttttaagagtgtacttgtttgttagtagatcttcagtgttcattttcattttgatataattattaattaaattacagagaaagcaaaaactacattacttcttaaaaacttaaatgccaatttttata

SEQ ID NO: 122436 - DNA, 1036 bp, Homo sapiens
cttggacacagggcggggaacatcacacaccagggcctgtcggggggtggggagctgggggagggatagcattaggagaaatacctaatgtaaatgatgagttgatgggtgcagcaaaccaacatggcacatgtatacatatgtaacaaacctgcacataccctagaacttaaattataataataaaaaaaaaatgtatctgataatattaagatgtaagttccatgaaggcaaggacttcattcatttctgtagctccagtgtctggaacagtgcctggcacatagtagctactcaacatttgttgaatgagtgaatgaacgaatgaatgaatgcctgagtaaacctgtaattagcatgaaaatagcagctttgctgtgaagctgactcaggcttacttctgaatggatgtttttatagatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaaggtacagttttgttccatgggcccagaatcacaagcagtctgatcttacaggaagatatagtcactcttgaattatagtgtgagatacaaaactggtgtgaaaagtgaaatgaagagtctaaatgataaacttcctaaaaatctcaaaaatatcataaactattaataatggtttgttttataatttattttttgttttttttatggaatagtgtgttgtgtttcttaatagctacaacaagaatggccatccatccaatttcttttataatacaggttgagcatccctaattgagaaaaatcaaaattcaaaatgctccaaaactgaaagtttttgagcaccaacgtgactctcaaagggaatgctcatgagagcatttcagagttcagattttcagattaatgat

SEQ ID NO: 122437 - DNA, 1013 bp, Homo sapiens
cctcccaaagtgctggaattacaggcatgagccaccactcccacctaaaatacatcttaagctagttgatatctgccaactcattattttccaggtaacagtgatttacagagtaatttttaaactcttgtaggatatctacacttggtgtcaactaagcaaaatgtatatatattattctcaaagaaatagtaattctgttttgaaattgtcttttgtagttttttcattgttttattattgtttaattctgacttaatttgtgagaaagatggcttccataacagtatttgggtgtggtttttttctttgaattcgaataggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaagggtaagcttaccaaatagtacatgtgctctaactatggagagatttcactccaaattttcagtagaactaaaggttttatgtgctattgatatgggagtgctgggaagggaagagtgtggtcccgtaaaatgatacggaaagcgggaggggaagtgctgggtagagaaaggtgggtccctggctagggctccacccccacagatctaggtgaggataggcactcctgctttcatgcccaaatgttaccattttccaagaccaccttggcctgccatgccccaatcctgggcctataaaaacccgagaccctagtgggcagacacacgagcggctggacattgtgaggaacacttcggtggaagacccaagcagctggtcgtcaagaggagcacgccagcagaacagcacaccgagaggcactggcatgctggcaggccattgac

SEQ ID NO: 122438 - DNA, 1009 bp, Homo sapiens
agggagactccatataggaagtaacaatgaactatgtcttgaaaaattgttagaatttcagtaggcagacatggggctgcaatcattctgcacagaagaaaatggcatgtatggaattggaaaaggacagtatggaaatacggggaagcaggagatagatccggaaaaataaagttgagaccagactgtagactgtcttgaatgccaagctaaagtgtttatactttattcagtaaataaacaaaactggtagcgcaagaaaaggagtgagcaagtggtaacaacttaaagacaattcattttgctcccacgtgttatatcatgaatttgttgggcccaaagtcatatatagaattttttaaataattgatacttgattaaagaaagcacaaagacataaaaataaaacattcttggtggggggaaatggtttttaagaggcattttattaattttaccacaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaaggtaaggtttatctatcttgtcttcatctgtaagaaataagtggctaaagtgtctggtgaaaatgtaactacccttaaacatgcatctaggtgaaggaactatagcctatataattaatataactataggagtaactacatgaattttgagaattttatttgtagtgtcttattttgtttttgtttgtttgagacagggtctcactttgtcacccaggctggagtgcagtagtccaatcctggctcactgcagccttgacctcctgagctcaagcaatctttctgcctcagcctcctgagtagctagaattttatttctaataaaaacaatttatttgattttagtccttaagtttctgacttcctcccataccttacgttttatcaaaaattactaaaaagcaataca

SEQ ID NO: 122439 - DNA, 1046 bp, Homo sapiens
agaaatcacttcaggaacaaaccagtcaccttgtttttcttgaatttaggttttaaatctttaaattgttaaattttagttaacgaaatattgaaagaaataaacgtatgcttatactttctgccctttattagaatcaggcagacttaaatggcaacttaatggtcaaaatatattacctacaaagatttaaattgttttaatgtgtagatgctactagttgttcttctacattattttaaattaagactatcttagaattaatgatactctaataggcttattgtttatatttttcagaagatatccaaactaaaaatagggtcccttttttctctcctgtatctcccctcaaaagagacagaggaaaactttacaaattaaagacaaataagagacatcttaaaagaagattatattgcctcttaaatgccaactttattcctttcttttctattttcttagcagtgagtctgtactagaatcatgagacagtagagtggttgatggtagagtggaccccaccagccctcaaattcattctggtgtactatatcaaaagtggcatcattctctaccagtaagagggaatactaaactaaaattagccatgtagatgaagaaaattttaaccaaagagttcatggtatgtttctttttggaaaattttaaaatgtagtatttctaaggactgatgtagatgagatctacttggagaaatggaaacagatttttttttattaaatgggtctctatataaaaatcagttttccagtcacatttctgcgaatttggtccctgttctttttatcttatgtcttaaaacattatggctgcttcaaaatgtacaccaaatgaattagaggttagaatatgttccattgtcgcatatctagcagcttattatctccctttaacagcttttttttaaacttgcatctacttttggacccagtgtgtaaagcttaatgaaaataagattttttaaatattcaggtgtgtgaatatcctatacctgagattttaattgttaggtctgacatgca

SEQ ID NO: 122440 - DNA, 1377 bp, Homo sapiens
agtcgtaggaataggaaaaggatttacatatatcccttttcgcatctgaaagctgactaaataaccagtattacaggctggtcatagtggctcacgcctataatcccagcactttgggaggctgaggtgggcggatcacctgaggtcaggagttcgagaccagcctggctaacatggtgaaaccctgtttctactaaaaatacaaaaaattagctggacatggtggcgcatgcctgtaatcccagctactcgggaggctgaggtaggagaatcgcttgaacctgggaggcggaggttgcagtgagccgcaatcgtgccatcgtactccagcttgggcaacaagagcgaaacactgtctcaaaaaaaaaaaaaagtcatacaatcttattctgaaaagcagattatcctcaaatgattatatattcaaatgaccaatatatttaactgtgtttcttctcttctcacctccctttctccctgcagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtaaggtttttttcacatttacaataatattgttgtgctttgtacttcttactaaaattagacactttctgagtgtctctttgctctggacaccttccctatgagcaagataaatggactgtatcccagctaatccattcattatagttgtcttaccaattgacatggatcaccatatgattaatccagcttcatggatggatgactcatgaagaggattgggaataggtcagccttgcaactgtttcactccatatgtaactatagtctcttttaaaatgaaagttaaattgttgatgtaaattacctttcagtggaacagtttgaggattatgatcttataacttcaactagacctcctctttatttttcttataaatagtccaggattttaaaaattaaatgttaggttttattaattaatgtaaattaaattttataaactgataataacattttaaattctcaaaggattagatacttttcttaaattgtaggaaataacggagtcttcctttttattgatttttgcgtatttgagatcatgtgttggttttagtatatcctatattccttcatagaaagcatctgtggaaattatattggtaatcctgtctttttattaaaaacaggaatttggaaaatttac

SEQ ID NO: 122441 - DNA, 1035 bp, Homo sapiens
acagatggaaaatggttgatcattatgttagccgtgtccgtggaaatctccaaatgttagaacagctggacctgattgggaaaaccagtgagatggctagactttttggcattcagtttttacatgtactgacaaggggttcacaggtgggaaatcagttttcttgcagacttgaaagttctgtatgagtgatacacttttgtgatgtttgaagtgatttgactttttaaactttctgtttggtaccaactaatcaatagctgggtaattaaatcttgtcattttattctctttctatgccaactttccggccactgccaagttttttatggtattaagaaaataaatgtccatgcccttaaggatataatattcctgaatattgttactgtgattaaagatgtcccttaaaactagagaagcaacaaagaaagtacctttcttttgttttacatttttaattttggcttgttaaaacttcccatagataattttaatataaaaataaaaagcttgaaaatcaatataagtggactatgtaacttttttaaatgttataaaaaaagaaacctaagaagccatttaattcatatctaagtaatttcccaaggatataatgagagatttttactaaacgccttgctgaaaatgattttatatattcaacaaatatgtatttgaatacctgtagtttgttaagcacggtggtaggcatcagcgataccatattaaaacactcagattccttaacgttgtaaaatccttacttattttaattacctgtgtctataacataatcaaccagttcagtaaatatagcaaaaatagagttccaactacgtttgttttacctgtttatttcatttaattgcttataagctatttattttatttatacccatcaaatttaacaactgtttgagctagtctgtaataaaaggcaaaaataccttaaaacctcatgagaatacttcagtgaacccaggctggttcttgtgagtaattttttttctaataccccaagccttctaatag

SEQ ID NO: 122442 - DNA, 1014 bp, Homo sapiens
tctatcaaagccttatagaaatagaagctgaggcgaagttggctgagtgcagtggctcacgcctgtaatttcagtgctttggaatgccgaggcgggcggatcacctgaggtcaggagttcgagaccagcctggccaatgtggtgaaaccccatctctattaaaaatacaaaaaattagccgggcatggtggtgcacacctgtaatcccagctactcgggaggctgaggcatgaaaatcacttgaacccgggagcaggagtcagaggttgcagtgactaagatcacgccactgcgctccactccagtctgggcgacacagcaagactccatctcaaaaaaaaaaaaaaagctgaggagaaattatacaccaataaataaaacttgatatttaacttaacattgaaaactatattcagtggtttgtttataagccccggaatctctaaatacatgttttaccacctttaattaggtattatctaggatgataactgtttttgacaagtaaaatagaggactggaactaaaattgtacagaagggacttagactagacattagaccatttatgtcaaatggattatgttatatgagaagaccatgcactctttgagtagtcttggaaatatcagacaacttcattcttaaatttaagtgaatacttaaatttaaatgagtacattcttaactttaagtgaatacaaaaaaataagtctgacttacttttttggtaggtatggtaaccccttttgatttccatttgctttctacagtgttttaaggacatacatatatattgtaaatcgacttagaatgagaagaacttgctagtcaaggatttcttgtgttaaacctgtaaaacacaaaggtaccctaattttttttaataaacccagatttttgtctcctggaagccccagatttatatgaatgaattatgttcccaacattttattgtttcaagcttagaacacattttttcataaaataatgtcttgtgattagattcctaagc

SEQ ID NO: 122443 - DNA, 1944 bp, Homo sapiens
taactagataactcacctcaaatctgtggaatcccattaatcagcatgtcatcaagaaccaaaaagtaagtatggaaagaacaaaaaattaatttgcttgacaatgcttctgtcaatatgtatattatcatggagtataaaaatggtaagaactagaatctcttaaaataagtattatatgaccaagttgaatctcatcaggtctgctttctctaattaaataattttccaatttgttatgaacatttctgtccagtaggctctacatagttttgaattatgattcagttgtactgcacatcagttttacaagtagctttaatatctactatgaaaagtttaaagtgatattggtatcttttagaaccaaatttgctacataaatgtaagcattattataatggtgtcttgcctttttttttaggtggctctaactaactacacctttgaaaatgtgagctttcatgttcttcatcagcgttttcccctctttacctttcgagtcttgtcagactggtttgataacaagacagatctatacaggtactgttctataactctgaagaaggtaatataaaatcatcattgagatgtaatttatatgtaataaaatgcacacatttaaagtgtattgttcaggccagttgcggtggcttacgcctgtaatcctagcacattgggaggccgaggcgggcacatcacctgacatcaggagttcgagaccagcctggccaacatggtgaaaccccatctctactaaaaatacaaaaattggccaggtgtggtgatgcatgcctgtaatcccagctactcaggaggctaaggcaggagaatcacttgaacccaggaggcagaggttgcagtgagccgagatcgtgccactgcactccagcctgggcgacagagtgagactctatctcaaaaaatatataaataaataaagtgtattattgttcaatgactttgaaaaatgcatttatcttgtactcattactccaatcaagataaggagcatatctcacacccagaagattcccttctacagctttgcagtcaacctacccatccctaatcatctagataattactaattggatttctattactgtagattagttttgccaattatagaacttcatattaatggaaatattcataatctatcttggctttgaagaaactcagaaaacatagtatgtatttctgttgcataaatagtttgttcattcttattattaaatagtattcaattatatgaatataacttacccacccacctgttgatggacatttgggttgtttccagtttgaggctattatgaataaaactgcaataaagatttgcatatgagtcagcatgtgaacatacattttcatatctcttaggagtagaattactgggtcatatggctgttgtgtgttaacattttaagaaacttaatctgttttctttggcaagtctgttggcaaaaaattatcttagcccttgtttatatgaagatgtctttatttcacccttatttttgaaggataatttctcagtctcagttgcgtttttttctttcaccactctaaagattttgttcccttccagcctctcattttgctgatgagaagtcaacagttattctcatttttccagtatttgtgattcattttctttccaaagtcagatttaatgagtggttgaccgatgtcactttttactctctgcaaggtttatagtggaggcagggggagtttctcagttctcctgtctaacctcagtctttggatcttcctgttcttttttttttttttgagacagagtctcgctctgtcacccaggctggagtgcagtggcacagtctctgctcactgcaagctccgcctcccgagttcacgccattctcctgcctcagcctcccgagtacctgggactacaggcgcccgccacgacaactg

SEQ ID NO: 122444 - DNA, 1770 bp, Homo sapiens
ccttgtctcagtttattcatctgtaaaatagggataatagaacttatttcatagggttattttgaagaacttaaaacaatcaccagagtatatgttacattgtttgctaaatgaaaaacaaacttttaaacattatctctttaaaataaaaagaattgggtgagtggttgtacatggtctttggattcaggtaatcctagtttagaatactagttttcttactgtaagatcttgggcaagatataacatttctgagtagaattttccgtaatacaaaatgaaaattatactaacttcttaaatggtcctgttaaaataaaggaagtaatgtttgtattaaaataaatgatgttggtaaaattcttagaacataataaaccttcaatatggtaaatatttttattattctggaacctctaatcatcaacattcacatatacctagtgttacataggagagacgcattttaatttatattctaggtaaacttcatctcctaagaaactagactcacaacgctatttgctatgaggaactcttcatctagttctccatatgcattcaagagaatttcatcctgaatgtgaacatgatgtcaacaaattttcagagaatcgtttaggttaaaaattgaactagttttttttccaagaaattaccagattaactgtggatctttctcatgctaagaccaaagaaatgttagcattaggtgtttataaaggtagcatcaggcacctgtagtcccagctattcgagcagctgaggcaggcggattgcttgtgaccaggagtttgaggctgtagtgtgctatgattgcacctgtggctagccactgcactcaacctgggcaacataaaaaacaaacaaaaaaaggtagtgccaaaaattaccaaatctaaagaaaaaagtgtttcttatttaaatatagaaagaaggagggagggagagacttcaggttatatttatttcacaaaattttttcatacattgtgaattatatttcatctttaatattcatccttaatgtatattctcattttccctggcataattttattgaaagtttgttttctgtgagccctgatacagtctgttttcatttctatagatgacaaaattgagaacagatttgcagctgaaagagatgagtatggatcatatacaatgagtgagataaatattgttggccgaattacactaaatctttggagaatcatgagaaatgaggtgggtgatttatccaaaatgttgtttagaaataagatattcggtcaatataatgatttaatcattatagagtattagtaagatttactatatagcttatgcgtttgtcaattactgttatacttaagtagagttaaaatagtactttctaaaatgcaaaactacagaggtaatagactttaatgttttaagtgagtttttttttttttcttgtgtctaaggtagcaataactagaaaggtctatagctataataaaatattggggccaggtgcagtgctcacacttgtaatctcagcactttgggaggcccaggcaggggcatcccttgagcccaggagttccagaccagcctgagcaacatggcaaaaccctgtctctacaaataatagctaaaaaaaattagctggatgtggaggcgcatgcctgtggtcccagctacttgggaggctgaggtgggagaatcacttgagctcaggcagccgaggttgcggtgagctgtgattgtgccactgcactcaagcctgggtgacagagtgag

SEQ ID NO: 122445 - DNA, 1140 bp, Homo sapiens
attatgtttactttacaaaaatagcgtcaaatcgcctataatcccagcactttgggaggctgaggcaggcagatcactggaagtcagtagtctgagaccaacctgaccaacatggtgaaacctcatctctactaaaaatacaaaaaattagccgggcgtggtgtggggcacctgtaatcccagctactcaggaggctgaggcaggagaatcgtttgaacctgggaagcagaggttgcagtgagctaacatcatgccactgcaatccagcctggacaacagagtgagaccccatctcaaaaaaaaaaaagaaagaaagaaacaaagtagcttcaaatcaagtactcttaaccatccatctcttcctgtataaaaactctgtaggtaccactgtatcatcccttctccatctgggcaccgttagagaacataggtttttgttttcataccttatatcatgaagaaacaattattctggttaaaggttcaaatgtatggtacttatataacttttttaaattccttttttaggtatgatcctgatattctgctaggatatgagattcagatgcattcctggggttacctcttacaaagggctgccgctttaagtattgacttatgtcggatgatctctcgggtgccaggtatgtgtcattgtgaatgttttgtcattcaactacagagcaaattataaaggaaataaagacagaatgttaaagagtacttatgctgtagcccaattttttagtactaagttgtgtaagttttagatatagcataactccattgtagaaaaaattaaaaataaaataaaaaatattctagtctcactgctatatgtactgttagtatagttgttgggttttttcctttcagtcacttttcatatacatatgtagtggtttttaaataatcataccgtatattccatttttattatgcttccttcatctagtgtcttaccacacatatttttctgcattatgaaatagtcttcataattattatgaagctacatagcatttctttgacttgttgtaccataattttattgtttgtctgcctctgttttttttaatccattttgttggttaagaaggacaggatgggttgaggaacactagtagttaactaatcat

SEQ ID NO: 122446 - DNA, 1049 bp, Homo sapiens
agtgaattaattggtaggaaatttgaattttaaaaaagctctctttttactttaaactacaggtaaaactatatagtttagctaactacatgaagagtaaaacgtgacagactttggtttcattgtataactacttggactagtcattctctttctcaaacaggcattgagagatcctgcatatatttgagaaaaatagtctaaatattgtcattgagagcagattttctgaaataacatcatgaattgatttaatctaatcttgggattaaaaatctttcgttttaatatatggagtgctgctgagctgtgactttgtcctttatgtccattttttctgtaatcttacatacatatttccctagagccttacatacttctttgagcatgtctttaaaaaatgttttaaaaacatagtatttatttgcttttatagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaaggtattgtccatttttattaatgatatacctgcccactctagggtgaatgttttaatggggaattcctgtgctgaagatctaatctaagcaagcatgatgactcttttctaaaatgtttgctgaggtaggggtaggagattgtgtataactttgtcctagatttattattcttacttggattagtcagaagcagccaggcacagtggtgcctgcttatatatagtcccagctacctgggaggctgggcaacaggattgctcgagcccaggagtttggggctgtagtgcactatgattgtgcctgtaaatagccactgcattccagcctgggtaacatagcaagaccccatttatttattcattttttaagtcagaagcaatgcaatataaagatcttaatatttataattatcttatataa

SEQ ID NO: 122447 - DNA, 1604 bp, Homo sapiens
caagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacaggtaagtgtacaaataacaggaagtctccataattgttcttcagaaatagaaatgaagataacattagactgtaatgaaaatcagagctttttaaatgaaggtatagctcagcaaatatttttcgtcatgtcttagaaagtcgtcacatggcaactgtctttctgctgtgaaatctacttatatttgcttccatcctgtcttgtgggtgaaatgcaggagccctctcaaaaggcttatcttctcaacttgactttcctgttggcttttatacatacccaggtctcccacattttaaaacagaaacaaaaaacctgccttgacctcacgtctccagccagcttctactctttctcctccccttcaaagccaaatttcttaaaagatttatctaatttgacaactccagttatttacctcctactcatttctcagcccactctaaactgaattctgcccctgtcattctacattatagctcttgtaaagattcccagtaaacttatagctaaaaccaatagatgttcctgagtcttatcatatgtcctctaagcagccattttcttgttgaccttaccttccttcttggagcttctccacttggctttcctcctacttctctgtttttttcccacttgattttctcattattctcagttgttatctaaatgttggagtttattaaggcttggtcttaagccttctttatatctttctctaaatgatctaattcctgtctacaggattactacagataactcgcaaatttatattcccagttcagatctctcttttaagctccagaacactatatccaactacctatctgacatttccacttgaatgctaaatggcacctcaagattagtattttaaaaaccaattcatgatctcaccgcatacattcaccaccacttccccaacacacttatatatacatgcctccacataaaaacccatctggccttctttcagttttccttatttcaa

SEQ ID NO: 122448 - DNA, 4321 bp, Homo sapiens
ctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccaggtaatcagttattttttcccttgggtcactctgaattattatgatatataaaattatgctatggggattgaaaaaaaaagaatgtatgcaacatttggttacctgactgctagttttctgtgataccgtatttgtaagtatatcattgtggaaagtatttctaattacagacttactaagaaaattcaaaaactaactggatggttacacctagagaaatttatttaagttgacttggatctaccattatttaacactatgtcttcattaaagattagaggtgctcactgtaaagatgtcatgatactttaaaaggattacaatgatcattgtttaaatggtatttaatttttaaa

SEQ ID NO: 122449 - DNA, 1056 bp, Homo sapiens
atagtttttttaactgtactttgattcacggaaaaccgtattacttaagaaggaaaatgcatttattttgaattaatattttgcaaagttcagtacattactaaaacaccataagtggttctttcttggtgagtatcacaaatttcaccggaggaaacacgggtggctagggccatggtcccagcctcctcatctcactggccagggctgcactcaaccagtccttcagtggcctccccttgagtggcatctcaggcttcctgcagccactgccagccttccctggcaaggcctcccaactaggggctgacagtgctgagctgtacccacggccaagaccctgtgcagtcccaggcagccctggctggagcacacaacaatgttattttaataatgtccctaaattactctaatgcaggtggtccaaggatcaactttgataggagagctacctcaacacctgagcctttgtaccaactgtattctttcagcctgtgccagtatctatgatgttgttattttattctgagtgatctgaattgttggattattaagaaaacaggccgggcgtggtggctcacgcctgtaatcccagcactttgggaggccgaggcaggcagatcacgaggtcaggagatcgagaccatcctggctaacacggtgaaaccccatctctgctaaaaatacaaaaaattaaccaggtgtggtgacgggcacctgtagtcccagctactcgggaggctgaggcaggagaatggcatgaacccaggaggcagagcttgcagtgagcctagatcacgccactgcactccaactccagcctgggtgagagagcaagactccgtgtcaaaaaaaaaaaagaaaacttatttgttggtgattattgtacttgttttatagtggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacaga

SEQ ID NO: 122450 - DNA, 1321 bp, Homo sapiens
cttgaacccaggaggtggaggttgcagtaagccaagatgatgccactgcattccagcctgggcaacagagcaaaactccatctcaaaaaaaaaaaaaaaaaaaaaatagtgctgttataagcagtaaagcataaattttaggataaatatcataaagttgtaaaatgatatcaatagtaacaaatgaaacagtttaagaataaacgtcactaaaaagattacctctgccaagcaaaagaattactagggcatgtggtatatttgtgtttaatttttaaataaactcccaagctgtttttaaagtgacagcaatgttttactttcccaccagcaatatatgagagtttctctggctctatatcctcactaacacttgttattatctgtctttttttaatgtagccatcctagtgtgtgaaatagaatcctactgtggttttaattttcgttaccctcattactactgatgtcgagcatctttatgtcaacattataactttgaaatttatccttgttcattcattttagctgctgatgactgttccattttaagactaaacaacaatgttagctatttctctacaagtattagatggtctttacttttgcacttagtgctacatctgtctccttatggctatgtgcaggagcttctctaccaaacacatgtagaagagtgagttgctgaatgttagggtgtatgcattgtactctacctagatagcatctgttctaacagtttttctataatgcaattagcttatacatggttagtaaacaagacaataataaaagttttactcagaagtcacattgtatcatacgcaattttactaggcaagcaaagcctcaacatttgatagcatcaaataataaggataaaataatagatgtaaaaaatttgctgctctgattctttgaaatagtgtctctgcattttaatctgcatttcctaattactaatgaatttgagcatctttaaaggccatttgggtttctctgtttgtgaattacattttgtgcttattttctattgagtcatttgtctttttcttatttgtaggagttcttcatattttctagatattaagtctttatcagttatacttattgtagagatgttttctctccatctaggcttatcttataaaaatcttcaaaaaaaaatgttaacttcttttccccccatttaaaaaaaaaagttatccttggggttttacatgtcttcagttttaatgtcaagtttaccaatattcctttatggtttagttttggtatgtgatttatgagaccttccctaccctgatgtaatgaaaatttt

SEQ ID NO: 122451 - DNA, 1078 bp, Homo sapiens
caacatggtgaaaccccttctgtactaaaaatacaaaaattaactctgcatgatgtcacatgcttgtaatcccagttacttgggaagctgaggcaggagaatcgcttgaacctgggaggtggaggttgaggtgagctgagttcgcaccagtgcactccagcctgggcgatggagcgagactccatctgaaaaaaaaaaaaaaaaataccaaagtgtttcaaatcaaaagttaatgaaatatgtcatcaaccactttgtagtaaaattaaggatctccccttttccacttggtgtccatttttgtacaaggcctaaattttggaatgagtaaactaggatccacactagatgttatctcttcattctgttaagtagggtcaattatgtggtgtcttctttatcttctcttttggggcactgatgaaaagcaaatgcttttgagtcaaagatccagactgggaaacaatcctttgtagttctcataaaaattaatgacctggtgatatcattacttttcctagctatgatcccactgttgatcattcatacattttatcagttctgtagttatgaagaattttaaagtattccctatctcagcagtagttgagggcaggaagaatggtgaatatcgtttgcccatttctcagtgtgctcaccttcccttttattgcatgttctcccttgttttttgaatactgaaaaagatgtctctaggcaactgatttcatatgtgtatggttttttatgcattcctctgaggtttttatattatcctatcccattctgccccgggtataaccatatgctaaaacgttttatattccttttatataaaatataatgaaccaaaatacgtagaatttacttcaaaaggatctagggtagtcagtataatatgttttgtatttttctcatcctatttttcattatatatacatataaagtatcaattttgtcagaataattgtgaattaatatatcaggttttctgggtacaagctaaatgtaagataattgtataagtaagaaaaatgttagaaagtttgctctcacataattattatgttttttatat

SEQ ID NO: 122452 - DNA, 1050 bp, Homo sapiens
caaatggtgaataatgtttgggctgatggcatcctaagtaccttgattttgtcattacagattgtatgcatgtatgaaaataccacatgtggctctatgagtatgtacaaatattatgtatcaataaaaagggatctgtaatttatgagtaataaaattttttaaagaacatttaccagccgggcatggtggctcacacctgtaatcccagcactttgggaggccgaggcaggcggatcacaaggtcagatcgagaccatcctggctaacacggtgaaacccagtctctactaaaaatacaaaaaaaatttgctgcgcttggaggctactcgggagactgtggcaggagaatggcgtgaacctgggaggtggagcttgcagtgagccgagattgcgccactgtactccagcctgggcaacaaagcgagactccatctcaaaaaaaaaaaaatttaccttctaaaaagtaattatatgaaaattgaaagtagaatttattccttttacctttctattcctaggtaatacattgcatgcaactggatcctgcaagaatcatttatcaggaaattctcttgctgatactttatttcggtgggaacaagatgaaataccaaggttagttaatgttgtaaaggaaatgaaaattttacatatatcctagttgtgatcagaaatcagtggttaccataattaaattttaaccttttattgtattggatctttttaatctatacacttaacagaaacaaaccttgacattagtgtattacaaggaataaacgattttaaaaacaaaccatgaaaatgtactagttattacctaattaacaaaaggaatacaaggtagatattgttatacttttctgcaacattcatcttcatcatctattctaatttgatatcctataacttgtcaagtaaaacaattacatttatgataaaatagtaatttaaaacaaaaatctaaatatttttaataacccctaaaatttataaatattaaataagtaataaagtattttgacatgctctggttttgaataatat

SEQ ID NO: 122453 - DNA, 1052 bp, Homo sapiens
gacatgtgactcttcctttcatttgaacatttagaggccattgtagggttactaatttgcctaatttcaatatcgtagtgtctcagggaataggaaggtgctaggaaagaaagaaacgggaatggccagtcagtggagcagttggaacacactcaagtttgctgtcttttatgggcacggtttattgtggtacctgaaaacaattaacaatagtaacatcagagatcactgttcacaggtttgaaatattgcaagaggaaccaaaatgtgacagagagacacaaaatgaacacatgctcttgtaaaaatggcaccaatagatttgctcaatgcagagttgccacaaatgttcaatatgtaaaaattttaatatctgcaaaatgcaataaagcaaagcacaatttaatggggtattcctgtatttggagttatgcaaccatcaccacaaattcagaacattttcatcacctctgaaagaaatcctatgacctgtagcagtcacccccaagcttcccatgtttcccactcctgagcaaccttactaatctacttttggtctctgtatatttgcccatactgcacatttaatgtaagtggaatcatataatatgtggggttttttcctacttagcataatgttttcacggttcatcagtgttgtagcttatatcagtacttcgtttctttttatggccaaataatactctgttatgtgaatacactacattttatttattcctatcccagttaatggatattttggctattatgaacaatgctgctgtgaacatccatttatgaatttttgtgtagctatatattttcatttctcttggacacctacctgggagtagaatttctgtgtcaagtgttttagcatcttttgccttttcttctcattgaattccttcccttctacttctcttaaaatgaaactgacacttccagtcctaatatcctttctaactgccataattttttttcttttccatcactgtcaaccttcttgaagcagaggttagcattttttgtctcttagttcacttttggtt

SEQ ID NO: 122454 - DNA, 1050 bp, Homo sapiens
aaccttttaatttttaaatatagttagtatcaaattggtttaagacaaaatattcttcatccatgcagttttttgttattcagaacatgttgcttacttgaaaacttgattgaaacttttaatttctaacaaaatacaaatttccggtaaaattgagatggaaattttgtgtgctaataagtgctttgttctgtatatttctataatcattgtttcatttaacattttagggaacataattttatgataaaactttttttttctaatttaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaaggttaattttcagtcaaattaaatttttgtcaaattaaagttttgaaacaagtgttatatagtcagtgatttataaaataatatatatttagaaaataaatgttgagtgactaaagaatgaaaagaaatacatgcaaagtgggattagagattgtcaggaaaagcatctcagaaaaaattttttttggtaacagctttattgagttataatttatatccgtttaaagaggacagtttgatggtttttagtatacaggctacctaaaaggtattgtgggtttagttctagaccactgcaaaagtgaaccctttacactgcttagcaattgatatgtattgtgattcttttttttttttaacctcagaccttaatgttactttttatattttaggaatagtatatgatacacaattctagaaatccctggagttgttagagccttgttactttagtccagcacttccctgatggtgtgaatagctgtaggttagtggacgtgttggtctctcagcattccagacggattcctaagtcccttgagccatcacctccaccactgaacatccttgtccattttatctcagtgggctgtgcaagcattgttatttttctt

SEQ ID NO: 122455 - DNA, 1043 bp, Homo sapiens
ttctcattccagtgtgatcaatcatatttctgccattttgttggtttacattttaacatctatggttgtttcttagaattctgccttagactttcatctttactctgtatattttctgttccctctacagacttatttactcccatgggtttgtttggttttaacttttgtttttgtttatctttatgcttttgacttccaaatgtatatgaatagcctcatttctctctagagcttctaaacaatatatcaaaccatctactggatagatggaatagccgagtggttaagagtgagggctcacaaggcagagaaattttgatttgaattttagcccctttgtttttttaagacacaggatcttgctctgttgcccaggatggcatgcagtggcgccatcatacctcactgtaacctggaactcctgggctcaggtggtcctcccacctcagagctcttctatcttttgtgtgatttttaaatctaagataatttctttatttataaaatggagatgatcgtaccacagacttgtaataaacattacttgtaataaagtacgttagcacagtatccaatatatagtgctcagaaatgttagttacctctgctgtgttaataaaatgattattattttctttatgattcatttccaatattattattggatccccactatacctaaatgcccttgtgtctaaattgagtttatccttattccccttccaaaaaatcccaaaccaatttttcttacagttcttcccctttcaaataattgcaccaccactaaccagctgcttaagcaagaaatctaggcatcaccctcagccccttttctgtctcacccttcacatctagttagtcatcaaggcctgatcatttcaccccttatatgtctcctgaatcagtacatttctatgatccttgttatagccaccatccttagtttttccacaacagcctatttactccttacctgtagtcttctgtgttctatagctagtctggtgatgtcacttttctgctattcacctctcagacaa

SEQ ID NO: 122456 - DNA, 1020 bp, Homo sapiens
aggaaagtatatgtgctattgaatactatcaacctggcataattgcaaacccagttgatatatatgtgtgagtacacacgtgtacattagaacttctaataaagtcattctgtgagactaaatttgcaaaataatttatctggaaacagtttaaaatggggtcttatttttacctaagagtgtgtgatggatggagtaggtctgggatggtgcccagaaatatgttgatgcctgtgatttaggtaacccttagaatctactctaagaaatactgttttgataaagcaggtgatattttggattgatgaaggtctcttttagaatcagattgttcttattattgaatggttaaaatatatatttatgtattacattattatatattaaaatatgtaaagaatgacattgcttttatcttgactgcataattcttatcaatttcttgctctttccagtgatttccacatttttactttcctacctattgctattttctgtcaggtgttgataaattctggtgagtgacaggtaatatgaggggcaaatatgtttattcccctgttctttttctttaatcacgtttattgaggtataatttacatataataaaatggaccaattagacgagttatgacaaacgtatgccgtcatataaccatcatcaccacagtcatggtatataaaatatttctatcaccctaaaaagttcccttgtgctccttttagtaaaacctctctcgctattcctggtccctcacaaccacttatctgctatatcactgtaatcacttatagttttgccatttctagactttcttataaatggaaccatgtgttacgtagttaagtgtcatccacattgtcgtatgagttaatgtttttttttaattgcattatatgcatttatccattatatggatataccattcactaggtgctgaacatttggattgtttccagtttgggctgttatgaataaagcatttatgtacaagtctctgtgattatatactttcattt

SEQ ID NO: 122457 - DNA, 1016 bp, Homo sapiens
agacagagtctcactgtgtcgcccaggctagagtgctgtggtgcgatctcggctcactgcaacctccatctcctgggttcaagtgattctcgtgcttcagtctcccaagtagctgggattacaagcatgtgccaccacaccatacctgtctaatttttgtatgtttcatagagatggggtttcgccatgttggccaggctggtcttgaactcctgacttcaggtgatctgcccatctcagcccctcaaagtgctgagattacaggcatgagccacctcgcctggcccaattttaacatttccgagtttgtaatgtgtctcacagtatgtacatttaatacagtaattttccctcctgaaaagctggtattaaactgataggacatttataatcagtgacttcttagagaaaacgtgacattttaaaattcctctatgtgctttttttaaaaaaaatctaatgtgtcatggaatgggtttgcttcccaaataaacatttgtccttcatttttgccttgcatctgtaattgttttaaatttgtatattttgatgtgttgtttggcacatcccagcttcatgaccgataagtcttttatcacagtgcttttcaaattatttgtggtgaagaatcaggtttttttcccaatacttctttaaaatacattaaaaatgaattactagaaaaatgaaatgaaatgagaataacttgacaaaatagtaatataacctccatttttaaaaattattttatttaacaggtatagaatttccctctcagactgctgtaagagtttctaaatgctaagtttcgagctttgttcttgtcttgttgcatagctgtagcaaacagctagttcatagatggcatttgagtagcactgtagagatctttttagcaatataaaaagactaattcatttcttaaaatctttttgtcctgtgtcaaaattattattcctatttcctttcagtttgactatttctgcgatatattgtataaatcgtttttcatcact

SEQ ID NO: 122458 - DNA, 1037 bp, Homo sapiens
gtgtgtgtgtgtgtgtgtgtgtgtgtgtgtgtgagagatagtaaaccctggtactcttaacccattttttttttctgaagcaatattaatgtctcctctcaaattcatgctcctatttggactgaattaatgtatttgtgtttacaaggtgatagtaagattttaatatcaatctgatataaaatttttataagttcagtgtaattaaatagtatgtggatatattctcattgtgaaatttgaaaagcagaacaggtaagggaaaaatcttctttgaccacctattcccctctctacttggatcagcttttgttgtatgataaatctccccaaaacatagtgctgtgaaacaataggcatttgttagcctaattctgggctgggctcaattaagcaattctgctgcagcttatgtctggccttgcggatgtggctgcagtcagctgatgggtcagctgggagctggttggtctaggatagctatgtctggataatccgtactggttgtttgcttgggtgatgggggccatgtgtctcccgcaggctaggcgtggctctttcacctggaggcagtagtagggtttacagaagtaactagtgacagcaagcctcgtatattttctgttgtccataggccaaagcagatcaacatggccaattccagagttggtatgggaggggtttcctaactgagtggggctaattagggggccattactacaacaatctattatccaactgttgctggctaactcatttttcaggaaacatgcactaactagcgtggcattgctcctttcttgaagtagtgtttatgtaagcaatttattcaacagttcagataaatttagttaattcattgttcttgtttttattccatttttgtcatccttcagcattattcttagtttcattcaactcaacaaatatttattgagcacccattaagtgcacaataaggtatcaagaggtgagcagcagatagagcaagactactgtgttaatcatccaggtttgttttgttttgttttgttttt

SEQ ID NO: 122459 - DNA, 3343 bp, Homo sapiens
aggctaaggtgggaggattgcttcagcccaggagttcaagaccagcctgggcaacatggaaagacgctatctctacaaaaaaatacaaaagttagccaggcagggtggtacacgtttgtggttccagctacttgggaggctgaggcaggaggatcgcttgagcccaggaggtgaaggctgcagtgagccatgattgtatgactgcattccagcctgggtgacagagcaagtccctgtctcaaaaacaatcaaaacaactttgtttcatgtgtaacattatttaaaattatataaaattacattcaggtttggtcccatcctcaggatatctcatgtatgtgcaaatattctaaaatctgaaacacttctggtcccaagcatttcagataaggggtattcaacttgtatatgaaaatggatcccaccttcatttatgagtagggaaaagaagaattgtttaataaacagtgttgggatagccagttagtcatctggaaaaataatgttggcttccagaggagttaaagatttaaatatgaaacaaagaaacaaaaaaggtagggtaattattttttacgtaatccaggattggtgaagtcctttaatagcatactgggttgctggattttaggacataaaaataaaattctgtacaggggaaaaaatcaaacaaagttaaaagagaaacagactagtaaaacttatttgtatacttcacaaagggctaagttcctcttaatacaaagaactagaaaataatccagtagaaaaattagcaaagagaattcatatgaaaaaatgtacaactttatttataatataataaagatgtaaattcaagctacaacatactctttgtcacctatcaaatgagcaaaggttatgtatagtataactcgggaaaggtgagaagagaaaatggtcagccttatacattgctggtgggattataaagtattcatactctatagaaagcagtttgaaaatggttttcaaaaattaaaacacagatttatttcgttctagtaattccattataggattttattctctagaagattttgcatatatgtcaaataaatatctaagaatatttgtggcagcattatttgttactgcaaaagattggaaacatgctaaacatatcagtagggaagtagttaggtgaattatggtgtatatattcaacagaatactagtcagcctttaaaaataatgagagaatactatgtgtactgctgtggtgctatgtcaaagatatgaggaaaaaaagcaagaggcatgactgcatgtgcagtttgctgccattcgtgtggttaaaatatatatttttatatgctatatatgcctatgtattagaataaaattctttattataataaaatccatatgtgtgtgtgtgtgtgtgtgtgtgtgtgtgtgtgtatatataggcagctatagaatgtaatgtgcatgggaggatacgggagagtctgatgacagtaattgctccagtgtgtagaagtggttgcctagaggacaaagatggactaacttttaaagtatactgtttggtaatttttcagtattttaaaatcatgtgcatgtaatactattcaaagttaatatttttaagttatgttttgcttacaggaattggtaagaaggaaaaaataagagaccataatagttgttacaaacaaatgattactgcaatactgtttttaactttagttattgttagagatcttctaattcaaagttttcagttgatgttacatggctcacagaagggtagtcctagtagaatgggggctgaaggaaggcgttggggttcctgtgaacaaatagcatggtgagtgacaaccaacagttaaaagcagcatactgctccttttgatattttaagtgcattaaatgaggtgtgccttactacttggaatctacttcagcagccagccacagtgtacagctgccttttgtgggaaagggatcatggaattgttactggagtttgtattcacggtgccgaaggaacatgccacctaccacaaggtgcaacccacttacaatgagaggacaaggaagcagggagggtgtctctggtggcccagctccaggcctgactatctgtattcacctgtattggatgctgctcaccacgtgcgtttgatatgctctgcaaggtgactgcctaatagtgcatgtatgtttgtcagaaataaagcatgattttaattttgaaatattcttgatgtgaaaatgtttggttttgaaattcatattaaaattttcagcattacatgtgtcaaaaaatatctaccataacactttacattttttcttctgtaattagaaaatatgataattttttttcaccaggcactgtgtagatgcctccaaatgccctcctgttgtccagtgtgctaaatttttttttgctgacaagttttgtttgcaatgttaaaagggttgagaagcatcattctagtcaaatgtactcattttgtatgaagaaaactgaaatctacatagcaggctcagggatttgtccagtgtcctacagttggttggtgtgaggctggatttgaaaattggggatcttggatcttgactcttcagctctcatcacctcacactgaccccctctccccccgaaacatgagggaatattggaggaaggcattgatgataattgaaagacaaaaatacagaacctcagaggaattattaaaagaactgcacatatgtagttcagaaatctttgagaccctactgtatctaatagtgcttagaatcttcttatataataatattattaatattctataatctagaatagattatagtaggattcgttttatgatgacttgggctgtatctttaagaaaacaaaagattatagcaaaaggagtttagggcaaacataaataaaaattgatactaaaatcgtatgtatgctatttccaaaaaagggaggagggaatatatgagacctttcaagttcctctggtactataattacattttctctcatcttgcttttgattggattagaattcacgcaattaaagataatctagggccaggcacctataatcccagcactttgggaagcagaggcaggaagattgcctgagcccaggattttgagaccagtctgggcaacatggcaagaccccgtctctttaaaaaaaaaaaaaaatctaagtgaaaaatgattcaagtctaaataggttgggttaaagtaggttttagaggatgttgtcattggtgctggatatttcaaagaaatagtttgaacttacttataaagtaagaaatgggccatggtatgaggtatgtcactctggtatctggc

SEQ ID NO: 122460 - DNA, 1672 bp, Homo sapiens
aatatggattagtcatgttaaaggaatttttaaggaacttaaaatttcagatagaggaacagctacaaggtaattgacagatgaagacaactgctctttgcagggcagtttggcaatgtatattagaatccttgaagtgttcttttttgacccagtaattctagttttagggattttaatctatgagcataaatcttttggcaaatctggttgtcttttgaatccgtctacttcttttcataatccatcaccaccctaaactactagcatttttggtcaggtttactacagtagcctcctaatcttggtttatcccaatctactttgtccccttctgatctgtttcctacactgtaatcagagggatcttttaaaaatgcaaacctgattacatcaccctactgtttgatatgcttcagtagctttccattgcattcaggatatggacagaactctgtgtcttatatggtggcatctgcctgtcttacaaggtcttgcatagtctggcccttacctttctgtctagtcatgacttgagccatgttcttgacttactctttttgttccagccttgttggccttatctcagtcccttgttcttgccatgctccttcccacagtgagggctttgtacctgccgttgcccctgctgagaatgtttttacttttctttcacctaaacttcgatttatctttcctcagggaaggcttccctatcacagactctcagagcaccatgaactctcctcatagcacttgctgtcattgtaatttcatatgtgttggagattaacatctgtttttccaaatagattgtaacctccagaaatcctgataatgtgtttctttttcctcaccattatagagttaatgcttaccacagtgcttgaaactcgtctattaattcttggaactcatttgtggcaaggattaataaatagatgataatcatcacagagaacaactctaagtgttcaacaattggcaaatggttgcataaactgggtatattcatttgggaggatgtgtttaaaacatgttgtagaagtatgtgtaataacatgggaaagtgctgtcatattatgtgaaaaaattagtttacaaaatagtcacttattaaaagtgtggaaaaaaatacaccgaagtataaaagttggttatctctggaaggtatgttttatattttcagattttttacagataacatgtgctgattttataatttaaaaaaaccatgtacaaaattaaggaaaaattgattttctagatatggttccagaaatgtagtgggagacatgagattcgtaatggtctccaaaatatgtgtcaaccaaaatgcatgattgcatgatgatcatattgaacttaattatataaattccatttagaaattgcaaaatgattcataaattaaagcaagccagtaatttctggttgtattattcttacttgtatgtaaagtggttttaattttaaaatgttttgaaaagtaacatggttttggcacatgacagcactaaaacagagtaaagactagaattaacttaaatatatatgagagcttaatataggttgagcatcccttatctaaaactccataatctgaaatccttcaaaatctgaaatgttttgaacaccaacatgatgccacaagtagaaaattccacacctg

SEQ ID NO: 122461 - DNA, 1037 bp, Homo sapiens
aactatgttgaagaagggatgggaaggggagacagccgtgacagaaggtacgttctcaaaaactcctggggcttatgataatataaaaaagatagaggcccagtttactaggtgttttaaaatggttttgcttttttgcatgctttgaactgcttccatgaaataatggagttctaggaaataatgcatcttaggaaaggttgttcttccctctagctatgaattgccctatgggattttagatagcatttcccacttgatgctccttgccctcatcaccattcatcttattactacagtcagtttctgtggactaccaagataatagcgctttcccaaacacaagcactcattttaaagcagttatcttttaatgtgaattctctttgttaaaatgtcaatgttgtgagatttggtagcatattcctatttaaactagtgaatatgattttgatatgaaccttgaaagatggggaatttgagtgcttttaacgtgttgaaagtgtaacacttgaaactttggaggctgggaaatcgaggcgatgaagtgttctataagataggttttctgcccttttaaatatagtggtgctgtctttgtttccaattggaatttcagtgtaatgcactgttctcacttcagatgcagaggaaggataaaatagtgaagttgatatggccctgttcagccaaatttccgaatcataaagtgacatgctaataggatatactgtggcatttctgtgtattacagcttgtatggtttgagttacttttccacacataattttttctcctccacacaagtcattaaatatgttttcctgagagatagtcaagctttgttgtataggaaagtttcgtttgtggaaataaatgagtttcactgtaagctaatgtaattctattacgtgaggaaatgttccttaaaaaataaagaatattatatactgttgttttcctgaatattttttaaaagacacattaactatttcctatttaatccttcatggacatcccacaatagattaccagca

SEQ ID NO: 122462 - DNA, 1039 bp, Homo sapiens
cataaaagcaccaccgtggggaagggccgttttgaataaacaactttattcaaaaatcgagagggggtgaagcgatgcagttagggaatttttgttttaaagagtagtaacatgcagctggcttggctattaaattggaaacaaggggttcctctctgacttggccactgatattgggcgtgaccttggacaaataattttgtttctttgggctcagtttctacatatgtaaaacgggaaggtttctcttaaaaactaatcctgaagggtttcttctcaacaaaaagatgcaagctgtaggaggcagaaagcgtgggttcaagttcgaaatttgcccctgaattaggacccttgacacatttctaacccatccaagtagagatcgttcttttacatttgtgtgttatacaggtgcattttagtggttaccaggttgccacgtatttgaagtggtgtgagagctactcgtttggaaccgttgtggattttcaaataggaaaatcaaaaggcccaaagagacagctcactggtaagaagctgtctataaattccctaacatataaatgctataataagaacttacgctccgagggatttgagactgattactacagtaaattagcttgtagtttttaacctcagagcatgattataaacatacgtggcaagatttctactaatatgctggaaattagctaatatttttaagaggcaaaatctcttgatctgaaattttagaaggctatagaagtgattttaaaatatgactaccatgctaaaatgtattttttataaaataaatattttgtacacgccgaatgtcagatacacaatatcagtgattctcagtgttccatgacacctagaattctttaagtgttgatattttggctcttactgaattatattttgggggatggggcctgggaatctgtattgttagcaacactacttgccaccccgtgattcttaagcaaaataaaattgagaatccttgtactatattataatcagtgtatccataacttttaaattataa

SEQ ID NO: 122463 - DNA, 1783 bp, Homo sapiens
tttgtagcattggccaattcggtttgctttctttttgaggaacagggtctcacgatgttgcccaggctggtcttgaactgctaggctcctcccacctcaacctgccaactagttgggactacatggtacaaatgtgtcctctaccagagtgacttcagtaaatgtggagttagttggaaaggatgctgacaatcagaagttggcttcagtatatgacctagtttccagcaatcagatgtacccattcaggacatggatgtgagagcgagcaacatgatgcttcaactgcactcagggagataagtatcttctgacaaataccatgaaggaggtatctggttcctctgggtaggtagggaggagttgtggcatctgttctagagtcataggtgctgactggcaggcattgctgggatgggtttccactagaatagctttgtgatgtgggatgggtgttctttgtggtttggtttttcttggatgttgtttctagcttggtttatccaagtctggttctctggccctctgagagatctgtgaactaaatagtatcttttaatccctttttgcttcaaccagcccagtcacagccagctacataatttgtggagcccagagcaaaatgaaaacgtaaggcctcttgttccaacacaggggaaaatgtgctattatctgtattaaaatataaagctttttctttgttctgtcgtcgctctctccacttgtcatagtgtttttaaatttgctttttaatgtcattctatgagaagaaaaattaaattttttaattcttaggatgaattttaccattcatctttatattgtgtaatgccgttttaaaatgcaaatataagagcatttcaattgtatgtggaatcaccaaaattatacaattcatagcttgtaaatgcatatgtattttgtgctatcagagcagtgtaaactctgcacaaaacaaaactatttttgttttccttcttgatatgcacacattctaccaacattctccatcttctgcttactgatgagtaaggaaggatgaaaggaaagggagtgctgagttgccctactttccctttcattctttgtcatcattttttgtgtaaatggttggctaatagtggtaagtaacacatgagtaaggaaggatgtgatgtaatcacttgtgtttcttaaagatgctgttgccttctttctgcacctgaagcaagttcggatttgaatgaaaagtgtagcctcttggaactgtctatgcctccactaactcagtcatagatgttacatgcttgttttgtattaactttgttactctcttgagttcctgcacctcataggtccaccagaatcctttgtcatgaggcatcatggagaccatatgcaaatagaacggcaaggaagaaaggatacatacctctgcttgcatattatgctctgctataccactggacttacaaaacagatagtcaaacataaaagtattacaattttcaagacagtgactacagagcattaaaccaagcactgggccctgtgtgactatacttgtcgcatgttcatgaagttgatggctctgagcgcttgggtttctcaaatggggcttctggcatttttggtgaaacagtttttcattgtgcaggacatttaacatccctggcccccatgcactacatgccactgtaacaataaaaaattccccatgtatttctaaatgtccccaaagaggagttgctgctctccactaaactcctagagtgacctccactgtgtacagctatgaaccatg

SEQ ID NO: 122464 - DNA, 1042 bp, Homo sapiens
atggtggcttacatctgtaatctcagcactttgggaggctgaggtgggagaatcccttgaagccaggagtttgagaccagcctggacaacatagtgagactctatctccataaataataataaaaaaactagccaggtgtggtggtgtgcacctgtggtcccagctactggggaggctgaggtggaaggattgcttgagcccaggagatcaaggctgcagtgagccatgatcacaccgctgcactccagcctgggaaacagagtgagatcgtgtcaaaaaaaaatttttttttaatttttacaatttattcagaggactattgcacctgtacagaagaacttaaagtgaattttgctgtctttttcatgaggacattagtctttgccacaatgcttactactaatgagtacaagaaaacgctgtgtgggacagagttgctcgatccaacctcacagattgacaggcaaacaaatgttttatagggcaaggtagctgttggaattaaactttttaggatttttgataacagaatatgtacttctcataattagggttttttaaacatttttaaggatttttaaacttttataaaatctcagaattttctagtctgtgaacagttcatgtagaaaaatcagtggttattatgtacactgttattgcagcttcgctgaaagattaaaaatctaaaaaatacagtaaaaataagttctgagtttttgtattgatgttgggtgctgtgatgttatctcttttaaaatgtgtttttctttttccataatataaaggaatcaaaaaatacaacttgtatgtgaacttgtgcaaatgtgtgaaacaaattaaggtgacagggcagaagcaacaaaatgaagctcaaatgaaatccacctctcaaagcaggttctatttaatttctctatatttgctattataaattttttattttcatatatgtgtttctttgctagagatgataattggatgccaacctaacttccaatttttaggtgattattttaccaacaaaccactcaccttgat

SEQ ID NO: 122465 - DNA, 1099 bp, Homo sapiens
ttttagtatttaagtatgtctcatgcaatatttggctcggtacatttggtattttttgttatcttaaatactatttacgtgtttctatatttgggacataactttaaactaaaatttttctttattattgtaaattcaaatttaactaggcatcctgtattttatatggcaaccctacttcggatgaattttaaataaatccatggtaaagtaatctataaagggatagatgggtatattcagggatttagtcctagaaaaagttcggaaccgctgctatagatgctgtgtagtgtcagtgaaaggattgctgagcagtagtgaactcacttaaaaagaagcagcatgacttttcttgattgaatcactgctaagaagagtaatagcagagattgctggtacaagggaccactttggtttggctctagctggtgaggactgagcaggagatttgggcataattgaaatgactagagtccaggctgtaaatgaaagcaggtgaaaccagaagatgaattagaagggactgagagtttggcagtcacaatgagtcaaagaggtagaagttcacagggaagaaactcagaatttacaatcttggaggaatggttctgtatgataacggggttaaaaatccaatttcacatttacttttactaaattaaaagtaagagctctggagacaagatacttggttttgaattctggttgtgtgatcttggccaagtaatttaacttccctgtgtcttcgctctttatttgaaaaatagtaataatgatggttcttggggccgggcacagtggctcatgtctgtaatcccagcactttgggaggctgaggcaggtggatcacttgaggtcaggaggtcgagactagcctggcgaacatggtgaaaccccgtctccactaaaaatacaaaatttagccaggcatggtggcatgcgcctgtaatcccaggtagttgggaggctgaggcaggagaatcgcttgaacctgggaggcagaggttgcagtgagccaagatcacgccattgcactcgagcccgggcgactgagcgagactgtgtctcaaaaaaaaaaaaaaaaaaattggttctt

SEQ ID NO: 122466 - DNA, 1092 bp, Homo sapiens
tattctcctgctctcctcatccaccgcttcataccttctcatcctcaagccacaagtactttttctcctatcttcctttgcagtgttacttactatttccctgagaaatagaagtaatcagaggacttccacagaccacctccccccaccaccatatagagtcacctacttgtaactgtgccttgtattctctgtcttccatctgttcttatgaatgaaatgttccgagctgtatccttgcaacttgtgcactagatcccattccttcccctactcaaagagtgattcagcaactttctcctctcccctgcagcatcactcccaccctctctattgggtcattcccacaaccagcttggtggaagcaacaatcagcccgctcccggattcttgcagtagcctcctacctggtctccttttagcccctgctccctttcactttattttcatcgcaatagccagaatgattccattaaaatccactcttgctcagaaccctccagaggcttctcattcactaagtataaaagttaaaatctctaaagaaaaaaaaaaaaatccaaccctacttggtcttccctgccctctacctcttcttacttctctaacctaatatcttactcctctccctcagctctttctgcaccagccacactgattttatttttcctagaacaccctggctagaacttccatctagccccagattttctagtttcctagaacccccactgcttgccctagattttcatctagcttgttccctttcccttttttgacctttcatctttcatatcatcagtgaggcctttcctgcccactcattagaagtataactgcccccacctcccctactctatttttctcagttacacttgtctccatgttgtgaaataccatatatttttacttgttaattgttgtctatagtctgtcacccccctcaaccctaccccaggtaaggtgcttgagtggttgggatttttttttcctttttactcccctcccatattactggtgtattcctagaacatagtaggtacttaccaatatttgttgaaagaatgaatctataatagagtataattggaa

SEQ ID NO: 122467 - DNA, 1046 bp, Homo sapiens
ccatggcacttagggaagagccagctcattttagactggtccttttaatgttgtttgattttgtacacttggaaaatgggcttgcattctttttctctttttgaaaaagctattatgttgttttaaaacatacatattttaggctttaggtaatattcaaattctaatttaaaacaaagtattacttaatatatttgattgataacacattacatgcaccatgcatggaaagcaagtaaaaacaaattgtatgttttattgtactatatgggcaacagggtagcctgccttacaaaacaatataaatcatcttttaccactgctctccaaaaataatttggagtttacacaatccaaattgcacctgccagaactgccagcaatatcttcaattttcactgactatactttcctttcactccctccatatatttagacaaatggaacagatatttcagccacacagtttacacaataaaaaacaaaggttgaaataaaggaaaggaatgtattaaattaactttgggcatgtgagtgtatagatgctagcatccatagcatataaatacacaggtgaaatatacctaaaataaggtggtttgtgtgtatcagactgaatatgcaggtgtggtgtacacagatgtgtacatgccaaactgccgattttctcacgtaagtatagcagtttcaatacctagcagtgaatgttaatgtattttgagaaaaagaatttgtctccttaaatattacaatatacaataagcatgtatttgttataaatataaaaataatgtgcttgaaatgctaattaattagattggagagtacatactttgtgaggaatagataaaaaactagaacaattagacctcagcctgggcaactgtgaaaatataaactcacagaagctctgagctggaaggatttgatcagggcctctacaatctaaatcttattaaaggcatgaattgtctttgcaacatcccagtaaagtggtcattctgcacttgttatacttttggtgtagggatactcagtgcttacca

SEQ ID NO: 122468 - DNA, 1103 bp, Homo sapiens
tatgatttctagggtctctttctagactgaaagttccataacagaaataaatgatctgagaatttaattgattttcgtgctttctttcttcctttccccccgacctttggttgttgttgtttatttggttagtaggctaaaatagaactatttttcttgaaaaatagtgcataattctctgggatgagaggcatttcttctctgtggtattttcccacagtgtaaccttccttctcttttcatttgccactaggaggtgggtctcactgattcttcctggttcattaagaagaaacagaaagatcttgtgttttcagagactctttctggatcatttcccatgatcataggactttgcaatccatttggcaaaggtggtggtgacaatggggtgtttggcaaagtggatgaggtagttgacgaagcagctggggtaaagaaaaatgctcttggcaaaacatcatgaaactagggtggaatgttcaaaatggagaacttgcatcccttgctgagatgactccgagaaaaattctgtctttaaagaggtgatttatttaacaggaaacaaagaaaaaggtatcaacagtaataatttttctgagcactgagctgagaaatagctagtctaatactttgattgtagccatgtactgagacctctttgaacaatctagaagttaaaatagatttgaaaccagtcactaaaatttaaaattacatttaaaattctaaattagtcatcaaatattaggtaagaacctaaccttgcattccacaaacccacccctcaaatcggtgtaagtctgaataaagcctttgggctaagaggttatttttactaagtcagccctaccccacttccaccccaaaaatatctaaagatgaatgcctgaggaccagcataacatctaaatcaaccgagtgttaatcttattgtcagtgctctcaaatagttgttacaattcctttgatgggccgggcgtggtggctcatgcctgtaatcccagcaatttgggaggccgaggcggatggatcacgaggtcaggagatcaagaccatcctggctaacacggtgaaaccccgtctctactaaaaatacaaaa

SEQ ID NO: 122469 - DNA, 1050 bp, Homo sapiens
caaaggcacagagacaaaagaacacagcatgtgtgagggcatgctgaaatggtccagggtgaccagagcacacagcatctacagagggtgatgagagaaaactacgcaaggggacacagtcctcttctgagaggcctcatagatcgtgctaagaaaggtggatatgatcttgtagtcaatgggaaaacggcacaaaatttgtaagctaccaagaaacagatcagacctacattttggatgttcctctttgatggcagaggagaggatggctagcacaaggtcaaagtggagatgagaccagtaaggagactcatcagtaagtgacagcagtgagaccctgggcaaaggcagcgcagggaggatagaaaggtgtgccatcgcacaggctgtgcaccatacagcctgaggtgtcccgttcccataaactggagcctccctcatccagggcaggggtctcagtgcagtcttgacatctgaggatccctccagggtgaaacagggcctgagtttagggtgctgtggtctgattctcaacatgtttactccaccactgccttccctttgccaagcatggaatgtggcctcaggtggttttgcccccattctccaaacttgctggcagacccttctggtgtgaaaagcctcatatgaatcacggcaaagttcactcaggtaactatagatttaattcctgtaatcattagctttgagagctgaactatgtgcaatgaaatgcctccctggaacagccagcaaaaaccatacacatcttgacttttatgtacaagagataagaagtatgacatgaaccttctctttttctttcttgagttaaaacagaaactacatctttgtgtgcaacggttctttgaacaattaggacagcagtgatcctatcagatagctttaaaaccctcctgattcatactgctgaactgagtggtacaacttgttgatctttctggtaacattgttatctctaaggattgataaagaattgatggcagacatggtggttcatatctgtaatcccagcactttgggaggctg

SEQ ID NO: 122470 - DNA, 1685 bp, Homo sapiens
cctttttaaatctcagaatccttggtcaacaaacaagcctgagaagtacagaccagctctggctgaggtaggggtgggaggcgcagacccagcccctcctccagcacatatgggcacccactgggaactccacaggacagcctgaaagtcacaagtgtagcaccgcctcctagtcaagcagaaactgtctcacagcgtctctataatcacggggagaaggaggattcgtagcccataaaacagccagttccaacgctgggtgattgtttcggtcagaatgttctagttttatcccatgctggacaagtttaatatcctaaatgtctcccacttatttgaatataaccaggccccatagttccccacctgtcatgagctaagaacactcccttcccttgtttgagcatctgatatgcaccagatattttgaaaacattatttcatttcatcttcacgacaatcctgtaagtattagtgacccattttgtgaatagggacattgaggcacaaagagtttaagcagtggggccacggtcacacagcctgtacatgaggaagccaactttaaccaggcccacatgatgcaacagcaggtgtccctttcactacgccacctgcctttctgaaaaggtagggcacagaacatgatacagctgcaggggccagccctcctcaccaccccgtctcctgcctcctaggacttcatagttgctggtaaacagccaagccagcagagcacgtctttccagaatcttggatcctagagatgacagattgctctccccttgcaactgataggaacaactgagtcccagaggtgcagggacttgcccacagtccctaaggtagatggagccagaaccaacagctcctctcctgacatggcaagcctggagctcttcacccagcatcatgctgccttcagctggtctctggggaagaatgggacttccctggacaaggtatccatccccaggggacagtgaggtgttgtgatcccctccccactcaccattcgatgaatgtacttagtatgtaagccatgctcatcctcgtccagctgcgactcagcgccttccacgtcctgtttgtatttggggctgattgctacgattatcatcacggtcttctgttaatgagagggagaaaggcatgtttatggaagtgtaccagcaggactgtgggcattctctgacacacggggtggagggccaggctcattctccatagaaagagaagcactggcccccactcaggcagactcttatctctgcttctcccttctgtctccagcccagccccaccttgaacatgcagagcaaatggctcagagaggggctctctcaaatagatgtgcttttgcctaccattttccacaaccatcactaataaacctctaatgaaagcccgaatcactgagtgagtctgtgtcgtggcaaaaaggcactgcaacaccaacagtaagaagcaccctccctccctccagctggttctgagctgccagtcactgcactcgactgccctgtcttctgcgtgtacacattagcacagtcagtaggaacagacccttcagcacaaagcaaacatcaggctgcagacaaaaggaaaagtgcaacaccccagcctgctgagactcccgtcccccactggctccctccaaaagaagcagccgacacggacacgct

SEQ ID NO: 122471 - DNA, 1381 bp, Homo sapiens
cctgcagagctgagaccacaggttccccagcctccgtccccagctgctgtgcctagaccccctagcaaccctccagccagaggaactctaaaaacaagcaatttgccagaagaattgcgtaagttgtttgcaacattgttctctccttcctctttttttttttttttttttttgagacggagtctcgctctgttgcccaggctggagtgcagtggtgcgatctcagctcactgcaagctccgcctcccaggttcaccccattctcctgcctcagcctcccgagtagctgggactacaggtgcccactaccacacccagctaattttttgtatttttagtagagacggggtttccccatgttggccaggatggtctcgatctcttcacctcgtgatccacctgcctcggcctcccacagtgctgggattacagatgtgagccaccgcacccggccactccttcttcttgtgaggtcttatactttgtgatggctggatgatcactcgtccctaatctcgaagattttccttttttttaagacagggtctcactcctgttgcctaggcgggagtgcggtggtgtgatcatggctaactgcagcctcaacctcctggggtcaggtgattctcccacctcagcctcccaaatagctggggttacaggtgcataccaccacaaccagctaatttgcttatacttttactagagacggggttttgccatgttgcccaggctggtctcaaactgctggattcgagtgatccacccgccttggcctcccaaagtgctaggattacaggcgtgagccactgtacctggcctcataacctcagctatttctcatgtacacagtaaaataaaatgcacttttttgctttttgcttaaaaagtaaccagcattttgtatgaatgtttttagtgattctgacaccactagtaacactcaaaaactgcttacctctagatttccttaagcacatactccaaaaacaaataaccccagtgccttttccctcttctaaatgatgctcttgagtggacttgtccctgggtaaattgattggatgtccatgtggtattgggcagggacccagcatctcaccataagttagcagcagccatcaagaatgaggtcatttcctgtaggaatgagcaatcttgtttggaaaaaacggtctcacattctccatactgcatcacaaccaaatgcaaactaagccttttatttaaagaaacattcaactaagcgtaaggtgatgattctttttccacattttgctgccagaaccagaaatgttgaaatatcaccaaaatgttctcatattaaggtcagtcaggacagtaatttccagaaatcttaagaaaacagccactacttgtg

SEQ ID NO: 122472 - DNA, 1188 bp, Homo sapiens
atcgagaccatcctggccaacatggggaaaccccgtctctactaaaaatacaaaaaattagctgggtgtggtagtgggcacctgtagtcccagctactcgggaggctgaggcaggagaatggggtgaacctgggaggcggagcttgcagtgagctgagatcgcaccactgcactccagcctgggcaacagagcgagactccgtctcaaaaaaaaaaaaaaaaaaaaagaggaaggagagaacaatgttgcaaacaacttacgcaattcttctggcaaattgcttgtttttagagttcctctggctggagggttgctagggggtctaggcacagcagctggggacggaggctggggaacctgtggtctcagctctgcagggcactccaaggactccccaggagcaccagctctattaggtggctggtgatgtggctggtccctagaaaggaatacatttacagtcaattttcattctttacaaaggcaaaccttcagggacagaaagacttttagaactatgggaagatcccagtgggctctctctcctctgcctctatttcttaactgagacagaaggaagaggggagctccatggagttgtagtcaataagcgtttcagctggctgccacatgtgagggcctgtgctctgactccaaagagggaagcaggatttgatttctctattcaagatttgtttaattggaaaaacaagtctcatgcacagggcagacaaggtcaccaacaaaacaaagtagtatgacaggtgacacagatggttgatgttataggcattcagataaaaagacatgacttttagctcataataggtaacatttaattatgtatcaaaaggtaaagagggccatgtagatttagaagtatttgtactgttgacatataaatggaaatctgattttgaagaccctttaaagaagttgctaccatattagatagcatctttattattttcgttgccagtattcccacgagcattctgctgagatgaacaatcagatgacctcgtgtgagatttggaggagagaaggaaatggagagcatgcgtctgccgcttctgtggtttctgtcggtaagcacagtgatgaggtgctgagttttccccagaaggcctcccagtgtcctattaccagcttcacaagcgtcgagggcagggcatgggcatctattg

SEQ ID NO: 122473 - DNA, 1043 bp, Homo sapiens
atgagtgttcccttttgtaagtggaatctgaccagctttgtctggaatttgactggttgtatggaaaaggttcctaaataggctggacacgcctgtaatcctagcactttgggaggcctaggtgggtggatctcttgagcccaggagtttaagaccagcctgagcaacaaggtgaaatcccatctctacaaaaaaataccaaaaaaaaaaaagaaacaagaaaagttgctaaataaaaactatgtttatcaagtaaatgaccatcatttcactgctaaagttttaatcatttttttccaattactatgacgaaggcttgccaatttacttgggtactatacatgtaaaataatggctaacatttattgatcacttgctacatgtcaagtactgttctaagttccatattgagaattatagagttcaattttccattttcataaagaagtttaactcagaataaaaatccagattcctcaccatggcccatccagccttcatcttctagcacaccattctctccttgctcactctgctaggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggccaaaaaaaaaaaaatggcttttccaaggcttcacattacaaagactctactcatgattaaggctcactcctttccccaggaagtagagaacagatttctttttattcattcaacaaatatttattgaacctcgatggccaggcacttggtgaac

SEQ ID NO: 122474 - DNA, 1088 bp, Homo sapiens
gctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatgtaagtgatctttacctcctctgggcattctgggctgggtgactgaagaaacaagggcctcacatcaatgcttcgtgtcactaggctggcatgaacaggtcagaatgcagggagggcattctgcttctcttaggggctttccatgtgtggctggatttgcaaagggcctgcagagaatgctttttcttagcctaaagcctgtcccacttggagtctccttctctagggacctttaaggacaaaatgggttcctctgtctgggttagtttaacaaacctgcctagaagcagagagatgaccaaaatgatttctagaaaatgtattttttgttctaatctttgggcatatgggttcttccttctcgtcatctttcttccccatcttagacttggcagagaaagggcttttagtcaaaaacaaagcaaaacaaaacaaaaaaccagaaggtgcccagaatgtcattgagactctgggattcgggccattacatgaaaatgaagttgtttctgtgattttgctgcttaaatccttttggacacttgagccatccacagctaccctacattccagccactctaagactggca

SEQ ID NO: 122475 - DNA, 1070 bp, Homo sapiens
taatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagat

SEQ ID NO: 122476 - DNA, 1024 bp, Homo sapiens
cttctcatacccagcactacatacaaattacaagtaaataagtgtctctcctacaccaataaaaggcaaatacaaaaaaatccttcagcgtttccccactttccttacttctcttccgttctccttccttcctttctctcccttcctcttcctctcttggtttttcctttctaccccttcctctccttcactccgtggctgtggctgaattagggatcacacatgtgcttagagaaaccatcttatctgaagaaacaaaaaaacaaaaaccaaaacaatgacaacgacagaaaaaaaaaaaaaacatgggctggtttgaggttgttctctaaatgtttattataacttctaatgtgatggagtcagtgtgttcccattagtccttctcctcctcatttagtagctcagaggagtcccagagcaaacttcctcaaatcaggtcggttcatactgcactgccttcagcctgatgtgagtcttactgtgctgggtttatgtccaagggccagtaaatattcccttccttccagggctcaccactgtttcaaatcctctggcaagcccagtggaagaacttctctgtatgggaaattcagcaagtaaacttggaagtatttgttcattggagtttgaatctgagccaaacagttcactcaaaaccaaccttccactcagcaaaccagtgttatgaaagtttgcatgcatttgggcaggaaacaaaggacattaatgagtttaaagatttttttttaaatccatgacttttggacatttattaaaaagattactctctggggaatgaagtaaggccttgggaatcttgtaattgaaagtttctgatccgaagtagatctcaggatcctcccagctgtaaatttatagatttctttttaatgtccacctgaaatattcatgctgtgtgtctctaggacgcttcaaacctattcctgactcaaagaaagcttaagaaaaaatccaagcagttgtgatcaccaaggcctgattatggaggagctgttaatat

SEQ ID NO: 122477 - DNA, 1054 bp, Homo sapiens
gatcaagaccatcccggccaacatagtgaaaccctgcctctactaaaaatacaaaaattatccgggcgtagtggcatgcgcctgtaatcccagctacttgggaggctgaggcaggagaatcacttgaatccaggaggcagaagttgcaatgagccaagatcgcgccactgcactccagtctggcgacagagcgagactctctctcaaaaaaaaaaaaaaaaaaaaaaaaaaaatcaaataaacctatcggagaagaccatttgcaaagttcagacattgtaaactgcgactaaaggatttctgttcactccattctctgtagctcctgatctcctctgatgatcagttcacgggctgggaggattagaaagcctaggagacagagggtcccatgctttagaacatcagggtagataaagacaaatgatgcatttggctctgccgtagtcgtgacacagaaagatgtatggggaaccaggcatttccgtgagaaaagttaagagtgtatataatccctcaaacacagccacactgttgaagatttccttacaagcaccagaaggtgtttacctgctttgagaaagataggaatcctcctgtggctaagtgttggcaccagaggattttatagtagcattagtgtggcaaaatgttatctgcaatttccccgggagtcttaagaatgtttactatattaattggaatggttctttcatgaatcttgaaagagtatggttttcaacaacaggcagaagagaattgtactaaagcccacagcaaaagggatgtcatctgttcattagtcatgactcaggacaaagaatgtcacatgataggcatttcctaataagttgcattggaataaaatgatctttggtcagtttgttcctgaaaggtattttaataggtttaaatgacttttgttgaccttcttaccactatatattatacaatactgttggaattcaattatgctatcaaaaatatttgttagaagggagggaggagactggttttggtttgggggcaggggaaggaagcttaaacacatttt

SEQ ID NO: 122478 - DNA, 1287 bp, Homo sapiens
tgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaattttttttttgtttatttgtttaaatcatggaaggtactcgtagttctgtggcacatctgtcccacaccagatggtatggaatcacctggtgaatttagcctttgtgcgatgacttgcaaatgacagaaacattcagaacatctggagagttcttttccctctagaaagggtaggctcttgaccagctatttcagaggatcattaaagcaaaagtaggcataccttaccatctgaatttatcagacattttttctaaccggaatttactgtgtcctgcttgtaggagaaatagacaatcacaagaagaatctttcttgtcctggagtcagtatatttatttccaaatgtccccctacttctgtaatgaaggagctaacggagcgacaacctggtgtggtaggaagggcagtgggtggacgcaggctacctgtccacgcctggctctgtgatcattcagct

SEQ ID NO: 122479 - DNA, 1018 bp, Homo sapiens
tttgttgacccgttgaccctgacagaacattcccatcccacttggagttccctctggccccttggcagggattcctcccctcccccaggcagccactgatctgctttctatagatgtagttgcgccttttctagaatttcgcatgaatgaaatcataccgtatgttgcctgttgtgtctggcttccttcacttatcatgttttgagagtcattctgaatttttcatgtctcagttctgcactccttctttactcctgagtagcatggcagggtttgactcctggggggatgggagtactccgcatgttttagccacatgcagacgcaaagaagaagaaaggggatctgcaagtgcggcggtcagggcctggatccccggggtgcccactctcactgcgcttgtctttgcaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttcc

SEQ ID NO: 122480 - DNA, 1101 bp, Homo sapiens
tgtaagtagcagctggtctaaatgcttcagtccccctccagttcatagaatctctcctctctcagtaggagtatgtgtctgtggttcccagagcagaaatgtcactggcagtgcctctgcccaaatggagtttgcagacatgtctgggaaagagaaggagaaaagccccactgctttttgattacactgtagcactgacccatggagtgagcctggcaggaaggtgccaggacctgttctctccacaggacccagctccagatggccaaagagagcagaggcacatgtgaaatgcaatttagagccactcactgcctgttgctgaacagtcaaaacatgctataccaaagcaagtataatgtaaagaaattggaaattcttagactctggaatgtttctgtattatcagatttatgctctccaaagaaaccacgagtttggcttatccatgcttaaattgattaacgtcgacagatggtgacataaaggacacccatgccatttcacctccacgctttagtggttatagcacagggacgatctgcttttttgaaatgttaaggacatatttttcagttactgctgagtgaagaaagaacatagctccccctcattccctgcgtaagaaaggagcttaaagaaaaaaaaaaaaaaaaaaacaatgatagaaacgatagtgacgattaatgaggaatttaggtctcttgcaaatcctgggtttgtaatcatagctttgcagtcagaggagctagcgaaggcagattaatttgtaatccctttgttccttttttatgattgtttctggtcatcttcagagaacacagagaggggcacatcaagataatctcgttctgggttggtgtagccttgagactcctaggagagccaagttgacatggaggcaaaattgacaaattcccagtctctgaagtgccggcactgggcgtttagagatgcgggtgtaagtcagttttattgatgctgcggtgactgctgctcccggcatgcacacacgggcagacactccgggaatcgccaaccagcacagaagaaagggccgccctgggggatggagcacagcgtgggtgtttctgaattgct

SEQ ID NO: 122481 - DNA, 1047 bp, Homo sapiens
tgtttaaccagccttaggcaagttgctatgaagaaatatgtgtctccaacctcaaaggatttgcattctatttaaggagattttttaaataacttatgaaagaactagtaaaaggacacagaggagacatggacacagtggaacagtgtatagtgtttatgcagtcaggctctggcaccttcggttcaaatcccagttctgtcatctacacttgtcctttgtttggcacattgctttcctctcggtgttccgttttctcatctgtagaacaagactattgctggcatccacctcatgtgcccagtgctttgcatgcctgactcttagcaagcgctcagtgtatgtttagctattgtggtagctgctattatcaagcattaaactgttgtttctagcactggcgctaggtgcattggagagattagtgaaggctggagtaatcacagatggcttcatgaaggaggtgggactggagctgaggaggctgtagctaagcaggtgaagagaaagagagcatttccaaagccaatgtaaaagaaacaagtgtgagcatgctaagtgcaggacacaggttatagtaaagcaaactgaactagattaactgtgtttggggtagcaagaaccaagttaggtcaggcacggtggctcacatctgtagtcccagcactttgggagaccaaggcaggaggaccacttgagcccaggaattcgagactagcctgggcaacatagcaagatcccatctctacaaaacataaaattaaactaggtgcagtggctcatgcctgtaattgcagcactttgggaggccgaggtgggtggatcacctgaggtcaggagttcaagagcagcctgaccaatatggtgaaacaccgcctctactaaaaatacaaaaattagccaggcatggtggcgtgcaccaatagtcccagctactcaggaggctgagacaggagaattgcttgtacccatgaggtggaggttgcagtaagtcaagattgcaccactgcactccagcctgggcaacagagtgagactgtctcaaaa

SEQ ID NO: 122482 - DNA, 1035 bp, Homo sapiens
tcaaggccaggccctgagcctgtgaggtggtcttccactgacagcactctagaagcaactagaaatttggggcgattgcttattctctattccctggacatctcactcaattacagcagatagttcgtctttagttacaaacactttgctaaattctgcccaatcagagtctctaaataatgccaacatcagttatttgagtgccttatctatgaaaggactttactaggagctactgatatcaagaagcctaagactgcacgacagtcagcaagcatgaggaggaagacgtgggggattgttgaagtcagatggaactggttttgaaatccagcgctaccacctgatgttctggggtcttaggcaagttatttaacttttgcctacctcagtttacttatctgtaaaatggaaagacattttgtctgctgtatgcatttttgcaaagattaagtgaaacaatgcatgtaaagtgtttaacagggtacccagcacatagtgataaatgttgcttgttactgttggtatatctggtacaatactaagttcttggggaataaacaaatgagtgaatggattgtagatacatggaaagtctcaaacactattcaggaaagggagagaagaatcaaagataattcccaagtagtcagatgcaggtgattgtgagaatggcattaccaataacagaaatgagtacttgggaagatcttactttcagagaaagaggatgcatttgggtttggatctgttgagcttgaggtggtggtcttggtcctccaagcccagaaagatgagtcggggtgccctcactgggtctcactgccacagctgggccctcagccttccagccctcccctgagttctggtcacagccacctccctaccccaccactgcaccttcttcccagaatcattccagaactcaccacaggcaccacaaggatctgctgtccatcttcttgtccataccacacctgtctcctgtgacccccgacataggcaatgtcacaagccttgcttctggaaattcac

SEQ ID NO: 122483 - DNA, 1267 bp, Homo sapiens
gagattgagtcccatttcttctagttttatcaaatatatgttgttattcctagaaatggaattaatgctgtttgtttttaaaaggtaactgttacttctccatgcctatacttttttctaccctgcttttttatataaacctttttgtccccccatgtggatggcattattccatttgactaccttattacttttaataagaaaaccaaatacagctctctgttgggaattatctttcaaagtaaattgaaatgattttatgttttgttcataggaagtttactggatttcttaaaagatggagaaggaagagctctgaaattaccaaatcttgtggacatggcagcacaggtaggccctgcagggtaacttgatgtgccatagatttaatgacgtgtctaagtacattgggtcgtggtgtaacatgtcctgttccctgggtttccacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgggcacttgaatgacaatggctcgtgatcacagctgtgagaacagtcacttactgcacagcccttccttcctccttcccttcccttccttcagaaaatacttgaaatgtcattcttcagcttggtttggacaccttgatctggcaggaatttgacagctctgcaggtgggagactgttgtgggcccagtggagggatgagatattggtttttggtgggtgggtgggtattggtatttgctgctgtggtcctcttggctcatgctggtctcctcacagcgtccaggcctagaatactctgtttttggagaaagagaccacatttattctcacattctcacatgcctgtgttttttacaaaggcacaggcagggtttcagaaagccaacagggcatggtgcagtgtctcagagcttgtaacagcaacagaactaaggcctcaaaggtaagggggcagagaagtgggcacaagaagtcagaatgggccactgcacagagagggcctcctcagtaaagagagacgtcagggatggatctggggattcacacccaaccccactctagcccacttctgggtcttctgccagacccaaccagaagtagaggtcacaggagctcagcgatgaatccttatgggtccagagcagggagagggagagtgga

SEQ ID NO: 122484 - DNA, 1731 bp, Homo sapiens
tttggttttaacattctggaattcctaaaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtaaggcagagggcacattttgttttggctgcatctcaaagccgattaaaaggatggttttgaacaaaaatgcacacacagccgttgggacaaagacacttaacctggataactagacgggcacaggccatccagattttcagaatatgctgataccttgctgtgctcatctgtcctacttcatgtggttaattaaggcacccgcagaacaggaaaccagtacactatgaatctggtgtttcctcttcctaagaaatgggaaggtaagatactgtatatgggcagccataagaaagaccatggacgttttgctcaatgggcctgggtttgaatccttactagctaattaaccacgaacaaggggcatatttaactcctttaagcctcagttttttcatctgtaaaattggaatgatacctttttgttgttgttgagacggagtcttgctctatcactaggctggagtgcaatggcgcgatattggctcactgcaacctccacctcccaggttcgagtgattctcctgcctcagcctcccgagtagctgggattacaggtgcctgccaccacgcccagctaatttttgtatttttagtagagacggagtttcaccatgttggccagaatggtctcgatctcctgacctggtggtctgccagcttcatcctcccaaagtgctgggattacaggcgtgagccaccacgcccggctggaatgatacttatttaaaggattatttttaggattacatgggttaatatgtttaaagtcccttgcagatagtagatattcagtagagatacatacttctctttatttgattgtcattgataaggctggctgcactgggcctttgtaatttcttttatagcccttttgggtcagttacagctttgcttagaaacaattcatgggtttaggccccactcaaaaacatgtttcagtaaaacaatattaatacttatggaatcctctatcttccttcctcagaactcattaaaaacaatatcgatcagtaccctttgctacgtgtgggtatagatctttaggtgtggtctgcattaaaagagttaatacaggtggccgggcacagtggctcacacctgtaatcccagcactttgggaggccaaggcaggcagatcacctgaggtcaggagtttgagaccagcctgaccagcatggagaaaccctgcctctactaaaaatacaaaattagccgggcatggtggtgcatgcctgtaatcccagctactcaggaggctgaggcaggagaatcact

SEQ ID NO: 122485 - DNA, 1013 bp, Homo sapiens
cattattaaatttgaaccccttttgcaaagtatttaagttcatccattttattccttgttttcacatttcaagactagtcgtttaccatctacgaacagtgactctttaaaatgtaatacatgttttacacagagtggagtattggtcacagctgagggtaggtttgttgttttttttttcctattgtgataaaaagaaatcctggtttagagccccacccaagcatttgataaaattgttaccgacataaaatgctacactactgagcagatcaaggctgacttctgttggcaaataactactccctggctccaaggctctagggctcccagctccggggcccacaagcctacgagcaactttggggtttgggggtagacacttttcttggtgtggggtgtggtgggggcacagaatcttttagcaagtctttaaatcagaggaacagagacagctgttataaaaccttaaaagccattctaaaccagcgccaggctttaaatcatatatttgaattagagcaagataacaaagaatatctcaccaagtgcaaactgaaaaatctgaactataagaaccgtttaaagaaatacagctttaacaatgctaattacccacagtaactcaagaaataaaagataacatagtagagatcctattttcctaaatcaacatgaatatagagtatatctatttataggtgaattggtgcttctagtgtatcaaaaagatgacttaattcactcgctcaacggctctcaatgaatattttgagtctgtaccagcctctctaggctcaacatgtgaggtttactacataataaacattgaatctttgtcactttatgtctcctttgatgaagaagatgaccctagaaagcctagaaaaagagaaatcaaggattttatctttctcatgagtagctgaaaacccttgtgagattaatagggtcaagtgagaaaatcatgaattcctgattcatgacttcagaatgagctgataattgcattc

SEQ ID NO: 122486 - DNA, 1005 bp, Homo sapiens
ttcatgaccagcaaagagaaacaggaaggtcagtgtcacatctgggccacagtggcagagcctagctttctgggctgcgcctgtttaaggaacagtggtggcagaactggccgagggcccaagggtcagggtgtcacctggcagagccacaagaaaacacattagcacaaagcggctgtttgaataggcgtcatcaatgccccctccccaagtacgaggaccgctgagaatgaaagccgaggaggttcactctccaaggccgaacaaaacccgccctgccaatcttcccagtctctatagaggttcctcgccagatgattctgcaaatgtggcctcatcctttcaaaaacagtgcattctttttctctttctttaattcactagttccagtcaagaagatccaattcctttaaagacacagaaaggactttgaagaaggagatttgacttcttttgcctttgagctgatagcacggtgcttgtggtctccatgtctcccattttcgctgatcatttatctggttatgaagtcacagcccaatctaaatctaccagcctgagaatttggctgtgaggccacttgcactgtgtttttggggcagaggctggtgtctttcctttgaagaataacatgaagcccagtcccccggcccctgggtctttgtgttggcactttattcaggctgccagaaatcagcaacaacagcagggataacttttgcatcccctgccgtggtgtagaatttcaaagcttcttgcagctgttttggtgtgaatgcagataaagtagccagtcagaaagcatagtctatctaattccacggcctctatggggacagaatggctcaggaggacgggaacaaaaggagcagagaggcagactccagccagcctcctcctacactttattgcctgaaggaaaggaggatggtctctgccttccctgatgttggtttcctcaccctgggtgagcccagggtggttgaatatgtcgtgcgtgtctca

SEQ ID NO: 122487 - DNA, 1001 bp, Homo sapiens
ctcacatgtaacaaaagctacggctttgccacagttggggatgatttgtgaggtatgaattatgaatagacaggtagctagaatggatagagtcattggtccacttaggaagtcatagcttacttagatacctccctgtccagccacttgcatgcagtctctttctacccttgccttcttgatctggcacccccccatgcttctcttttctccccagcttcagtatgtgtctatcaagacccagtttcactcctgcttaatactggataagtatcagttgtataatgtgcaaatgcttttgcttataggtctcagatttagccagatctgggttaaaatgcagttaaacctagcactgaggccttaggcaaataactttacctcccttcattgatgatgatgataatacccagcacaggatgttgatggatcaaaggtcatttgcatattgcacctaggaaagctttaggcaccatagtgagggctcagtagaatggactcatagttgtttaagatttggcttctgactgcttctcaagctcagccacttacccagctacacatttcaatcccattaaactataagctccttttgagcagggagcctgtcttcttcagccttagcacccaaagcctcgaaatatgcttggcacatatttgaatgctccataaatatggccataaatcaaataagccgtaagaacacttacggttctttgagggtatcatggtgttccacacctctgtgccctcagatatgctattcccttgcctgcagtgcccatctcctccctgcctgggctaatatccagtcactttctcaattgctgacctggatgaattagaactccctctgtgtcccctctccaacctgagtccctcgatttacttgtctgtctccctcttaagtatatattagctccctgaggacagaggccatgtgtacttgactttataccggcagcccttagcacagtgcctgtcacataaaggggatcaaa

SEQ ID NO: 122488 - DNA, 1076 bp, Homo sapiens
tcacttccaatgataggggaatgctggagtcaaagcgactagttcacttcagaggacaggcagtgtataatgtcagggggaggagctgacccaaataatgtgtttcaagtcatcagaacacgttcatgtctggttttcatagtaaattgtgacagctgcgcaggagaagacagaatacactttttagatgttattttgtttattttgtgatgctgctttaaacagttccacagagtaaggaaatggagtttttacactgtgagactttaactcccttctttccttgacttgcctcttggctctgcttaataagccctttcagcaagacctcatctgctttccttgaagcttccaggtattatctcttggttgaatataacaaaaatcacaccaagtagctacctgacactcatgggtgcaagtatctcataggaaactggtgaattctgaaaatgcttttgagccacttcctttcactgctggactctcttaatctacttactaaagtgctacttggacaagagagtattgacagttacagggaaaaacaatgtagaatcccaggccatgtgtaggtttctgtggacacattttaattttttaaagaatattttagttatctaaattatgtacctaaccatttatattgagtacataaattctcagtaaattagcgtctctcttttgagggctgtgtgttatctgctcctgtgatccaaatatatagcactaagacaatataagggattctctctctctctctgtctctcattctctctctctcttccttccccccttcctttctctccctgcctccctccctctaccctctctctgtttgtcctaatttacctgacgttttagcccttgttgctgttggaggattctaaagatgaagccactcataaccttaatgcctgatagcatagagaatagttggtgacttcaccagaacttacacacccatgccttttcttttttgctttgccatgagtaggcagttgcatactttatttagcaaaagagagaactgttaaaaagctactaagtagtggtatattcataccatggaatac

SEQ ID NO: 122489 - DNA, 1051 bp, Homo sapiens
tccttccccgtgggagaggtgccctactgtgcatgccgggagttggctgtgggtcatgggcacagtacccctcacccaaatgattcttcccaaccatcaagaaagtaaaccccaacttggggcccagaaatattcagacagtagaagagttccacattcagacagacgataaaagaaatatcttcatattgcctagcattgaatttgataaggaatagaggaacagtattgtccttctgaccgggctctgtctcttgctgcctaaaattttattatcattgcatttaaaaaaatcaaagttcagtcttactagaatggatagaatgggtaagtgtagcttctagtttggtgagtccttcactgtttcttcctactaacctccctagctcagtctggctaagggcagggcctccatgatgaccagcaaaacttctctctggttaagctgagcttggtttgttaagcaactatacccaacatgtttatatcaaaagcacctgtgtttctcagtgtttctggaatcccaacttaagtgaggccggagctaatgctgtatttcagtaaataccacattagatcacacttttaagcagccatgtcaaacaattgacttaaattgaaattactttcagctaacacttccccacaaattgtttttacacatgctgctgctaaaccacatgtccaccgtcctgtacttaggcaacttttttttttttttggtttaggccctcacatttgtccttactaattttatcatgtcagttgtggcctaatactccagcctaccaagatatttttatatcttgagattgtcactcctgtcccttcaaaagtttgttccatctgaatatttcaccatacaaattttcaatatcttcatctaagatgttgacaagtttttgaagagctcagagccccattttaggcctcctgagaccaccttctaggtggacctgagctcaccaatcagccccacttaaatattataattcacttcattgttctagtatctagcccacattttcctatcttattcccaaaggtatta

SEQ ID NO: 122490 - DNA, 1132 bp, Homo sapiens
acttttctgccggcacaggagttctcactcaggagtgaaccagatcacctggggagcttttacaaaatacccaaggcttgtccttcctcctccccatgctgccccacagccgtgagagtgagatgtggggcccccaaccctgcaccagtaaccccagtatcactacttcttattacttcctcagaggtttcttattaaatatttcaaatcgcttttttcttttttctttctttctttttttttcttttcttttttttttttttttgcttgacaaaatccagtgaccaattttcttttttaacattttattcatttttttttatggaaaatttcaaatgtatagaaagtaaacagtgtagcctactggactccctgcaacctcacccagctccaacagtgatcatcaacattctgccattcttgcttcacctatagctggataattgttgtcattatttttgaccaattcaattttgtttcatagatagcatagcctgagcgctgaaaattggttatgtgttcctactgcatattgaattgactgtgtgcaaggcacttcccacaccttattgcatttaatctgcacagcacccataggcattgttacccacattttataacaatggaaactgaagctctaagaaattacacacctgcccaaagtctcccagctagtaagtgctcaagcaagcattcacactcatgtttgaaaagcatgcttttccccctaagctacacttcagaaaaataaaatgcatgaaaaaatgtatagttaaaagttttgtagcatgaatagatgcatagctatttgataaagcacgtatgttataatattaatgtttaaagctgggtggtaagtatatggatattcagtgtaaaattatgaaaactatgtttgaaattgttcacaataaaatgttggaaggtttccaacaaaagcaaactttgtcttaactctcaagcagtggacaagacaaacaagctattttcagatacctatcctgttgatatccgctccaaagagagagctttgagacttggttgaattttgaccttaaaaatagtaaaccttaaaaatagtaaagtgtaagccaaaaagtatctgagacaggtttcaatcaatttagaagtt

SEQ ID NO: 122491 - DNA, 1062 bp, Homo sapiens
gagaatcacttgaacccgggaggcagaggttgcagtgagctgagattgcgccactgcactccagcctgggcaacagagcgagacttcatctaaaagaaaaataaaaaaatagtgcccaagttatctttgtaagtattgcttccaaaataccaaaaatctttgcccttgaaggagagcacatttaagaaaatgtgaattattctactggcatggtatgttttgatttttatatattaagggaattaactctttcttacctgatttttactcttgtttttcaatatacctgaagttttagaagagcagctatgtcaaaagatcaaatgatcatagcatgacttactttgtcatttaaaggtagacacagaaaacagcattgtattttcctggatactgggtgatcttgttggatttggggagcagaggttatttgagagcagctgtttatattgcattaaaaatatagtcgatgttggggtggctgcttacctaggacaactatatcccctatatatttttgcagctttatgtgtaaattatgatcattggttactttgatattgtaggacacaataggagaattcccaacttgaccctttgactgtgttgtgataggaaaagacattatatgatttggctgtgtcatcacccagatctcatcttgaattgtagtttccataatccccacatgtcatgggagggacccggtgggaagtaattgaatcttaggggcagttacccccgtgctgctgttttcgtgatagtaagtgagttctcacgagatttgatggttttataaggggcttttccctctttgcttggcaattctccttcctgccatcacgtgaggaaggatgtgattgcttccccttctgccatgattgtaagtttcctgaggccttcccagccatgcttaactgtgagtcaatttaacctctgtccttcacaaattatccagtctcatgtatgtctttattagcagtgtgagaatggactaatatagacagcaagagctggtttacatatggctttgtttagaaggctgaatgatatttctagagg

SEQ ID NO: 122492 - DNA, 1052 bp, Homo sapiens
ccccaggaccacagcagaacaagcaggccttgtgtctgttttttataccagttatacctctgttttgattaacagtggttaggtttcttttttccaactagtcaaatagtctcccaatatgtcagtcccattttgagtattactcacaatgaaatatcagtaaaggttagattccatttccactaaatgtcaagtctctgaccactgaccccactacttgaattattagattataatcacaatctcaggggagaaaatgacaaaagaatggcgacagactcctggagtttgttgtgatagactttactaaaatacaaacccttagctgtaagaattgaaattcaaatagggaaaagattgtcccatattactaattagaggccagaaccccacatcttccaacattctcagttaagtgaaggctagaggagatcatgttttttgatatctttcagtaactgaaggatggcactgcaaagccagccctcttgtaatacaaatgaattttcttacattcccttcagtgctgtatcctttggattttgacttgatgtcaacctcactattcacagatcccctaaaatccaccatttaaaaaacttcaggtgtggggttgcatttggaattagaacagtgttgttgtgagtggcttggtttcttctctttccccaccatttccctagagtaatacacacttagagcccccaaatcacaatccttttatcccatgctgattcaaagccttttcatttctttaagtggatatctcatgttcatttcaaaatgtcatttagcagctgtatttctgctaaataaccagaaattatagttgactccagccaagtggctgagtacctagattttgtttccaagtatggtgctgagcagaaatgttttggtttcatcctcaatattaatagttgactgagagtgatggatgggcctggggatgagaaaaggaaaggaaatataaaatatagtggcagagcatcatctgcttcagggactcttgacctggggtttttaccagaattacctgagatgatattaaa

SEQ ID NO: 122493 - DNA, 1030 bp, Homo sapiens
tttataaatggaatttcattgtcatttgtttgtatgtttgtttttaacatcctcttttacacagaaattaatatgcttgggaagtgatagtgttttgatttgggggatgtttgattttttgaagagggggaaagttgggtttcatagaagtgttatttaactggattacttaataggttaaggtgttattataaaatcttggattttttaattggtaggttaacattacaatagtaggtatttcatatgtaagtttaaaggaaaacaaatacatttccttctacatatcatctgtaggattttgctgttttgaatttttctgactccttaagaagggtgtgacatctgttgttcccatcttgcactctttgttctttgtgtctttaactgtgttaacatgtcacaggaactctgtcagctcagtccctgagagggactgaagcagaactaacagataaatagcagtgactctccagatgggtccaggcagaggctaaagatctctgttggtcattctacttgtttttaccagaattattcttgagtttggagtgaccgggaatggtgcaggtaaagagcttctctagacttacttcatcatgcaagaatttggtcctgcctctcattttacactttaaccgcctgaagcacagagaggttgaggaggacccaggtaaaccttgctatggtttgttcccaccaaatctcatgctgaaatttgatccccactgtggcggtgttgggaggtatttgggtcatgggcagctggatgccattcttacgatagagagttctcatgctcccaattctggattagatctcgagggaatggttagggttcttccaaagtgaggacacccctcctaggtttggcgtcttcacacatatctgccatgttttgacccagcacatggccctcctgagaagctgagcagatgccagcactatgctacttgaacttgccagcctgcagaatgatgagctaaataaacctctcatctttatgaattacccagtcacagatatataa

SEQ ID NO: 122494 - DNA, 1067 bp, Homo sapiens
ccagctactcaccacaacccctcctccaatattcacttcataagaacctgtgggaatccctgcaacatttaccaccttctccaaccctggtgacccattcttagacaagcttggctaaataattcccttcctgccatcctcacaaccagtgaggtcaccttgtttgagctgtgttcatttttggagttaatgtcattttgaatcacatttatgaggaaagaagggtgggggtagatgataccattggttggacttcagttgccatatttaaactttcatttccaaacctttcttttgattttacgtttttgtctatgcttattacgtagccttcacagggatccaattgctgggctgaaatttttgagctttgactgaaagaatttggcttttgggtggggcctttacctgtggttgggaaactcagccgtggcattgcagatgggccagtgtttaaggtcagatgtctgtaggtgactgtgctgccatttcatagaatcaaagagagggacatggcttcaagggttgtctggcccaatcccctgctagcaaaaaaaaaaaaaaaaaaaaaaaaatgtctcctactgatccctgacaagggaattcaaattcttccagagatgaggagcttgctgttgcacagggtaccttggttcaattaaaaggacagttagggcctacagggaaacccttgtgaggagggggtatatagttgttctgtatcttagtgctggtggtatttatgcagttgtatgctttggtgaaaactcacagaactgtataatagaaagggtgagttctcttgaatgttaattagacctgaattttaaaaatggaaagaaaaaaaaccccagcatttaaaaattgaacaattagcccaacttgttaaaaagaaagtaaggaggctgggtgcggtgactcacgcctgcaatcccagcactttaggaggctgaggcgggcagctcacagggtcaggagatcgagaccatcctggccaacatgataaaaccccatctctactaaaaataggaacccaggaggcagaggttgcagtaagccaagactac

SEQ ID NO: 122495 - DNA, 1041 bp, Homo sapiens
tgtatgccaggcatgatgctgaccagatggagtgtaacgatgagaatagggagaagcaatgtgttcccagcaccactgtgaaattcttgcggggctggactgggccaaggtttgcagtggaggtgaagaaggcggtgttagtttacaggcccgagggactgggagaatgatgataacagctcaggcttactgagtgtttactgtgtgccagaggctgttataagcccttctatgtcgtgtatgttctttagttgatatcatttaatcctcatagcaaccctatgaggtcagtacagtaatccctattttacacataataaagcctagaaaagaaaggttaggaaaactgtccagggtctcacagctagctggcaagaagggaggatattactggaaagaaagaaaagaggaattggtttgggggaatatgttgtgagttcaactgcagatatttttccattgttctcttgtcttcaaatatttcaaagggctaaacattcagatatttataagcatagtttctggtatatttcattgtccagttttaaaattttttattagtgaatactgagataatttgtaaattggtttcatcttcctgggaaaaacagaggaaactggtaggtggaatttagtacatcgatgggtgcccgaagcagaggaagaggttgcagtttacagagagaaacataatatgtgttcaattatttctgtttaatgatgtggtttttcttttgttgtggtattgtttttcaggaccagtcctgcctctgttgtagaagacatgtggtgtatataaagtttgtgatcgttggcggacattttggtaagtgttgctgcatttacttctaatgcctcttgctgtaaaagggtgctcacgaagggaagctgttgccttgttctgtccatcttttacttctgcactaaactcaggcagaatggagttctataattaaatgtgacattgaattgatgttttctgacagtgtgatactttttcttgttattgctgatagtattaagcaatatggggttttctaa

SEQ ID NO: 122496 - DNA, 1035 bp, Homo sapiens
taaagaaaatgctgggcagaatcaaccaagttaaattttgtgacccattgaattgactcgggaccacaggttaaaagagtgtgctttagcgggttgtgttggcttacccggttagtgtgaaattgaaaccagcattaggacttgcctgtgacttagtgtggagacaggcccagaggcacaaaacagtaagaatcagagtggacatccttctgcaaacacagacatcaccttagcccagggttggcaaacattttctgtaaagggccagatagtaaatattttcatctttgcgggccatacagtctctatcaagacaattctgctgttgtgtgtgaaagcagccatagacaatatggaaacgagtgggtatggctgtgttccaataaagctttacttacgggcactgagattttaattttgtataatctccatgtgtgatgaaataatcttttgattttttgtgaccatttaaaaatgtaaaaaccattctcagttcatggactgtacaaaagcaggcagcaggccagatctgatccgcaggctgggggttgctgaccgctgcccaccactgcccttgctggtagagcctcagtcttctggctgcagactctcgaggaattgacctaggtgattttcctctgtccatgtacattttgaactgattatcttatttgacccttgtgattcctctgtgttttcagtaggaaaatctctgtggcattcatgatcaaaagttatttaaaaagcatatgttatcttcttaccagagaactctaattagggatgggggaccttcttaaaggacccacacaattttttgtcagatggtgaagttaggaatagagttgacaccgaaaagtctatgcaaaaacaacagagcttgaatttaaggagggctctcctttgggaagctaatatccagggaaacagagtgaccaaagaaaggcccgggtgtcctcatggcggatggaggagagcagctcagtggcaggggccctgccccgggatcttctcccaggtaggggcaggctggag

SEQ ID NO: 122497 - DNA, 1033 bp, Homo sapiens
cgtggacccaggggtccatttctccttcctaggctgttgggaggattgaataagaatgtgaagctcttggggcatgtaggattctcagcctcccactcccactcctaccatctaaaacatttcccaccctagtctcggcatagttaggaagatatgaagataatgggaaggtgcattccactgagtcagcatgcccaggtgccagcagctctctgcagtgggtattgcaaaattataagacagaatttcttggtccccagttggtaataatttacctcaccttcaatagtgggccgggacattcagcagctccatctcctgcaaaggtcctatgagggtcactctgctgaggctaattgcctgagaaggatagtacactatctgttttgccacattttgtgatttactttgtttcaagccttttccttttggtggtttggtgaaatgctgttagctgatgggttgtgggcatgaaggtgaagggtcatcttggaccgaataacctagggacagggatccttccaggagggcagagctgggccgaaggggtgtcctcctgacccagtcaggggtgcttgagtaatactgatgcaagtgtgtcccaccccctcctcctctggttagccttcagagccatctagactgatgtgctctggaaagagagagatggttctttatggcccctggggttatatttgaccaacgtccaggttccaggagttacaagctcgtgcaattgtatttcatctccgaacacaagctggttaaaaaggagaaagttcagtcaggctttgtgttttctacaatctaaattagatgctagtgctggggcaccctaggaactgcgtgggaagaatgtggtgaccagtctacacgtaaaccccagcttcctactgcacccatcccacttccccgttccttttttcccttatctacagggtcttcaactgcctcaagagctgttgtgggctcagaagaaaaggaaaagactaggaaaagcagaaacacgctggaggaactactgtgagagcca

SEQ ID NO: 122498 - DNA, 1812 bp, Homo sapiens
ttccagatctgtagaccagctccctctgcttgtccttggcccacaataggcgctgcagtgcccacgtctaatctatataatctgacagtttagcaacccacagctgactagcaataccttcttcattttcgaactccaaattcctggcagaacgatctaattagtttaacttatctttttaaaccaggctacaacttgtaggttcctagccagtatagggatgagcctcccttgcatcagttgttcacccctgccccatcatatgtaaggtcacccctaccctcatcatatgtaaggtcaagtaaggttggaacagattcccagagaaggggataagggtggggcagtcacccaaaaatgtgcagatgtgctttgagagatcatgaaatataaaactacattctgccctttgtcttcaaacaagtctatttgtgaaactggattcagttagaataaggaacacagaagccatttgacccacattgtccagtgtttgcagtacttacatttacagctccaatccttatactgtacacataccccaagccctacagcctgctactacccattatggcatctttaaaacgtttccttttgaaagtttcctctaaacttgatggcttctgtaaaattaaagtctgtttgtttcctgtaattctagcaacttagtaaatctaaagaaattcataaatgaaatcatacagcattaaaaactttctgtatcttgtgtacctaaaactgagctcctagagttaacagctcctgactacttgtatattcagcaaaggcacaggcagaagacagccatgtttgccacatatatcagctggtgccgggcaaggttggctcctgtgccaagcagctccaattattctttagtaaaacacacttttattcattgaggagcagttgcttgccaatgtattatacaattatatagtgaatggagaacaacggatgcattgtagaaatatttttaaaacaagtaaacaacagtggataggaaaaggaccctaactccaaagtgaagactgctgacatatgggatttagcaaagcgcgagtgtaaggaagagttcagaaggacagaatgctttgtttcaaacacctcttcctggaagggccccaggcagcattcatttctgctccacccacagggtgggttttcggggaggcacagggagcaggggtgtgtaggcatgtgtggaagtgggtgtgagtgcacccaggcactgggcttcacactcgtatttgtaagaagaaaaaagacagcatacattggttgatttagtgcttcctgaggtcttaacttgaaaggaacatgaacataaatgtaaatttttcaaggggttagagtttgcgggtttgggtgacttgggatgaaacagggccgaactaaaacatctaagagatttacagttcacacaggaggtaaccattgaaagtgtttgcactttcaataccgcagaatattcagtatttttaccagaccgacatcaagtggattcacatcccatgactgattgcacttgtaatttaattctgcctggatggccctgggatactctcagtgaaggccttccatgaatcagaggtttttctcttcccattccagtgacagccaaaggcccccttgttagacctgatgccaacagacaaggagaccacctttaccttaccctcatgatgtatattcccatattttcatcctaatagtgatataaatctttaaaccttaatccttaatcatttatcataggcatctctgtcatattatgaacaagacaggattcagattacaaagcagttttac

SEQ ID NO: 122499 - DNA, 1980 bp, Homo sapiens
tacagagtgaacataagtcaagacagcagtgaggcactctggcgctgggacacagtgagaaattaagatttgctagtgctggttccagggcggcctgaactcttgtacttcagctcatgtcatgctgggacagatctgaaggaagatccatctccctcgggtttcttgatacttctgtgccttctgtctggcaagggcgtcagagccacgggaacttagaggtagcaagggctccccacccgtcctcaacccacttgcaagtttcaactcacatctctttgaggacactctggcatccacgcacatcctcttaccacatagtgaacatctccattaatagctaacattcctctagcactgctaagaccttcagtattcactgctgctttttggagatcctgtgaaataggggtcattattatctccattttgtagatagcaaaactgaggcctagagaggtaaagtagctgatttaagtctgcaacttctcattatggtgtggagtctgttagagtcctgcatgctagctcttaaccacagcactcaatacctctttcttccaagcaaattccaataaagtgaaagttgaaggccataaaaagtatttgagaaacactgggatttcatttattgggatttgacctacattctttctgggaatattgtcaagatgagatatagtttgtaaatgaggctagtgcagtatgattattctctcaagtttgcatttcatgagtcatttactcatgctgtgttttgtagagtcttcctgaaggtgttgggttctctggtggtgagtatatctttcttaaattgctgctgtggtaggccttggtaaagttcaactgggttggatggggaagttctttgaactctttcaaaaatcaccaaactacagataatcgcaaatctagcagagggaaaatatcagttatttaactttgaaaacaaatccaactttgtattttagaaattacttgcaagacagtaagtccatgattttacaacacaattgcacttgtaggtttaaaattagaagtaaatagcatagtaaatgctcattcaatagttgtttaatgaattaagtaattatattgtttgtataattttgaggaactagaaagatgagtgaggcgatttcaatgtgtacatgagggcaacaatcgtgtataatatctacttggcacttcacagagggcatgactctttccataaaaatatttagtatgttcatgatgtcttttatctaaagaatttcatgctttagatattagtcaattctcaaaacactactctgaggaaggtgagtgacacacccctttatagacgaagaatttgcagttgaggctggttaaatgtgactaactcaagattaacactggtggtaggagacttgtctctggcctcattctgtgcccatgacctgctctttgaccttcaggaagctttatagcctcctcctgtccaacctccctcccttaaaaaaaaaaaaaaaaaaaaaaaaaaaggaaaatttctgatttaattacctccataaaggaagagtgataatttagctgtgtaagcatatttggtttctaagtatacaactaaagtatttctagccatttctccccaaactttttttcttcacacagttccacaaagtgcacaccaagcagatggtacagacaagaacatgggttatttacagccagtagagtagacgaaggcatatgcgctaagccctcttaaacccactccctgggagccattaacacatccatttagatgaaagagtcccgaggttttgccatgggcatttctgctacactcccctgaagcatcgccatctgccctgcctcctcccagaggccttgtcacccccactcctgcccagccacagccctgttcttccgagtgccctcattcacttagatgcagagctgatagcagttgctctctgtttttcacttaagccagtttagctctatgtctgt

SEQ ID NO: 122500 - DNA, 1021 bp, Homo sapiens
aaaaagagtatttacattaagtccataatcagcttgatcagatcaagccagccaccctcatacctgaggtatttataaatgctttgtgtgttgggtgtgtgctgctgctgtgctcagcgcccacctggattgatattgcacccaggaattgcatgaagggaagtggtagatgtgtatgttttctcccagtggtccctcttcgtttctctcagcctttcaccttgccatttctgtgcaggattatttgggggtaaatactgcaagaccaaaatatatagcttattcttagcgtggtgaacccttgcattggcatggcatgagataactgtcagcagatttctggaattcacataaatggcatccaaaggaagaggctgtcagtcatcaggtcatctgtgtgctctttgccattctcacagttggctgattcttcagggcacatgtgcatagatggagcatttgttggccctgactcttgctttcagaggctgaccagaatcacagccaggcactgttgtaaccagacagtgccccagtggaggaatcacgctgctcttgttggaatccaaagagagacactttgtcatttgtttattagggatacttatattttatcctggattgaaaacaataattaccagaaaccatttgttattgacacaagctgtctacttttaaactcaatccagcatttaaggaaagcaatgtatcttcgccaaataacttgaggtctttgtgtgaggagccgacagatggagtccattgatgatgaatgcacttggatgcacacagagtccaggagagcatccttgggccatgagggtttgccagaaagttaacaaggctgggttcagaagggctgtggacagagaaagtcaaaccagtgaaatagcatgcatggagattcttttttcagtgggatagctacgagggcatttattgcacctgctttaaaacggatacaccatgtattcgtttagttttggccatattataggagtaacttacagaaaagaggact

SEQ ID NO: 122501 - DNA, 1036 bp, Homo sapiens
taatggttatataaagagaattgccttaacacagcatctcttcattaggaaaatagttgaggtttatgaagtgagccttgtcagatacaatttgagctgtcttgctaagggttcccattcagtatcatggactgttcacagccctgatttaaggagaaaccaatgaaaacatctatcatctgatagccataggatgtcatccaaacttgtgtcatggtcctgtaatgttcccgggtttgtggagtgaagaaaataacacttgggtatttggaatttattcttaagctgtttttgtcagggatggatgagtttctcattcttgagttgaaatgaaacttttaaatattcttaataactgtcttatcgccagaccctctgcatgagacaccaagggtgagtgtttgagaataatattttttaaatttatttgggtattttttttaaagtgggggagatgagactaatttatgaacagtaatgagctgaagtcagttggtcactaacagtccatatcaagccatgatccctgcctgcacaaatttgaaaaacatgtaaacaaacacaaagtaagtagtaaagaaacaggaaagtagaaactacacaaagacctttacagtctatgcgtctgtaaaactaattaaaaatctgcctaaggggttaatggagtggctgaaactcaatttaatatgggtcatggtctcggggaaggcagttcaagtactatgttttaaagacaggttcagagaggaaagaatattctatttcagggactgtcgtaaaacaataatccaagatttagttggagacttaaagtgagttcatattatggaaggatttaaatgttggaataagaatttgaatgacttcagcaaggaacagaaaaggaataaaatgattctgcccgtactgataccttgtatttgtagatgtactgtagtttacagactccttttgggaatgttgttttattttatctgcactaaatcttaatgaaaatcacaaggctttttgaagactgaatctccaggattgctga

SEQ ID NO: 122502 - DNA, 1018 bp, Homo sapiens
aaaatctgacttcaggctctggaatctcgcctgcctctatgtaaatgtaaaaaataggatttcatgttttctaacagttttccatttagtagctcatttcgtaaagcatgttctgaagcacattggtcccaggagatgtgtggaaaatggattctgtggccagataagctgggaagagctgcttgttatatccccctcttggggattccctgtgcacattaacatttaaaggctctgagaagtcctactgcaaagactgtttaatgtgttgtttttttaattgtggtaaaacacatgccactaaaatttaccatattaaccattttaaagtgtacaattcagttgtgttaagtgtattcacattgctgtgcaaccagtcatgactacatcttggaaaacttaaaatccatacctcttaaacaacaactccggattctgccattcccctagcccctggcaaccaccgttctactttttgtctgtataaattcgactcctctaggtacctcatgtaagtggatcatatagaatgtgtcctacaactggctgatttcatttagcataatgtcctccaggttaatctatgttgtagcgtgtgtcaaaatttccttcctttttaaggctgaataatattccattgtatgtatagaccatattttgtttgcattcatccatcagtggacacttgggttgcttctgccttttggctattgtgaatagtgttgctatgaacatggacgtacaaatatcttttggagaccccgttttcaatttttcaactagatacccagaagtagaattgctggatcctatggtaattttatttttaattttttaaggaactactgttgtttaacatatttttatactcagttcataaacttgtttgatcacaaagttctttttccacatcacacctttgggtatcccacagagcatgggtttttcagaaaacactttggggaatcctgagctcagtaagcaatttctgcttgctccaaggggccagaaacctcag

SEQ ID NO: 122503 - DNA, 1027 bp, Homo sapiens
ggatttgatgttactgtctcttttactttgtaggtttctttgatgagaacacagagctttcctgtggttgctcattcacttgacctgagaaaaatgggtccatattttaaatagcagattaagtgtgaaataggaatagtccctggtgagcatattggcttcatttgtaagttctaaccactctgatatgtaaaactggtgggatttgttttgtttttaaacatttccattctttcatatctagattttagtaagcctaacttattttgttagcattcctatgaaactgaaagtagagcattaaaccattaaaagcacatgttctctggagtctcagaagtgcagctttttttaacttgttatttctgggtcacccttcattaatagcattcatcagatttacttgatcccaggccagaaagattagtgatggtggcattttcaaaatatttctgtcagagtttttaattatatattgactagtattgtctatttgaaactttgatggtgacagtacatatttgagaaggcagcatggtattctggaaataatttggaaatgttgtttttggccaaaaaaaatggaaaaaacctcaatgttccccatttgagatttaattatgtaaactgtgatacatctattaaattgaatattatatattaattaaaatgatgatcaaaattgctaaataagttggacaaatgtttaaggttgttaaatagaaaaaaaagcagtataccaaatcacatgcggaatgtgaagattggataggaagaagtaaagctgtctctattcacaggcaatatgacagtttatgtagaggaatcctaaggaacgtataaagcaaatactagaaggtactaaaaagtaaatttaataaagtcacaggatagaaggtcaatagacaaatcaattgcatttctgtatattagcagctaatagctggaaaatcaagtgaaggaaacaattctgtttgcagtagtaacagaaaaatatgaaatatctaggaatgaatttaacacaatc

SEQ ID NO: 122504 - DNA, 1029 bp, Homo sapiens
tcacttcctcctggatacattgcctttatatcactgtctttttgaaaacatggctcttggacatgaacacggtacttacaagatggtttgaccagtgtagagtaagaggttactatcaggtctccttaggtgcacattttctgcatcagtataggctatactgatgcagaccaatattacatctctcatcgagtcactttatcatatcttcagcttgcattgagcttatgtgtgataaaaatccttaggacttcttaagtatgaattgctttaaactcatctcctttccccatgctacataggagatctggatttctgtcagtagctggatggtatagcttgggatccagaatatagaccagatagggatctagagaacaaacagatccatgagctggggcatgctcatgggaatggtaccagcagcagagtaaacagaaggcagtttggataatctggtaagacatagtacagaggaaactcttctataggtggctgtctagatggacagaagtttggcagcagaaatgtatggctgggcatgtcgtagagccagatgagaggcatgcagatgtgcagggacttcagttcagaagctaatgcaaagagctgagtccaaaagaatgagttatagagtcaactactgaaatgaggtaggccccaagacagatacttgagcccagagtaaaaggaagccccggtctgaagtcagaatcgtaaaattgatatgattctgaatgtctgtggctgaaagccatacccacccagagtctggagacaggatcactggcagaacttgtaaacaggatgagttgtttccattcagtaaacaactgaacgtgaggcaagtgataacaccatcctatccacacataccatagattatttacaattgaaagcaagattttatctgttaatttggagaggaagatggtgttcttttggtcagttgtggctgtcattctaacctatttaagtcttttaaaatctctattctgtcgtccaattaattaactatctcctttcaac

SEQ ID NO: 122505 - DNA, 1626 bp, Homo sapiens
cattctttctctgaatgtttgctgagccttctctgcctgtacgtctctctgcctccccaggtgccttgagttcccccactgaaaggctggacgtcgcagctctcgctagccacccaggcgtccttttcggcccccactactctgcccaaccacattgccttgggtgtaacttttcagctgttctgagttatgttcctcaattccctggccacttgggggctgccccttcatcatctgagaatgacttggggttatttctcatcttgatttgagtgcaagagaggcttttctttctgaactagagccattctgaatgcagctcgtttgtctctaagttagggaagtatactatctgaaacattgttccagaacaattgtgagtaactcctgacctttgaccccatgcaggcacctagcttctgcaggatggcctgtgatctactgctagtcacgggcttttcagctcatacaaaccagggcaacttggggaaataacacagctctagttaggacaaggcagaaggagcctttttagaatccgcatgcactcaggttttggctgtggaagccagggattggcaaagactgtcgcctatgggaggtcagtatactgtgacccttctggactaggccaggtccacagcaggcaagagcctatgggtgccaggagccccctcagggcagtattgtgccttggagcccaaagaaatgcctggcatttgccccagactgcaggacttgccctcccctgtccaactcaggcagtgaatcctgcagccacaggagggggaagtccattcatctgggttcccagtcctggccccatgccgggcaaacagcagggctcagttagtggggtgtggggggcactgaatggaatgtgttcaattttgcttcacttctgctgttaacttcctgttagaccttagaaaaatcatttctcctccccaagtttcatttttcttatcagtaaagtggtccctttcacaggaccaagtaaaattactcgcttttaaattgaaaaacacaaaccaaatacattttgtttttgtttttgttttctgacttgggtcttgaattaaaatggaaaaagggctgttggccaccagtctaaagaatgccaggtaagaccagttatggattgggactgaaggagcaatgagtgtctaacaaaagagtgaacacgggtgactgacccgtggtgtggatgtctgtaagtgcacagggaatccagattaagagaagctaaacgggtagaaatgctgcttggatggagtgagtctgaggcacctctgaaaggctctgcctgcaccctctcctcagtcaagtagttgatgacctgaaaaacaatcattgccttaggggagtttgctgttttaaaagctctattctagaagttccactttcagaacctttttctgttgctggtagaacactgttgaacacggatctatcaacttttctttttgtctgtgtttacctatccagaagaatctaatataggatgtgcatctgttgtataagtaaatgatacctgttggccaactccagtggagaaaaattgccaaagttacagtgtttgttcttcatgtggatttttaagtttcctcttttagttgaacgttt

SEQ ID NO: 122506 - DNA, 1059 bp, Homo sapiens
cggttctgaggttctcactttagttgtggttgaatagagctatgatcattggtgcagaaagaagccattccgatgtgaatctgtgaagatgtgtctagcaatgtacagatgttttttggcaggtcagtgaatattttaaatcttttgcaagtagtaaaaagagttgaatttgaaatagagaagacaccatggcaagggaaaattataccttgtttttctctcaatcttccatttttaagataatcagacaaaatcctgaaccattatttaaatcttggattcatcatggctcttaaatgtccttcatcctgtatgatacatggttatgaccctaatgtattgaatctctttcaatagcaagaattgctgggtagtagtaaacataatagcagaatctccagtttggatctccattgatttaattctctctgtcacctcccctcttcacccttcctccagccatcaccagagatggcacacgcccctgtatcttgcaggtaccatgcttggtgtagtcccagtcaccaagaagctgacagtctagcggggaaacaacgaaacaggctctgcacaaagtgccgtgggaacacagagaagaggaaatctagtcctgcatgggggtgtgggcaaaggaaaacaagagtgaaaaagtgattttaatctggaccctgcaggctgattaggagaaagttgctacccagcagggttggtgagattggaatgacaaggcatagcccagcaccaggaattattgggggctgcctttctttttcggccctttcctgggatagaggcaggttgaaaacacagtggtacagtgctacttctggctgccttcttagctactgtacaccgtctctcacagtctggcctctgccttacttcccacctttctccctccagcctgccaccatcctcctagccactcctctgttgtgcagcactgtcaggcctctaagcgtgcagcccatgctcctttgactgtgtactggttgctttgcctgcactgccctgtcgtgaggttcatagggagatgtctgtgggcattcggaaacagtg

SEQ ID NO: 122507 - DNA, 1017 bp, Homo sapiens
ttctgccacctccccgctaccacaactaccaccttaaatgtgggagatcacatggcactttgacaaaatgtactatcccctttgctggcatataatgttaccacttcatgtatttattcattctgctcatgtctaccctcttttgtacacatcagcgtcaatattgtccattttcagtagcaagtttctagaaggctgagagtgaaccttgtttaatttgccttgtgctgcgtgatactacactgtgcatttattaaatgctcattggttctgattctaagcttccaagttgggaggttttacatatgttttcagtacttctagaatgagatgcgtcttaagtaacttttcttcatgcaggtgatacattgggtcctctgcactgatggatccttggagtcatggtttagaatccagattttggttgcatgttttagattcccccttatgttctgcctccttgggtgaaaatgcaatagccctacttctaatcttgcctctccgttagggccaaagcatagataatgtgccatacctcacacttcttttcatgtaagtgtggttgaccatgtaattcccatagtcattattcaacagattcttgatttcagactgccaagtgttagaggttgttctcttggaggttgagaattactcagtgaagactagtgaggatgaggagtgtctgggaagaatctggaaggactgtggtagaatgaacagaaccagatgcctctatgggtgccagcagctcctgggaaagggacaggttctggttaatttatttgttaagtatgatccaagagggattggcacttaaaaaactgcaaccctaaacattatttgattgtaccccagtccaacatgccatgtggggaagagtccctaatctggggtgcccaaggcaagccctactgctttccctgatcctcacatctctagctgtgacagaggttctgtttccagggaatgaatcaccctggcccccatccccagaacagggcttccttccacaca

SEQ ID NO: 122508 - DNA, 1562 bp, Homo sapiens
agcctgaggcaggcgaatcgcttgagcctgggaggcagaggttgcagtgagctgagattgtgccactgcattccatcctgggcgagagagtgaggctctgtctcaaaacaaaagaaaacaaaacaaaagcatgaggttggggtagggtccgggtttgaccctttccagctgtgtgggctgggccaagttacctggtctctctgtgactccttttcttcatctttaaatggagatagtagttcctgcctcagagggttgctgtgaggattcagtgagttaatacatgtcaaatattcagaacagtgtcctacacataggaaaagctatgtgtttgctgctgttgttaatccatatgtatgtgtgtatgtgtatatatacacatatgacatacatgctttagggaagggatgatgacaatatattgtgtgtatgtaaggaaactttgaatattttagaaagagatttgggtgattgtcggttctgaatcaaaaattgttagaaaagttgggaaatttacttacatggtatgattgaaaacagcatttttagtaagaaatgcagcaccttcattcttgagaacggaaaacatgaaagcattctgacgttaaccctgtaaaagggtttcttttagtcagataaccagaattttaacctatttacaatggaaatccctcgagtttgacttcagaatgtcattgtgacttttctaaaggtagaatgaactataaagtaagaaaaaactatgggttatgactttcacacatttggctcctatgaaaaaagagtgatttgtgttatttagaggactataataatttttttagtgtttctagttgagcaaatctaatttttagctactaaaacacatgagaagcctgaatggtattatccaaatggacttgggtgacatgcaatatagacaacttaggaataagtgacactgtggacttgattagaacgcagtaatcctggaagaatataaattgaattggatttatggtctaataaaaacgtgggaggaaaagataatgcttactgactcatgaaactttaacaatgtttgtaagactccgagttgttgtaatatttggttgagagcgctttcccatttgtctcagcctgcttccagaacagcctgctgtgcacctccgtctggaagtgaagcctgacttgggtctccttcttgggtatacttaggaagcagagatcatcacatactctgcccttgtaaacccatgacctcgagcagcacttggttggtttaggcaaatatgtattgagtacctattaactgtaagagtttgggggagaaaaaagtaccatgggaaagtcctagctcattgcttatttgcactcagaaagcttttttagaggactacttgtttctggccttgtattctcctttctgtgatactgcaaaaaagtagagagcataccacagctacctactcctccctgaatacaccatagaaataatagcacctgccattttattgaactcggaggcatgtgttaggtgcttacatacagtcatgtacttaatcatagcaactctaggaggc

SEQ ID NO: 122509 - DNA, 1055 bp, Homo sapiens
gatgttccctttaaggaagaaatgttaatgtaaatctgggggcttaatgttccgttttgtaagccagtgactattacatgcttaatcgatattgtcaaaacttaagttgaacctgttctttcctaaaagtatggctcctcgactatttttataagtaacagaactgtaggtttagtcttcagtaattttattagaaaagagttatgattcattaaatatttacttacacactttttaagaacattcatcgtggaactttttacgataaaaaaagcaatagggttaatgagtgtactgtaaaaacaaagggtcgtttgtttgatgccagacccaggaaggaaagccagagcacataaactcacactctgttgaccaagtttaagagacttaatgataaggttgaatgtgagcaaatgcacactctgctttctcctgggtctggaatctccaaccccatctgacttgctcgaagtcctttttaacctttggggcccagctcaaatgtcatctcctctgtgaagccgtttccatcttctcctttccaaacaaatcatcatgttttggtttcaaactttggcagcaggcattatgtttcgcatgagtctatttccaccattaattggtcagcacattgataaaaggaaccttatcttacttatcttgtttcctaccaagttttatcttagcgggtattctgtttcatttaacattaaacaaatgtgagttaggtctttggtatgtgctcaacacctgtatcaattaggctaatgttagcaggtgtaacaaataggcctgcaaatatataatggctcaaaagcaatagacgtttattcttgctcatttaatagtcaaaaattcatgtttctggtcggtaggtggctttcctccatgcagtgactctgggtcccacacccctatcttgtagctccaccatcccatagcttatcatcgtaacctgtttcagtttacagaaggggcaacagagagtagacggggcacacccacttttaaaataccttagcctggaagtgccaccatcacttcctctcacattc

SEQ ID NO: 122510 - DNA, 1029 bp, Homo sapiens
caagcgggcgccgggtgaaaatgggaattggcttgggggcgaggctggcccagactccgcccccgccctccttttggggccccccgcggggactggggctgtgtgtgttgttttaatgtcagggatgatgtaatcacttaataattgatgccccgtgctgcttccctccccacccaacccctgccccactcctccacctctcggcctcctccctcggcggcggtcgccttctccaacccatcctcctgcctatttctggcacctcccttgcacttcccccatcctccccttcactcttcctgtgccaccacccacccacccttcccctttcccctgtgctggagccttccctcctcttcctctgtcccccacccctctgctccctccagctcttttctccttcctttccggctccctcgctggatttcctctctacttccctagatccatggctgtttttgtttgggctcctcccctctgttatctctgcggccacaggcggaggggactgggccagaaggaggccaccgagcttgggcccagcagagatgtgctgggactcactgggaagagggataataaaatcacccttcttgcccctccttcccccaataaatcacacagactcgccgggtgtgtgagtgtgagtgtgacacaaagagccctttcagtgcatagagaggagacacacaaagtaccctaggataggcacgatgcttcttgtctctcttccctggggcttccctttctttcccatgaagcagttgatctctctgagtctttcctgccacatttaccaaaaaataaaagaacccccggatgccgggtggcaggtgtcggcattttgctgtgttcagagaccggtagtgttgactggcagctgcagtgtttcttagatttaagggaacagttatcccagcagtcttaagagttgctttacttttaaggtagcctccccatcccctcgttctttcccctgtccttttgggaacaagtactaagagctggggtagagtagattggtgtggg

SEQ ID NO: 122511 - DNA, 1088 bp, Homo sapiens
gtagtgatttccagcactctctttacccttaagatccccttcttatcagaggtctgtcctctctattcttcatcatattatagcacgtactcctcaatgttttttgctatctattcttgactcaattttacaataaatagaaatttctgttttgtttaatatcaagagccatgtcttattaaatatttatctaagacttagcaaattccataacacagcccagacagttttcagtggatgcatagatgaataattatcctaatctttctttaaaactgaattgtcaacttgctaatatgatagagaataactttggggtagaaggattgtgtagcatttctaaaaattaccctttttgagacagacttactgcctcattcaagaagcaggaccagctctagttataccaaacaatcttagggtaaatattttatcatagtgttttagcaagtttactatgtaagcatagagcattttggaaatggtgtggcttccttccaagttagtgatatataactaagatcaggacttctctactctgatgttcataatatctgttttcataattatagtgtagcaaccaaaatcttttattcattaacatagaaaaaagaagttagaatctgctctggttggtaaaattttccccacaacatgcagttaatacctgttttcctctgaaatagtttgactttaagcattataatgagatgcttttatttttctaagaactaaacaccatcccaccctccaaaacacacacatgcttacttttcaggaatctcttaatattgaattaagttaaatatatttaaactttacctttattgtctttaatatattgctgtcgcaaggctgaatgtaacacagtcttttctcttttctcatttcacagttgctgttttcattggtcaccctgttagatattcccatcccacatgttctggagcagggagtccattttgttgcttgcacaagacatttttttttccaaataagtgggagatttctataagctaaaacaaagggagaaaagtacatatgtatacatataaatgtacttgtataaatagataatttttaatcat

SEQ ID NO: 122512 - DNA, 1054 bp, Homo sapiens
ccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatcttcagttctagccttaacattaatttatttttaataacattttatatttcagatccacaggttaattttaagttgtattctttatatttctttcctttgcaaagtaatgatactgttcttggtctttgtcttggaaatttaactttttacaatatttgatgtaaaaaattttagattgcagttgttaacagtggccagaaaagttgcattttctcctttccaaaagaaactgatattcaagatcaggcagtgaaaagtctaaatatatttacagcttaatcttatttctgttcaagaattaatctagaatttcacttgccctataatgatgtatcaactaatgggcaccttaggctacattgtcaaatatagattaaattttttaaattgagtatgtttttttctcccccaaaggagtctcgcttctccgtgccagtgcagtggtgcaatcttgacccactgc

SEQ ID NO: 122513 - DNA, 1002 bp, Homo sapiens
ctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgaggtaattctatccagggatagtcaaaaaactttattgtgcttttggagatattttgaatttttgtagtagcattttttagttattctaaattgtagaagctgcttctgtttttattttgtcttctatcttttcttggagtgatcacgcagaattttaccttctatgactccaaagcagcatttccccaagtatgttccatggaatatgaacagatatcatatgatgtaaaagattttgtggttgacacacttgtaaaacacgtagacaaaattaaacattttttagctgtagaatgtcttaatcatttaaaccaactaatctgtacctcctcattaactggtccaaaagatttctgtggctttttggtatcagagattgctttgacattattatattctagattatagagtatattaagcagattcttgaggaaattagttgtttctacagttactaattattgacttatatgtgtttaactcaaatataaagtttgttttaaataggatatttttatatgtgtaatgagcaactataatagtatattgattacacttcagataatccagaaagaatgactgtagggccagccatggtggctcatgcctgtaaatctcagcacattaggaggccaaggcaggtagattgcttgagcccaggagctggagatcagcctggggcacatggtaaaatcccatatctacaaaaaatacaaaaattagccaggcaaggtgttgtatgcctactgtagtctcagctgctcaggaggctgagatgggaggcggcggttgcagtgagctgagatcacaccactacactccagcctg

SEQ ID NO: 122514 - DNA, 1027 bp, Homo sapiens
ggaattatgtcactattttcttttcttttctttttttttttttttaatgtaagccctcttaagagtcaacagaactatactggaaaattttttttcttgtacctttagtttcttttacagaacattcagatacttttcaggatgtatgagcttttgagaaatgctgactttctccttagagtttgcctgtacagtcctatttcctagagtgaagcatttttgacgtgctcatgatgtgtgcttgccaaaggatattaataccctttctttaaccatcttcaaacctttcttgtctccaaaaagagaaaaaaaaggaaactagtttagtcaattcctttagatcatttattacatggcaattaatcaacttgaagtaaaaataaatgattggcattgctttcttcccccagggaagtctataccttagaactgaagtattttgctcccctgttctgtaaaaatagaaacagaatgtaacttgctgatttttaaatacgcttagcaaattttaaaagaacaaaatggtcacacttttttcctccaacctgagattaagattttatattcagcaagttaggtgtatgtacagttgatttttatacatattattcattgacatagcattttaagattaaaagttaaaattgctgtgtaaccatgtctttaaaagatcctcataatcatcggttaagaaacaaatttgtttctgtgctagtataattaacctgcaaatttgagctagctttttatttgatttatagttcgttatacctttttaaaaaatacctttactacccaacatctcagaagaacatacttacaattcacttaaaatagcaaaaataaatattaatactaaaggttaaaagtaaagttcttttttccccacatctaatgcctactccctgtccttacagatgatcaggtttgcagggtctttttatgtctgttctttcagatatattctatgcctatcaaagcatgtatgtatatttttacataaacaagattatccaatatatactat

SEQ ID NO: 122515 - DNA, 1052 bp, Homo sapiens
gactttaatatcttttagcctccagtggaaatttaacatttccttcagcaatgagtgtaggcaccaaatcacagtagtattattgaatctatcacttgatcactgtatcagttatcaattgctattataacaaggcccaggccgggcgtggtggctcatgcctgtaatcccagcactttgggaggccaaggtgggtggatcacaaggtcaggagttcgagaccagcctggccagtgtggtgaaaccccatctctactaaaaatacaaaaaatagctgggcgtggtggcatgtgcctgtagtcccagctactagggaggctgaggcaggagaatcgcttgaacctgggaggcggaggttgcagtgagccaagattgcacactgcactccagcctggtgacagagtgagactctgtcccaaaacaaaacaaaacaaaaaccaccccaaatgtattcatttaaaacaataaccatttattgctcatgctttcatgggttggcaattcaggctggattcaacctggacagctcatctctgctccatgtgacatatattggttgagctcactcagatgtctggggctggccgggaaggctgggcctctccctccatgtggggtcttaactcaacaaggctagtccaggttgttcacataacggcagctttaagagagcaagaatgaaaagcacacggtctcttaagcctaggcttggagctcagcaatgtcatatccattttactgatcaagaccagcccagactcaaggagtagagagatagactccactcttgattggaagagctgcaaacaattggtttaatctacacaatcaatggaagaaatcacagatttgcatattatattttagctgctgctgatatctcatgacactatttaaattcaccaataactcaaaattatggtaactattagatccacctttagatcttgttagttaagggattagtaaagaagcatatacattattatattacatttggtttttaaatatattagtctccttttaatttctatatattttattgtatgcat

SEQ ID NO: 122516 - DNA, 1018 bp, Homo sapiens
gggagagttaccccccaacacagcctaaggccaagcggcctaaagagggaaagcctaagagagacaaggtccagaagtcggcatccaaggagaaaagagcacggacagacggacagtgcagaggcctctgctgggaagagagttctgaggcctctgctcagggtgcagggaattgtgtgcagccacctgatggccaggatttcaccctgaagcccaaaaagacaagaggaaaaaaaaaagctgcaaagccagtagaggtagcaatggacactacgctgaaagaaacaccaatgaaaaataagaaaaagaagaaaggttccaaatgaattctctccagccagggccttccgaccactcagcttgtcagggcgctgctggggcagacacctctggcctgaagtcagagcagagttcaccccagagagccggggcacatcttgtgacatgcctgtgggtggccgagtctcgccctctcaccacatttctccccaagttatgttcccaggagggctttttttaaatgttctaaatcatggctttcataaacaaatacatttttgtaaactctgaaaaaaaaaatagtctctggagccatgcagctttctttttaatgctgactccaccagcatctagttatgtgatgctgggcaaattacttactctccctccgcctccctttcctcttgcctataataaggttattaacagcacctgttttgttggcttgttgtgttgggatcagtggtttgcagacaataaccaagcaataaatgttaacaatattaaacatctttgagtactaaggcagtcggtctaaagtgagcctggaaataattgataagcaatacagtgttctattggctcttgtatatagttttgtctttatgtacatagctaattattaggttggttcaaaagtaattgcagttttgccattaagtgatggcaaaaactgtaattacttttgcaccaaactaatatctacctatctaattatctaagtgataatttaatcatg

SEQ ID NO: 122517 - DNA, 1012 bp, Homo sapiens
tggatacaccaggacttggtggtttgacttttcagcatcgtaggtggactaatatgagtacccccatatactctcaaagaccatatttaattaggtgactgtgttggatattttaaatcatttttatatttctgcattatatgttccccaaaatttagtagtaattcctcaatagacttaaagtatatttaaacttttttttattatagaaggtacaggcgactggggtcattttgctgaatattaaaattactttcttaatataattactttcttattataagcaaataaatcatttctagtatgatacttattattaaacattagcaaaggagaccttactcagcaccagtaacagatatttttaaaaagagaatttcccgagaggaagaggtctcagaggaaaggagatatgtcgtatacaaatcatgtacagcacttaattaccttgagatttattcatttcaatagacacacacccacacacattttctcaagccttccctcctggctggatttgtgtcttaggattaggggctttgctctgatctctgttttacagtgtttggcctgtgtagactttcctacttggactaatgtgctcaattgtatttatctttccagacctcttgttcatttagatttcagagttctgtccaattccatggtctcttggaagtcccagctttggcttttcctggcctgactcattctgttggcacccaaggctggcccagttaggctgaaccactgggcattttcagagttgccaccatttgactagaagtcttggaattccaaacttgggttgttgactgcagggttctccttcctcagtgtctgagacacaggcttttggtgattgcctttccccttgcgttaaatgctgctgtttctcagggctctgactctaggcccttctttctcactctgcacagttttcctgggccgtctcaaccacttttctggttcccagttgccattccacttccgtgctgatcacttccaagtc

SEQ ID NO: 122518 - DNA, 1073 bp, Homo sapiens
atataatatgtatggctcttatccatgcaggaaattcatctgcagccaattagctgggaatattcaggaggaacatgcataggaatggaaactaaatttcttcatatgccttacaacatagttgtttcagggcagaatgctttagaaatcagattcatgtagattacccagcagaatgaaatatttctctaattcattgtaaaccaacagtgctctgaaaaaggagtgctggtaggggtagggcaggcggtggagaaggcagtaaccagtatcagtctccacaaagctgctaggttctgggatcctccccgagaagctaggttctgtctcccatcaaatataggtttagttgtacgtcgtcctgtgtctctatgtgattttgaaagaacttcccactgattagtgtccagcttcctccaccttaagattattttgggcactcaaatgaacagtcaacaaagtaacagggtcaaagtttaaaggtcatgaaagacaaaggctgaagaattccagattaaggggactgaagagacatgagaagtaaatgtaatgtttggtctgggattgaatactggatcagaggaaggacattagcgtaatgccaattggcaaaagtgtaaataaggtctgtagatttggtgatagtacagtaccaatgttaattttctgattttgaattttgtactgtggagaatctgggagaagggaatgtgaaaattatttgtactatttcataacattttttatgtctgaaatcatttagaaattaaaattaatgataaaaattatagataaaaatgttacaattgtgaaggtgcttactattaaaattatatttcactatgggtagtgattgagaatataggttggggcatcagaattcaggggtttgaatcccagctccattacgtagtagtagtataaatttcaaattaattaatctctaggtacttcagttttctcatctgtaaaatggagaaaacagtgctttctacctttcagtgtggttgtgaatattgaatgaatgaatgtacgtaacgtgcttggaaaagtgccaggttccataaatgttt

SEQ ID NO: 122519 - DNA, 1042 bp, Homo sapiens
cccatcactatgtgcgtattgtgctggtaacatggattacataatttttttttgcattaatgatctagctttcccactagactggaagccccttgggaccatgttatatccagaagatataacatgtattttatttatactatctctcaatgcatgtatgttgaaggaatggaatgttaaataattcattagaatgaaatggataatgttcaagagctatgattaacaacagaaggaaaacccaaatgtattgagatcaaagtaattgtttcatctgagtgatgttttgtcttagctgagatactacttcttttttccttcttttctttctttcattaaatctttgtttcaaatcctttttttctatcatattaaaaggaagcttctagacaaaggccttctttgggtggttactggcctcacccggacaagttcccaccttatctttcatattccttttgtagtatagacaaataaaacagatggagaacaatgttgtgagccaaagaacacagtgcagttggaaatacttgcctcatgtagccagagctgtgtttattgttttcctagataacagatgtgaacgcactacagaatggaagatagggtcccctgaacacactgccctctttctcacatccacacctttggtcctgctgagacctctgtatggactacccttcccctttctctgctttgtgagtgcctcttcatttttaaaattttcactcctctaggaaacccttttttattggcccccacaaaggaagttgctttctcttttgaggagcacactttggatataactcacagaggtactcaccaccctgcatgatagcgtttctttgctgtctcattaggttgtgaactcaatagcctgtgattatttcacaactgaattctcagcactaagttcaagttaaacctggcacacgtagttattcaaatttttgttgaataaatattgaataaatgtgaagatttgcccctagtctgggataatgtaatatttgtaatcattgagtcagatgataatgtccta

SEQ ID NO: 122520 - DNA, 1030 bp, Homo sapiens
agtggcacaatctccgctcacactgcaagctccaactcccgggttcatgccattctcctgcctcagcctcttgagtagctgggactacaggcgcccaccaccacgcccagctaagttttttgtgtttttagtagagacagggtttcactatgtgagccaggatagtctcgatctcctgacctcatgatccacccgtcttggcctcccaaagtgctgggattacaggcatgagccaccgcacccggccaagcatgctatttttatcttgatgtttgacatcttgtagttaaaggtgagcagggtatgagaagcactggttggcattgaggaaatttggtttcttgtcctgtgtctatccctatccatttgtgtgcccttggactggtcacttgtgatgcccccttttcacagcccgtaaaatgaagaactttcattgaatgatctctgatagtttttcagctctaaaaacattctatgatattaaaggcttagcgtcatgtgggttgtgagtcttagctgaagcttctttagttgtttggctatttgtggattgtgtattcacatgcattccatttaaatcacatgctatgtgctcatttacttgaagtttaataataatacttaagcatttatatattgcttctcatcttcgaagcacttaacatgcttatgaatccttccagcaacactttgagatagctaagtactattaaaacagggagagagagaaggggagagagagagaaggagagagagggattttatgtgatttagtgatttaagtcttcccctggctaaaggatctatcttcctttggctaaaggaaattaatataacagggccacacaattaaaaataaaataattatttaaaaaaagagagagagagaatatacccaggccggaattaaatctgattgcctgtgttatataagaccttggtgtcaaaaccttccttcctctgacattctaagggttaaatttagcttctcctctctgctctactccaggattttttctgttcttcatag

SEQ ID NO: 122521 - DNA, 1052 bp, Homo sapiens
taaatttgtgggcttttttaaagccactaaattgtgataatttgttaaagcaacagtaggaaattaacactatccctcacctctggcctttatcatgttgagcaaacgtactttagtttttgtttttatttctctgcatgttgttcacatagtagcaaacacttctgttctgccttaataaccaagaattatgccatgttgaattatttgtttatattatagctaaaggaataattagaaaattgattaattatgcttctgtgtaccgttatgttcccaagtctaattatttcctaggactatgtttcattcttcgaattcacagaatgttggatctggaaagaaccattaatatgatctaatggagtctaacactccccttttgtaagagaagaaattgtgacctattaagggtaaacccatgagcgtccccatatgcatctagttagttgcttataatactaggataaaatttgaggacctctggctcccaggcaggcatttgccccacagtaccatgctgtttccacaaaagtgtgagaatgtgaaaatatgtaatgaacctggtctcttaatgcaaaaggtgaagaaacgtgaaattcaaatatgtcttgtataattcaacccattctcacttgagaagcagtgtaatgcagtagttacaatctaggaccccaaagctcgattgcctatatgcaaatcccatgtctactacttcccagcaaaatgactctagacaagttacttaaccttaccattcctctatttcctcatctgtaaaatggagatgataataatagtattgaactcatagggttatggggaggtttgaatacatagtaggtcaggtgccgtggctcatgcctgtaatcccagcactctgagaggccgagatggtgggttgcttgtggtcaggagttcaagaccagtctgggcaacatggcggaaacccatctctactaaaaatacaaaaatgagctgggcgtggtggcgggtgcctgtagtccaagctacttgaggggctgaggtggaaggattgcttgagcccagga

SEQ ID NO: 122522 - DNA, 1309 bp, Homo sapiens
tattttttaattgatttatttatttggaggacattaattctcggtctgaggctgattttcaaaccgtttgcaaagcgcggctccattgttcgccaggcgcgcagaccccgccccctgctttgtgtgcggcgcgcggattggccgacgcgcgcgggggccgcgtcagcgcccgcgagcccattcatctgtgcacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggtaaattctacctgtggttgtggtcatttatttcgtgtctttctctccttccctcctggtggctcccaaggctcattcgtggagaggagtgtggctggattctagtctgaaagttgaatggaaatggatagcctaaattgtggatttttcatagccggggtccccccacaccaaaggagtggttccttagaatcctggagaattcttgagtagacgggaggaaaggagtgataaatcgtctaaaatggcgtggtttggagattggcagaacgtgactagctaggtgccctccttcccccgcccccagccaggtttcatttgtgtttgggggcacaatggtgtttgggtgtctctcgggtttgttgtcgaagctggattgtcttcgagatttctgaactggtggtgtgattgtgtgtggcgggggggggagtcgggaaaggggggcgcaatggggatggtggtggagaaaggcgaggagggaaaggctgtcttattgtatgccgcggcggcgtgccctgggttcttggaaaggtggctggctggggccagacagagggcttcggtaccttttgatgaggctttcccactgtcctaaatctttattcgtagctgtctgtgga

SEQ ID NO: 122523 - DNA, 1541 bp, Homo sapiens
aggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttat

SEQ ID NO: 122524 - DNA, 1498 bp, Homo sapiens
ttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaagcctgctaaaataggatttttttttacaaattttattttaaaatgcaaatatttttagagaaaatttttaaat

SEQ ID NO: 122525 - DNA, 1124 bp, Homo sapiens
gttgtgagataggtaaatttaagaaacaattttaagtaaaaacagttgaggattttagtgtcagaaagcatgtaaatgtttgggcacacataattttgtgccagcctttacaggataacttggaatagtttattaaatcactagaaaaattaaggcattaattactccagaaacacttaagacattatcaattaatgtgtttcttagcatgagcctacaggacctgatcaatataataggtcagtgcatttaaaccaagattgtgccatttttaatatttcacattgcctcttttaacagaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatcc

SEQ ID NO: 122526 - DNA, 1114 bp, Homo sapiens
attttacaacttctcattacacttaatgtgatggttagattgtagcataacagtatgtgtaatggtatagactgtctaacatatttggtattggtactttttttttggtctacttcacctctcagctctgaaataaaatgctactttttaagtaatgacattattcccatcccctattagaaaaacacacttttttcctttagagtttcagcatttttaaagaaaaagagattcccccaatttttattatgtgtttttgagccatttcttcatacatgaaagcaaagttttcaatattaaataaaccattcattccattcaaattttaaaatcattaggcatgttaccctttacgtttaaatgtggtaactaactgcttagtgcatttgtatgagtatgctgtaatgattataaaacctgtgactgtttttgtcaaaatttattaaaatattctgtgcagttcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacaggtcagatttgtttcttggtaattgtgttttaattgtaaattttaaaaattgggctgcattataatgtttatgctatcgagaagtcagttgcacaggtatcaggaggaagtatgctaggtaggtgactcttttttcttacatataagtggtacttagctcttaaagcttttatataaatgttattgttcctatttgctttagtaatacaggaaaccttattttcttgataacataggtttaaaatagtgaacattgcattgtgatatagattggttaagaaagaggacaaagtaattatgaatctattggtagtgcatggtcagaactgaacttctaaggtaatttttagctacctaaagcttatttaatgggagaaaacacaaagaagagttacatatccttagaccagttttgccattttgaaaaaggtcaaataatggattttgttcagaaattgaagaaaacattaaaaactctgaggaaagctaggaggggatt

SEQ ID NO: 122527 - DNA, 1032 bp, Homo sapiens
taaaagaaacttttctagtagcaataataaaaattgagtgctagaattatgtaaatcacatgttgcaactattgaagaatgcttaatgaaaattcccacagtatacagttacatgaagagaacagataaactttgtaaaattaactctgaaatggaaggaaatatagaaaaacgatttttgaataatgtcatttttaggtggttagttttttcattgtccctttttaattttttcccaaatactcttcagtatgcacaaatgtcttttgtaattgaaggattttcttttcttctttaaagattgagttatgtgcctaactggtaatattccgagaagggaacttactggaaacttataaatgtttattgaattatgacatttatccacataaaatatttacttttatgttaggtttactattaatattaaatttctacacgtagaagttgaagtttttgaaaattaatagatgtttttaactcttaagttaggaaaactactcagtaccactacctaaagttaactcagggttaaactatgttgtttagctttccataattattttacacatgtccatagggaaagaaaagtcaataaaaattaatttagatgatacataatgttttattgtaacatgatgaatttcaccatgtaaccctacatgaacatctttctgtgttaataaaataggtgtatattcatattataatcttaatatagttgtgtacttgacttttccatcagggacacctgctaaaatagctagttatatcttaattttttaatatgtattattgtataacgtgtttggaaaggagttttagacttgacattttttacatttttatttgtttttaaaatatttagaaaacccattttggttgagtaacatttgcacttattatctttttaaaatttatttttcgaactgttgcagtatgcagattttgttgttacccaaatcttcttgtcttaggtcatgctaaatgtgtagaagttgtaaaaacttttaacttaccattactgatgct

SEQ ID NO: 122528 - DNA, 1026 bp, Homo sapiens
tcttcatgtgttcagattcattgaatattctgtcactttcaccttcttgaaaaacagccttctcatctgttcatgtttggatgactatctttggtagacctggcaggacacatagctgttctctgctttttttctgttgtattggttctccctggtggctctgttctctgtccttaatttttttctcatgttttggtggagtgccttctgaagtagcttcctgataaaaagtgtgtgggggattaggagtgctgcagtacatactaaattttgatcatgtgttgaaatcagcatatgattgaaggctaggccaaagcaaaatatcaccattctggaatgaacttctagggtgtaagaataaatctgaaattttatttaataagatattataatgtatatgtagattagaaatgatttttatcatgagtgtttgtgtatgattttagaggtttttttccacgtgaacttttaggtagcaagttgacagtgtgctttgtattctctaagatgtggagaattctcaaatagaactttctccagaacaattgctggtcttaatggaattggataactaaatacagatattaaaagcttctttatttaatgttatgattgctactataccagctatattagaattatggtataatctgttattctatgttaagtggaatgatattaaattaattgtccctttgtaggtcaacagtggttgaaccgcagtttcatattgtaacttaatgtgttaataaccatcttttgcctcaaaatgtttataaactttctaaaatgatctacctaatgtactcttaaaagtgtatattaactatcagttttcctctttgacttgaaagtccttaatgtttttgtacttaatattttttataatcataaactgcagcagttcactcttagaaaaaaatttactttgtatttcagctaatagagtttcagttgcataaagcgtgtaaggatatttgtaattccaagtcttaaacttcattctgagtttctctgctgccagct

SEQ ID NO: 122529 - DNA, 2261 bp, Homo sapiens
gtctaactgcctaacttccatatctgaatgaggctttgttctctactgatggatataaaattatctctgagttgttgaaggagttatttttccttatctgtggctgcagtttgagagagagatctatagaggtacttaggaatttggatgttcgcaatgttagttattttttgccatcagttatgacacatcttagcagattctactttgtattatactgagctagtgttttttgcttgtagttattccatgcatgctatccatagaggctgacttttcagtcaacttaaaattgatactgactcctcaaataaacagtgattgagcagtatcagtgtaacatcttgcctgctcatcaggagcaaaggaaaatcatttgcaatcatttgccttgttttttaattgactgttgatgttggttccagtgtcttcaactctttgagcaagttcttgcccactcagctaatagttttaaacaactttaatttgtctggacacatttttttgggtggtgtaatcaaacatgatttaattaattgacttggtgcacagctttccttgcttatctaacacgtgagccgctcagaaactttattttgatcacagcctcatttctgtttttttaattttgtgaagaaattttgctgtactatggtatgctgtttatagtgttatgagaatattcttatgagtgcttagtctggaaatatcaatttacattgtattgttttatttagcacagttatggcaccattatataataaatacaatgctttgccatctaataatatctcacttcactatacttcaaaaggatgacatgagaagtccattttccccttattttgacatgagtatacactggtaacaaaatgtcatgacatggtgattcatgtgactcctaaactgcgtttgagttacaactgtgtcactaatctgtggtgctccaagcaccagtttgaagtcatgagagtaccacatgtagcctctgtcacagctaatcgattctgcagttcaaatgaagccataggtaataaacaattgagcatggctgtctttcagtaaaactttttttatggacactgaaatttgaattttgtataattatcacacgtcagaaaatactcttgttttggttttgtttttaaaccatttaaaaaataataaaaacttcttagttcaaagctgaaaaaagaggcaattggccaaatttgggccatgggccatagttagccaatccctattttatactattgaagatttactacagaggtgttttaattaacaatcttgagtatggtataatcttcagtttttaatatattagaaatatgtgctatgtttttgaagcatgtagaatagaacagatttcacaaagagtaaatatatattttttaacctacattgggccacaagtgggtatttaaaggcctgaggctcaaacctcagatatttgaataacctcttaggctgaatgtaaaaggtgattaaacattctggaatgcaagagctcaaaaatgggtttcctgaatttgtggtgcttcttcccatcttagaacctttaaaggaaaaaccaaaacttatggatttgttttcaggtatcatcagagagtcttatatattgatatagatattcatcatggtgatggtgttgaagaagctttttatacaacagatcgtgtaatgacggtatcattccataaatatggggaatactttcctggcacaggagacttgagggtaagactaaattctgtctgaaaaaatattgtgagatgaacctaggagatcagtaatcctatacttgaagtagtatttttctcctgagttaataatttgaaacttgtatgcagaattgaattactacgtatgcagtaacatttgctagaattcactgttgctgactataagcaaaaatttagtgaaaacttaaggacagtttttttctcagctgttttctttggttgaataaatgtttttgaatatccacaaagcatgaagcccttctcttgatgttcagtttgaatcttcaaaactacctgatggtagcctacgttgctattgattgtaaagaatggtggaataaaatagactaggtctttttaggttcttctgctcctctcttttgtgattggtcttgatttttagtagatctaattttaatctttttttttctttaagcttctaaaattggtaatgtatttaggtagagaaaggataccatagtgtaaccttgcctgcctgttaacattaagtgtatt

SEQ ID NO: 122530 - DNA, 1486 bp, Homo sapiens
tgcaaaagaggcatgagtagcccttgggcaaacaacataacaggattgatttaaaacccacataataatgagttctattaagcttatgatcctggccaggtgtggtggctcacgcctgtaatcccagcactttgggaggcggaggtgagtggattacctgaggtcaggagttcgaaaccagcctggccaacatggcaaaaccctgtctctattaaaaaagtacagaaaattagctgggtgtggtggtgcgcgcctgtaatcccactactctgtaggctgagacaggagaattgcttgcttgagccccagaggtggaggttgcagtgagccaagctcacgccattgcactccagcctgggcgacagagtgagactctgtctccaaaaaaaaaaaaagattatgatctctctgtgcagtaagaaactaaaattcatttcttatagtgcttgtgacttaagggtatacaaagatattaatatacaaaacaaggacccttattcttgaagaggttacaattcaagggcatagggaaagactaagaaagggttacatacatctgccatatcctttcattctctcagtgctaaggaactaaatgtgtgatcgtttatctgtaaatgttttccttgttgtctttagtatcctatgttttggctcccatgaacctagttaattcttagcaactttcaagatcaagattagccatgggaataggcaaccagctgttacatctttttggtttagtaacttactgacatgcatttcaaagttacagatattataggtatttaaggagtttcaaagaaagtaaattataaagcaattgaagttgcttttagaatgttaacttattgtaatattaaggggaaaggcctagaaaatttaagcctgtgttttaattaaataagaattgttgtacttagacaactattgagttcttgttaatagacagaaatattccacagataatcctgataagatttgatgatctttcacagataacactttaattaccttggataaaacaataaatatattttaaagttggaaactttatattatactgtgaagtgtatgtttgatgattgcatcaagcaaaaaagtatttgtgggaaatagtttttgtaagaaaaggctttcattaatttgcagaatgtgttgaaattaatgaaatccatcttccacagttaatgttggagaagattgtccagtgtttgatggactctttgagttttgtcagctctcaactggcggttcagttggtaagtgctaatgcaatcagatttaaaagttgatctgaacttggtgtgttatctttcgggttatttgtgtaaaacagaagttttaatgattgtgaattttgataacaaaaggaaatcagtatgtttatagtaaagtacaatttactttcaaacctctatgttttatgattatgacttaaacgctttttaaacttattttcacttggagacttcattcattccct

SEQ ID NO: 122531 - DNA, 1465 bp, Homo sapiens
agcaacaactcagtgtagcatattaagtatttttttttttttttttttttttacaataattgttaatctgcctgtgctgctgaaaagagttgacctgggactgttacaaaataataacacataaaattaatcccacaaatatttgcagggcatataatacatatggaatactgtgttagtgtggccaagcatagtacagataacacaagtgcaacagctgccttaatgtttttgtagataaagatgagggtatgtataaacaaatacagacacgacaattagctatttggggagaaaagaaatatttaaaacaattaatgctaggcaatatatgtgaatatgtgaattattttcagttacatgtagacatttagagaagaggggaagttagaataagactcagtctggaagtcttgtggaagaattgtgtcatacgtgaaattgagctcttcggaacaaggaagattaggatagaaaaaaggacgagaggtcgtgaacaaagatttagaattgaaaactcttgtagtgagtgatttcattgatgaaatcactggatgttttatcatggaaaaggagagaaagtagagtttatgaacatatggatttgactttttactcgaactgtttccactaaaataaggagtgattaaatcatagttgatatgcctgtgtaatgcttttaaaggagtttgaattagttttgagattgattactgttttctaaaacacatataagtttgggttagttttggaatttatatattttgttctggtagacttggttcttttgaggggaccgataggggaatttgtatatttgtttgataatactgatataaccggttgtaattccacagttctgacatttatttctcttcacagaggccccataaagccactgccgaagaaatgacaaaatatcacagtgatgagtatatcaaatttctacggtcaataagaccagataacatgtctgagtatagtaagcagatgcagagatgtacgtttctaagtaaaaagtagttttgctttgataaatgtaaattagtatttttaggagcttagaatgatctaaatctgaatatttttcctgttggtctaatatgttacagttatttactgatttgaaaagtcattttaacactactaaagctacttaagaaaaaagtaaacctatctgaagcttattggtttgcaaaactgctgtttgggtattcttctactcctagtttgctcccctgataactttgggttaatacatattggtagggagacctcactcccttactccctcgcttcaaaaaaacaaaaacaagattacactttgattagccttagcttggcatgtacatatctcttgtcttgtctttgtgtacttcagttaacctggactataatacacatctctttttctttgttaagatattagtgaagcttttgattctacgtaatgttctcttgtaca

SEQ ID NO: 122532 - DNA, 1087 bp, Homo sapiens
gtatcataataaaatacaatatgtaagaagtagagttaaacacattagcattaagcctgagagatattgttctacaagataattagcataaatttgttcaacaaatacgtctcaagcacctcctactctaagggtgcctctccgtgctgggtcaatggcagtgcacagaatgcatggcctgccctcccagagcggacattccagctgggggtggggtggtggaggggagacaggcagtaaatgcatatgtaaccagagcaatcgggaaagataaggcaaagtcaaatggatagaagatgcccagatgatgggaggagagaggctgccttcttatgtatggcagtcagggaagacttatcagtgagatgacatttgacaaaggccacaggaagcaaaccctgcccacatctgcgtgaagcacatcccaggaaggagcaacatgaccagaaaatgccagaggcaggaacttgctacatgtttatgtgcccctcctcctgccttcccccaagcaaagtaagcagatgaagtgggtgaggggaagggagaatggcaagagactaaataagatgtgatggggtgcagtagtctgacttgtacaggctggtacaagcccctcaaggatttattcaaatatgtcacagttacaatgaatattgttttgatacatctaatctaagtcttttttttaaactgatttcaaaaacaacagacatggagtcttgctatgttgcccaggttggtttcaaacccctgggctaaagcaacttgcctgcctcagccttccaaagtgctgggattacaggtgtgagccaccacactcagtctcaatccaaattttaccaccttgcttctcttttgggttcccttttcagctctaaatagtgccagctggaatattgagcaggatcagaaaataagcatgctttcactcacctcgccttcccactgaggcaggcagcaataattgatcacagacttctctagtcacactgcaaaaagtcagagctggccaagaaatgaaccattccagacataaccttgaatactcagacatctcctttcccttcttacctctccttcgttaata

SEQ ID NO: 122533 - DNA, 1059 bp, Homo sapiens
agttactccatattgctttgctccccttactgtgcatgtattagaggatggaattttccattgagggcatgtcttagacaaggccttctgtacaagttcccttatctgtgcctgcaggctgatttttcaggctattcttttgtttgaaagaattcaaccaaggacccaccctaactgcctgcttgaccactttccctctttctcctctctccaactgaagttcactcttatccttcctgaggacatacacctataaattctatttcttccatttatctacctaattgcatatttattaacaaatgatattatcagttctgccccacagtgtgatttctcccctctcagcataggccagaggccatgagcccacaggattataaaacagatagaatcctggtcctggacacaggtgtatttagtgtggcttgtgcaatgctttaacaatttttttttttaatttgcattcctttactgtggaaggcacactccaagcctgacctcaccactctttattggcttacaacagctgaatgcacacatttacctgcttagtgacatgggcagtgggtctggtctctctatagctcctcagtttgactcatattcatatatctcattttctccagcatacaggatttatttgcctctagctgcaacttcccttcaccaaaatgatcatttttccctttctcagatggcctgacctagaaaactagaaaagatctcttgactgtggaacttggtcatctctggggaactagctccctctaaatctgctgacatcatccaaacagcagttccttagtggctctctggatttaataatgacttgaaactctcgggtaaagtggtggaatgtgtaatctaaatatcaaggttatgtgtcctgcccactttctttgtatctttcagtggtatctattgaagcaggtcagctgaagaatgacaaggttcatacaagtggaaaggagagctttatttctcataaagagttgcagcctgcaaggtggctattctgataggctgggaggcacggcctctggccagatgccagaa

SEQ ID NO: 122534 - DNA, 1041 bp, Homo sapiens
tatagagcaggataatctgagtttggacttctcgctgagaatgcttggcatgaaacagtagggatgagccttcttcaccatgactgtctttaggggaatccactaggctgctttaatgctgctctttatgcttctctatttataatgaagtgctgtgagaccctgtagcagagatagtattgttttttgtttcaatatcaactggtactttttctctacaatgaaaaatgttttgtccataatatatatcacctcgtctctggttttattgttgaaaaccacctgacttgcgctccttttcttttcaacattttttattaagaaaatatttggaaggaagcaataatactaaattgcagaattacaaaagggcagcttatacagctaaattttaagatactctgagggacaaagaaataaagccactgatgctgggtaagaaaaatgtgtgacaatggaagtatgcaatgtgatttacttggctggctaccatgtaggaggaataaattctataatcttgccaaaacctaagggaaatgtgaattgaatagcaataaataaccttattggaaacagttgaatgtgatatactgtatcctctagccttaatacatgaaaatttctcattgattgcagcatcagactcaagtagactgaagatggggcaatttttaatgtactccacaatgtcccttctgttccctgccacaaccttctcaaacttgatgagttagaaggtcaggttaatctatgtatgcaactccaggctttttggcctctttcaggattaaataaaacttatagaaaatgtttttctctgttcctttcattttgttgttcagaagccattctatgtttataaatactgtatgtttagtaacattttaatttctcttattcgactaatgttttaaaggtatgaccactttagaacattttcttattcaaccctcacagtattgctgtgagctaaaagagagtattatttttcttgcatgtttacagttgagaacattcaggcttagagtgttatgtgacttg

SEQ ID NO: 122535 - DNA, 1032 bp, Homo sapiens
ttattgcccagaaatagctggtaaaaaatggaaacagagagagaacttttcctctcacacataataggaaaatagtaaacattctaaagagataaattatcaaggttatgagattatagaaatgatataatttattatgtgagcctataaacattatgaattagaagaaaatttatattttgaagttacccaaaatagaccatatcatgaaagattttctcaaatcctttgtgacagtatgtttctgtcatatctttcacatcaataaatataaaaaatacacttatttctttaaaatattttcaaattgtatcgtagcataaaacccaattctaagttatacaagtatacaaccaatagaagctaattcaaaactttgaaaatgaaaggataggcaaaggtgtactgggaaaatgctatctaaagaaattaggaattaaaaatcttagtatcagaaaacataaaatttcagggcccaaaagcatttactaacacaaaagagggactctataataaatgctgatgggtataatacataatgaaggtatatgatcttgaataagtaatagctttaagagctaccatagaagtttgttcagcaaataaacttctgaaaacatcccaagaaatagaaataacccattttttaggtggtagactaagtttaaaaattcagctcctgtattatgaagccaaatatttatattgaaatttattttcaagacaaaatatttctatatcaaagataattaaaactactcattaaccaaaaattaggtacttaaccagtcactaaatttttttcattatcaacaaaaagaggttccacgtagcttctctttttgaaaagaaagcaagcaagcttccaataaggctgtaaacgtatgcataaaacttttttgatttgaagaaaaatggaatgtttggactccccctaccctaaacagctattctaaacagcaggatataattccagagtttctgcagtcaagaggtttctgctgagcagaaattcttcttcaatttaggaat

SEQ ID NO: 122536 - DNA, 1055 bp, Homo sapiens
catttttcttgaaacactttttgtttgcacttgactttcaggaggccatacccctctaggttttcactttcctaacgggctgctctttctctgcatcttgtttatttctcctcatgtccctaacctcttagagtgtcataaggctcagacgctggatgtcttttctttcctcttctcactcctttaatgatttaatcagtcttatggccttaaataccatcaataggctgataattttcacctggacctcaccctagcgctccaggctcagatgcaacagattatatcacttagattctaataagcatctcaaatttaaagatccaaaacaaatcccaatttttcagttaattctcttccagcaccttttcccatctcagtagatggtaatagtgtccttacaattgcttaggacaaaagggtttttctctcatactttacatctaattcatcaggattaccttgttggctccatattcaaatttgaccacttacccccttctccaccattatcactctttcttttgccacaataatctctcaatggcattatttcatatctttctttgtcctttcctctgcccttgttccctaaagttaattttcaacacagccagcatgatccttttaaaattaaatttaatcgtgtcactccttaaaatcctccaatggctggccattttactcagagtaaaagtagaatcctggctgtgacttgcaaggctgctgtcattccttccccctctctcgtatgtctctgaatgtatcttctgctactcttacttcactccactctagtcagacactgtccactttgtgtcctcaaatatttacactttaaggcctttgcaccggctgatgcctggcattttcttccctctgttatctgcatgccttgttccttcacctcattgatcaaatgtcatctcagtaattgccctgccctgcatgtgttggtagagagaaaggaatttgtagaggaatcccaggggtctttgtggaggtcccacgtggatcctgggctgaaggctgggctcagggagaactctcctgtg

SEQ ID NO: 122537 - DNA, 1055 bp, Homo sapiens
ttgaagatagagtctaagtttagaaattagagcgttgaggcacctagcgtggctttaatacttaaactttgtaactttggtgaaattactaattcgacctgagtctcagtttcattagaaaaatggatgtaataaatacaccctgtctaattgtaagaattaaagataatgtatgtagagtcccaataacagtgcagtcacctacagagtactcatgccaccaccaatatttctaagatttttctagggaatgtcttgtatgcattcaataacaagttctaatagttattattattattattatccttatttcttcctctccagtgaaagattacaaaagaaaaggatgcaaatgaaaaactaacaacttgatgtgccgtccattgttatgaaaaaggatgagagaggcaatgaggctctacgcccaattgggataatagtagagccactaacaacaacaacaaaaaaatagtatcagatacttaaagacgtactcatacatgtatgcaaaggaataaagtatgtttattacaatcttgtttgtagtagcaaaagactgggaaaaacttaaatgtccttctgtaaggacagaagaaataaattaaggcatagtcatacaatggaatattattcaatcacaagaaaaaataaaatagaactttaaaatatgaaatggtttccaaaataactgtcaagtataaaagcaagatatttatactctctggaaaagtaacattttaatttgctcacctgtgctacttatgatatatgtacccagggtaccaaaaaagagaaaaaaagtagaattaaaagatgagaaattgatgttgccccttaacaaagacttccaaaatggccttcacaaggcatcagcaagacatagccatagactttgaaaatagcagtgacagctggtaaccagaagctgtactatataagagtcaagtttaccaaaaacttcaagataaaaattattctcctaggcagtatttgtctgtagaatcattcccaggagtaatatctttgaatccaaaagaggggagttatctaaatca

SEQ ID NO: 122538 - DNA, 1078 bp, Homo sapiens
tgcagttgtcttcttaatcagtctgaattgatggtcttcaattttgctgactgctgtgctgctaaaggaaggcaaaaaatatcccttttctatctctttctttcccacttgagtttccttagaagtattgtctttattccttgagcaacaatggcttggagctgtcagaaaagagcttcatgagggtgcatgatttattgatgctgagtgggctgagaagtagcagcccaaggttgggtgggtgctaattgggttgttgtgatccctgcacggctgtctgctcttgtgaggtctgagtagatctgaaaagagagttagggccacgacacctctcataatggcaagacactaattagctgtgaattacagcagcgcttttgaatattacatattatatgtggtagccagagaatctgtcttcattagatgcatgacagatagttttagtgaccttactcttatttgtcattggtagtgaattgtttttctgatgaaaaataccaaattctaactgcatgtcaactggtttggctatttcttgacttcaatcaattactttaaaggaaactattattgttattaccattaatattaatttactggttggtattctataagcattagtattatttattgtttaaagtacacttaaaaaatgcactttagggtctaaaattgagctgcagctgagtttttcagaggagattctgcattgaatactgtgattttacttgagacaactctgcacgtaaaagcctacagagtagtagagctttcacatttttcgtcagtgaaacctgttcagcaccaagcaataatatattgaagataattgaaaagtgactacattgaggccataaggcaaaagagctcatcaataatattcaaggtgatgcatctaggagttgacatatacttatacctttgtttatttcttcaacggcattcagtatgcccactgtgtgccaggccctctagtaagtgaaaggcagccaagaccagcaaggcacagtccctgaactcagtctagagaagaattacaatacagttattttgttgtgagacaagagagggcagg

SEQ ID NO: 122539 - DNA, 1003 bp, Homo sapiens
aggaataggttagccaggttcaagggtctcacaacatttagaaagattgtttttaagaaagaaataaaaaaaaagtcttatagagagatcagtgacacttcataaacaagtttgcaatgctgtctactagtataaatgaccgtacgttgatctgccagactcattgcccggctgtttttgccagggcacatatttgtgagacagctgctccgaactagggaaggtcaagcaaaaaccactgcctgtctagagatggctgtcctgatgtcagtctcattagttcctgagttcttgccaagttagtaagaactagcatagatctggaggtcaaagtttagcagaaagagcccccacagcagtgtgcaaagagctctttttctgttctactctttttttctctactggtcacctagttggtgtgtagcgtgtgtgtgtgtgtgtgtgtgtgtgtgtgtgtgtttcccaaatagtacttgaaggataggaaattaaatgtctgtgggaaaaagcaacattttgggttctcagcattttagtcagctgctttcttacttttccagactgtgactattctttgaagctattaaaatctattcttggtaatgagaaaagggagtgacttgatggttcttttccaattgctctgtgtctgacaagaaatacctaaatactttaatttgcctttttaaatttcccctagtggtggcaaaacaattctactcctatttgtcagggaaaaaaatctctgccgtgaatttcagtgctgggaacataacaagacaaaaagctacctgggctagcctgtttctccaggatgaaacaaaaggaatatagattttagcggctgctttaacagtttggtaaaggatctggtctatcttgggtgtgggagatgggaggggtaaagaggtcagaataccatttagatcacagacagaaagaaaccaggaagtaaggggaaattattacagtctgttcatagctcagaatgttaaaggcaaca

SEQ ID NO: 122540 - DNA, 1114 bp, Homo sapiens
gggtcagggggactagggctgtccttgaagatctcacgtcgtggaactttctctgcatgtctttctggacaccagctgattgtggacacagccacttgatttggtacttgcattttttttggctgcatttttctgtttgcacgatcaaccacccatcagtgtttaaactgcaatctgggagagatgcgtagtatatagtgtagtgtattgaaaggaacactagttgaaaagtcattaagatcttagccctagttttaccttctatcaagagaagaaaatacatatttattgcgcatcgactacgtgctccgtgcactttgaatacattccagtcctaccaacagtctgcgaagtttgggtcctcactgtgccctgagggagggggacatggagtatgcatgcttccagacctgtacactcaaattaattgccctccctccactattcctttggtttcccaattcccaaggaaactaattttgaaaagttaccagatttttttagtccaagatctaagcatccagacagaaaaagagctggttatgagtacagtggtgaaagcgaggactcctcagccagactgcctagcttaggacaccagctccactgttactagctctgtgacttcgaggaagttacttaacctgtgctgcttctcagtttccccatctgtaaaatggagctaataattggatttacctcacaagattgttgcaaggattaaatgagtaagagatgtataatgcttagaatagtaccttggcaaagacaagtgtttgcttttatggttaccacccaaactatttggaaacctcacagtttatgggtagaactctagatcactggtgcagacatcagccagggttgtgccccattatgggcacccgccagttcctgcacccaccagttcaggtacacgttaaaggtcaaaaaagagtggctgcccgaatttctcgtgtgttttctatgcccagatgctaaatttttttttaaatgtcctttttctgctgttacactttcctgctttcttaccttacaggtctggtttccttagtcacattgagaattaagaaggcttttttactgcttgattctttggccactgcttccccta

SEQ ID NO: 122541 - DNA, 1048 bp, Homo sapiens
gagcccagaagctaaaaatgatctatttgtgtaaatagtctaatgtgctttagtggttagatacctgctgagagtttgaaaagagaaattcatgcataaaaacaggtgtttatgaaaaacccctgaaacgtcagatcaggtcaagaaaaactgagagtcatttacaaagttttaacaagggctttatattctgttttccgttatacacaaattgctacattacttgaagagctcatagtttcgtgcgccaagtgcttaatgacatcacctgctttccatagtaacccagctgagttaaaaatatagaatgtcttggccccttgacctaagatcttcagggatcttggctacccaatgggttctcaaccattcacacatgttagttcctactctgtttacaacttcagctttcacatgcagtttctgctaagttggaaggagaaattatagcaaattaaagtgttaattagagaagtcacagggtaacactttttatttagatctctttgttcctctgtttgccatcgtacttgagaacaactccacagtcaccatctatagtgtacaaagtaaagtacttgtagggtacacgagtacctgtagaatattaagtacctatagggcacctgagtacctgtagggtctgtgtggcaacacagaccaccaagaaacccatcgtcaaaacggatacttatgcagctatttaacttaatcatactaacaatgaaaatacatcccagtaatgctgggcccttgtctgtttagccattgatcaaataattgtgttacctcacccacagacctcttccctaatagtgcaaagatgctaagtgagtcttcctgccatccctggttcctgcctcttgcccaccagtaatgctgaccagatcacctggcctttttgcaccctggtttcctctttgcctgctttctttcatattttaaaggtaattgctatttgggaaaaatgtaacaaatagaaaataaaatgtatatactatagagatataataaccattaatagtggtttttttcccccagtgatctt

SEQ ID NO: 122542 - DNA, 1027 bp, Homo sapiens
ctgtctctactaaaatacaaaaaattagctgggcgtgatggtgcacgcctgtagtcccagctacttgggagactgaggcaggggaatctcttgaacccaggaggcagaggttgcagtgagctgatgttgtgccactgcactccagcctgatgacagagcgagactccgtctcaaaaaaaaaaaaaagtgtaaaaggagaacaccaactttcatgagtttctcctggttttctatattactttaaatatatgactctaagtttagaattcaaatatttgggtgtatttaaattaaccttgatttttaatgagttagtaaacggactcttagattttatttgtaatccacaccagactttgggacaactgtttgttagacttcacaccagtaacatgttccctaaggggagtgggtgggatagcaggaagtaaaccaggagtggtgagccaatggtatttgtccctgacaactgtgagttagttcaccacatcccagccacaaatatgcatgataggagaatgagagctctgtttggcacatagttcaaaaacagacgttttcaaacaggggatcttaggctgatggcgttgaaagttactggatttgttctaaaatgtgctagttgccagcagtgaagaagtgatctgagggaaaagggttcaattagagaatgtattatgtaccaattatagatttgattcgtacatcagattgatacatgagaaatggaatgccttttaaatctaatatatcagcaaagttataggacataagaacttctggtttctgtcttgaagcattataatagattgaaagcttctttaaactctcctcctcactctgcagtgagaagttggacagttgtcctcaacagaggacaactgataacagctaactattaaatgtccccaaaagaatttgtttagaaaggtgtgatatgataaaaagaatgggcaacagtgtttcccttatcatacgttttgtcagagcataagatctgagttcagtaactctatgaaatgctaaa

SEQ ID NO: 122543 - DNA, 2053 bp, Homo sapiens
ttttcaagtaccattgcagtgtaaagctgtatgtattgcatttggaaaatgcatggttcatctttgaaaatagaatgtacaatacatgcctaaagggaagatttcttttttttttttttttttgagacagagtctggtgatgggctaattgaagtgattgaccaaagagatgttaaaacatggctctcaaatcagcattgatttgtagtgtactttttccccctcagaatagcaataagagtctattgattttacttttggctatttaattgtagtgtaaacacttaattaaaatgtgtgaaatttaaaaatagttgataaatatattcaatattttaacaaaacatcaacatagctggagtaggtttcgtctagcttaaaagatgttgtcactgaggccgggatttctttctgttcctgtatcctaacaccgtccatggtcacccagtttcccctcagaaggagacattgttattacttgttttcttacctggcccctgacaacagattcacccaaacacattatactccttgctacaggtgataatgttcctgctctgtgatttttatgttaaccttaatttaagtcttccaacaaatgctgatgaaaaaaaaatacacaaaactttgtatttgcttttttaaaaaatgctagaacagtgaggtggtgtttaaaacagtttgaaagtacacagttcatggtgtttatttggtaaacttacagattaatttaattatgaaagggagaggttctccctgagaaatatttggatggttttgatgatggaattaaataatttctcattcattctattttatttcactcatcaaactaaaaacaaagcaccgtttgatttgtttacgcctcaggattaataactcttagcagaggcatcttgttactttctttgacttgcctatgatgccttgtaggtaagcaaaaataatgaattgttttaatatcatttttcttcataagataaaaataaaaaacatcatttaggagtttaaaaaacaaaccataaataaccatatacaaccacattgttctttctgtttaacttttactccctgtgctggtttgaaatgaggctggtataacagaatagaactttggtttgacagggagtatacagactttaatattaggctggtgcaaaagtaattgcggtttttgccattactttcaatggcaaagtatgtggttgagtatgatatggccttgaagtatttctacatttggattagttaaggttacaagtagtttgcatgggtttagtgcttataagcattgttagacaactgtcgtgatggttacatgttatatagtttcctaatgtctccagactgctccagatatctgggataatctgagaaaaataataatctttcttattattaatgaccaattcatttagcactttatagtagtggtttttattttttggtttttgtcactcgccaacacaaacatctcttttggaattcagtggccactttctgggtgctctagaggaccattgtgaattaacatggcctaaaatcgtattttaagaatatcatgtaatacgtactgaatccagtttaagaagtttgactaaagcaaacaatctaaacaatttaaaatgactttgaatccatccaaaatcacatgtgtatttacctatcagtattctgcaggtcaatgaaattacatatgagtgaggttactccattacaacataggttgtaaaagcaaaagattagaagcaaggctggtatccatctaaagggcactgggtgaataaacaacactgcatctacacaaagaaataatgtacttctccttaaaaaaaaaaaaaaaaaaaagagggaggaagttgtgtgtgtactgaaatggaaacatttccagggtatatgttttttaaagagcagatacagagcttatacattttatgctatcttttatataaatggaagtggaggtagtgtttatacaaaaaaacaatgggagaatttacaagagacaaatgtattcagttacctaaaggctttagggttgggaatgggctag

SEQ ID NO: 122544 - DNA, 1558 bp, Homo sapiens
ttttccggcaaaactaatgaactttgtttttggagttaaaaaaaattttttttaggttgtagatctcattcaactagttgtgtttcgtttattagttagtttgctggtttaatactatgtaggcactttgaggttgaaaaaaatgtgttccattatctttgctttcacttagcttattatagtctgcctcataagggattactatgctgtgtatagtgcaaagtaaaaaggaatgcgtcttaaggaagacatgggcaaagtaagggaagaggagaccgattacatgtgctaattgcagatatatgaaagaaagcataaggaagtcttcgtggaggcaatggtaatttagagtttccttgaaagatgactttggtcatgtagagataggggagagaagtcagatggaatgacactgcagatattcttattgtactttcataatatttgcttttaaatttcagcatatcttgaataagaagtacacttaagagtaatatccaagatatctatggatatgaagaaagtagagatcagatagcaataattttgtgcttcacgtcctctccccaggccaccccacggccccattacatcacaactcttgccacaaccccttttgttctcctcaggagcccagcttgtgtaagtagcccctggtgcattgaccagccactcactccctggcaagaaggcctgctgcattttcctcatcatagcttgtttatttggatatttttttctctttgcctaagtgcgttcacttcatagcactgcctcccttccaccaaatagacatggaggggaggagaccaggtcttgggctgcaattacatggattatttgggtatgagaatatggaaaacaaagcaaaactaacctttggtaatatgtgtatcccagatatttgccccttttccctctacctcatgttttcattattaatttggtttaaaaatgaggattcccccccatatctcttgagttaattacagtgctctgagtttctgtaaaaatgtcagattgtgtggcaccagtcagttgtcaacgtaacttggttagtggaaccctagacaagtaactgtatggacttccaccttattacagtctttggccactgctatcttggaagctcaggcagtgggaaaagagctatggggacaggttcaaagagttgaaactatgttgaaaaagctgcctgccaaaaatcagtgaagtcttaaaactaaatagttttttaaattagaaaaatattaacatgaattgttgaagagatttgagtccaatgggggatcaagtgtatgtgaaattgcattttttaaagttgttcttttccagtagaccataacaaaaaattacatgaaaccacaagagagggtgtctccctgccttccccaaatttgggctcattttttaacaaaacagaataaaaacagttgaactaaattagaatgttgaaatggtgagagtgggtggaaagatgaaaggcacttcacttcaaacagactctaacggggaaatcaaaaactgataataagaccacccagctgacctgactcac

SEQ ID NO: 122545 - DNA, 1013 bp, Homo sapiens
gttagactgttagagattcaaataccatctctactttttgattgtttagcattggccaattgacacaattacttttaagttccacatgtgaaaataaacttgataatggtatttatctcataggatgttatgcagattcagtgagataatgtataaagaacttagcacaaggactgatggattgaaagcgctaggtaaacatttcttctttatgtttgctaccattgagaagcgtttacatgtaccagacatgccagtgcattgactactttatatacacatgtctacttcattaggagctccacaaatagcttcaccccagatagggctgccaccaaagctctctgaattttgtcatagagggcagtggcaatttatggccccagggcacctagctttgctcagaaaatgtccttcatcagcttgctagtgccaagagtgagcaagctttttctaaatcttccaagagagatcctggtaaataaaagggttatttctcctgtcaaagtgctgggtggtcaccacatcaacaaatagggattcagtcactcacttcctctccaaattgaggtcactgagtagtgaacaacagtttctgggtaacagccatctacttggtaaggttcacccattcattcaaagccacgtaactattccacacagcttgatcctgaaacagaaaacagtcaatgtggccagtaaatgatggcttatatggagataggcctttccttttcaggaccattatatgtaactgtgctcatgccctgcttgactcaagcagcttgtttaaagagcatgccttcttctattcgtcccatacataagaactacaggtggctgggtatagtgactcatgcttataataccagcagtttgggaggctgaggcagaagaatcacttgaggccaggagttcaagactagcctggacagcataatgagacctcatccctagaaaaaaaatttaaaaatagccagatctggtggtgtgcacctgcagtcctacctgct

SEQ ID NO: 122546 - DNA, 1869 bp, Homo sapiens
aattaacctaggtaagaaatttaaaatattgtatttaaatgcgtatgccttgtatttttattcctttggaaatgttaacagtagctttttaatggtaatttatattttgatcactagatggcactaagcacatatagctaagaaaaaataattttttctcaagttttctgaaagcaagtctatgttttcagcattacacactataaatttttttcttacgtagcccataaaattcttcttgctacaaaagctttgtttttctaagtgaaataatctcacatctgactcccttaggtatagtaagttacgagagagacacagcctctgaaattagcagtcatccactcatcaaacttctctattcttagccatttagatttattattatcatctgtttcttaaactgaccttttcttactagtacttcctcttccctgggaaacagagaatatattttaatttttttaaagggctattatatagcctctggcatgttaaaaatagatcctagagattcacacacagaagttcctgtagggcaaaatataaaaagagcaaaaactttgtttttgtttttggtcttctaaatattattctcatattgcaaaatattatttcttttgttagttttggtctggttatgatattcatgcaatatattttctgaatcatgatgctttaagttgcaaataataaataaccttaatgtttaagctattactaaattgagttattttacacaaccagaggttgtccagaagttgaatggtacttccagtggtggttagagttagtcagtgacttaatcagaaatccagtggtggccaggcacagtggctcatgcctgtaatcacagcactttcagaggcccgaggtgggaggatcacttgagcccaggagtttaaggctgcagtaagtcatgatcgtgccacactgcactccagtctggccaacagagcgagaccctgtctcaaaaacagaaacaaaagcagaaacccagtgatgtcatcagggacccaggtttgtttcctttcatatgtccactccgccatctctggtatatcagactcgtgctttgtgttgatgataaccgctgcagttctacatagaatttataatcatgggaaagtccagtagtagaagaggggatattcccccctttataggtttatttttatcagtggtatacattacttcaggatcctgcagcaaagttctcctcaggtctcatttgccatgcctgggtccccagcacttcctaaacaattcaatgacaggaggagggaataactgtgataggtgtagactgatagagacccttgcccttcctagcatcacagaccccctcagaggaagatgaaacccgaaacaatatcagagcactccccagcaaagagggagatggatgtggggaggcagaccacaatatttgctaccgttttttgtttttatttgttcgtttttgtttcacttaaagactcttcttcctggccaggcatggtggctcatgcctgtaatcccagcactttgggaggcagagtgggcggattgtgaggtcaagagatcaagaccattagaccattctggcaaacatggtgaaaccccgtctctactaaaaatacagaagttagctgggcgtggtggcacacgcctgtagtcccagctactagggaggctaaggcaggagaatcacttgaacccgggaggcggaggttgcagttagccagagatcatgccactgcactccagcttggtgacagagtgagactctgtctcaaaaaaaaaaaaaaaaaaaaaaacaactcttcttcctgatgtcctgatattcttgaaatataactgccaagtatttcaagtgtttcacactgg

SEQ ID NO: 122547 - DNA, 1056 bp, Homo sapiens
gaaaccaaaaacaaccaaacatgccggtcaccttgtgtgtattctttacttaaccatccattagaattctccagctaataacctccgttgtcttcacccttttacctccagtgtgctatgcattaaatcctgcttaatatacctgggaaatctctcatctttgtcctcctctccctttccactaggccatctaacccctccccaacctctcttcacttttcattagcacagacttctatttttgagttctttaaaatttcccacatctttttttattatttacttaggcacaaatatatttaatcacatgcacacaatatctcattggcttccattccatatagcatcctaaggctaattgtacagtcttgttcctaaattacctttccatcttccttaactctatctccataaaagtaccctttactcctactgaaatgattgccttttattcttatatcaagtttttgttctcgctattctgtcaacatcagtgtttctcagactttcatgtacacgtgaatcacctagagatcttgttaaaatggagattctgattcagaggccctggtgaaaccttagattctgcatttctaaataacttgtctggtgaagcagatgctactggttggaagatcacactttgagtggcatagatatatgtagaatgccttctccctttcctctctggtgacttcctacctcttatttaaggtcagacatacaaatcacacctcctttgcgataccttccttctgcagctccagtcagagctgtttccttctctgtattgtttagtgctttcacttggctacagttgggaaattgtctgctgaactttgtcagcggatgttagtgctgaggggtgcagctgtctgcaggaatctttctgtctttagcacaattccaacaacattaacagctccccgaatgaaggaggctgaatccatcagcgaactagtcaaccccatctccactaaaagtacaaaaaattagctgggcgtggtggcaggtgcctgtaattccagctactcagaggctgaggcaggaaaatcg

SEQ ID NO: 122548 - DNA, 1003 bp, Homo sapiens
agggtgcaaaatttacatctgaatctgatagactactaattaaaaacttaccttcctcaccctcaattctaaaaaattaacacctaatgactttcattgtgttatttatttggtaaaccgttttgtagcagtaggggcatgatgtcaagcagaggcatgatgtcaagcagatgtctgtctaatcactgaataaatcacttaccagcattgagatcctgggcaaaataacttccttgaaccttattttccccaattaagaaggccacgggattaaaaagtatatacctataagggccttataatatgtaggtaccactgaatgtcagctcctttccccacaaggttcttgtttgtacatgtcctgtagccatgccctaagtgtggtctgcccaactggctactctcacttgattaaaaagtatatgattgtcaaactgtattttcagagaatgatgaggagcaggaggcactgccatctctggataaacctggctggtactcccaagggaacgctgtccacctctatgaacttctgaagaaaatgactggcaaacctgaacccaaggtatttcccagttgaggagaagtcctcagtgcccacttgcagacataagcagttgtgaactgccaaatctctcctcttaattcttctgcttaaataagcctttcctttgtcaatgtagacaggctgtctatctgtgatagagaggagcaaggattccaagcagggcaccacagatttagggggtgtatgagtgtgtaggatgcctgtggaatgttatcctgataacaatctatccaaaaagtttccatatataaaacaaacaactgaaattatgctacagactagcttaaagatacacttgtttttgacagaatgatcacattgttgatgttggacattggtgcatttctaacagcagaaccctttcttctaagaaaatatttaccagaatttctgtgagctgagagatcgtggggtaacagagccctgctccattgg

SEQ ID NO: 122549 - DNA, 1135 bp, Homo sapiens
aatactaaatatgaaaattagaccaagttgttttttaactaccctttagacatcatcatcatcataatagaatagagagttatttttattatagggaaaaaattatgttttctaggttgctttgtttgggctagttttcagataataaccaattgaccatataaaaagctagtttgtgtttaaaataaaggatacttcataataaggaggaaatattattcctgttccaaaaatttaatgtgggcccaaagcctatttgtagattcctacagggtttcaaagtttttatttacttaatagacaaaaaaattatgagattgaacattagttaatcaccattttaattattctgttctcttgtttcagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcaggtaagggggaaaatacctataaagcttcacctgttactagacaataatgaccagtactagaattcttgtctttaagaaaaagaaatgttgccacaacattgatttatctttggggaaaaatcttctagatatggaacctaggtaattaggaccagcacttctgtgggaggcaactacaaaagctcaacaattttttttttaagtcagcttggaggcatattataaaattagggaaagagttaccaggacaagctgctgaggaggcccagtaaggtgaacctggcatttgaggctgcttttccccctgggtatttgctgattccggaggcggcaccacagagggtgagtgggcctttcagtaacttcatgaatctacaggaataggaactggaggagagggcctgcctaaggagggtgggtctggtgaactccctcaatctatgttgaggccttgaagggctttactttagaataaggatgaattgagaagaaatctccattttcacagggactaaaactcagcttgaaatcagctaaatacctaaaattggattgaggagatttcagattattagtgcccctgcacacctggtagaaaca

SEQ ID NO: 122550 - DNA, 1092 bp, Homo sapiens
tcttggggtgaaaaaatattagatatggcttgtggacttccaatatcatcctatccaccaaaatcttattccttagtattaatttatctcattgggaagaaatttgtagttaaaactatttaatgtaatttgaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactgtttatgctgtgatttcactctgtctatcatgggcagtattagaaaacacactggttttcactatctggtttacaaacactatcattattttacctggattgaagtgcagaatttggcatatcgatgcatgcaatggaaagaaaaaaaatttgttaaaatttgtaaatgttcagctaaatctcagatatactgtgggatgagtatctcagggtaagtaacaaaaaaacaaacaaaaaaaatcactgaaatttttccctcacagtcagtagctttgtttgatatttaacaataagtatatggtgatatacttgaaatttatgtccagaatgtcactggaatattacaatgagcataaataatcaagcttaggactaaatgaaagatactatctcatgtatgctttaaatagagaatttatttcttttaaaaataaagctatctttccttatccatgtttactctgtaaatggcaaataatacatctttaaatgcttatgaactactgttaatatgaaaaatgagaagtccaaaataagaaataactgcactttttgggccacttgagtagtggcgggggttcaggaggcagaattcagttgtcagaagttctagtattccctttatcattccacctaaagaccctgaacaagttaccaccaaatttggcttcagttttttccatcttatgaaaggaaaagtttagtttatttctaaatttccttcctttctagcagtcagtatttcttctaatgaatgttttttttctg

SEQ ID NO: 122551 - DNA, 1114 bp, Homo sapiens
gtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacc

SEQ ID NO: 122552 - DNA, 1084 bp, Homo sapiens
agacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaa

SEQ ID NO: 122553 - DNA, 1760 bp, Homo sapiens
ggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtgaaggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtg

SEQ ID NO: 122554 - DNA, 1147 bp, Homo sapiens
aatgtgcctgagaagaggataggacagttcttaaatgcttactctatttcctattgtttataacagaatacttgaatctgggtagcttaagaagaaaaggaatttattttttacagttatggagcccaagtccgaggttgaggggctgcatctggggagggctttcttgccggtggggactctacagagctccgaggtgatccaggacctcacatggtgagggagttgttcatgctagctcaggtttctcttcctgtgaaactatcagtctcattcccgtgattacccatgaatccattaacctattaatccatgaatggattaatcattcatgagggtagaggctcatgacccaatcgcctctaggtcctacctttcaatactgccacatccacattggaggtaaagtttcaacatgagttttagaggtggcagttattcaaaccatagcaaatatgttaaggttttctcatgggattatgttatcttcccctatagtgattgctagaataaaactctctgggagcaccaaattaccagcaaatgtttgggtgacacagcaaaattctttatacctcaagttggtgcccaacatggcaatgaggcaagttatatataagcccagagtactgaaaaggaaaattattttcctatgaaattcatatggtgaattagaatgggaagtagagattaaaatcccaaactcttgaggtgtactgatcgatgtaccatttgatgataacaataatgaagaatgtatgtttcacaaagtcttctcaactctaatgccccattctaataggaaatatgcttttaaaaattaaactgttcattaattggatagtatgtttaattgaaataatttttctttaaagaaaaatctttcttcctagctacttgggaggctgagatgggaggatcacttgagcccaggagttcgaggctgcagtgagctatggtcacaccactgcactccagcctgggcgacagagcaagatcctgcctcaaagtcttttttatgtgtatggtaaataaatgtatcccaaatttctatcatctcactttagtgtttcacaacttctagttatgtatagaagagtggcttgattagttgatgctgaagtcttgcagaaaagaatcaaactag

SEQ ID NO: 122555 - DNA, 1080 bp, Homo sapiens
ttccttcttaaactattttgtgaaaatttaagatccacctttttttctaaggaaacaagtactgttcagggtggattcatcccattatctatgtgctttgttacagtcccaagatattcaccattaaaatttttagacttcatgtggcttgcatagaattattctgtgtaaaatttaaattaagaaatgtcatttgaatgtctgctgtggtaactttaaaagttgaatttcatctcaacttgttaaatttcatcttgcaaatttcagattgttggaccacttccaatatctctttcttaagaaaggttatgtatggcagtatttagactacaaattgccataaaatcataaaccctgcacataaggaagtggagttagtggtgttagggtggttatattacagatcctagggtggttatattacagatccttctttatgtgcttacacctttttttcttgttggtgaagccactgatgtttggttcagtgattgcaagttttagaaaagataaatctgtgttacttgggaatgaatgttttaatatataacttttcccaatgtacttttgaacttggagagtcagatgaaaggatattttactttagtgatagacatactgaaaggatttagtcattgagtaagtatttgccaggtacttctgtgtttgaggggatgtctaggtggagggaagaggggaaggcatgcaaaataaatataacatagtttccagccttgaggagctataaaatctggttggagaagaataactgaatatgaaactttgtgagaacaattaggtgccgaatggacataaatgcagtaggattgcaggaaggaagaggttccaagggcagaagagggggaatgaattgggtctcagaggattttatacaaaaaagaggaaaggagaaagcactacaagcagatcagccagcagagcaaaggcacaagaagaggagcaagcagatatggagcagctgccaggtcaaggagaacttcagggaaaagtcatgggaattcacttatctccattgatgacattctctttttctccttcctttctttgtatattctttat

SEQ ID NO: 122556 - DNA, 1665 bp, Homo sapiens
tttgggtggagaagtatacaagcgagagagaagtatatgcctagattaggagatgccaagaatggggctaacactatgagagcagtttgctaagacagaatgaaataaggacaacttactcacctagataaggatatagactccgcattaaacattcatgaacttgtgcatgcacacagacatgggcattaaatatctggccatatttcaggccctcggagtttttaatttttttaaataatcatacctattaagcacctttcatatgccagtcattgctctgggcacctttctcatattatcattcatcttccttacagtcctgggagatagatatttctatccccaatttacagatgtggaactgagttggaatatttctgcagcagcatgttatttgtcctgtgtatccatggccagcaattcagaaattattctcttgttctacataatatatgtagtctccagcagtctactagagctttacttttcctcaaaaattatttcctgactggtaacatttcatagacttaaatatacaccatattaagttttttttagcaggaaatactagcaattgtgtagatgtagaagaaataataattacagagtattcttttgaattctctagataaaagttaatagtacagaaagattgtttaaatttacaaatagtaacactaatcaagtccttataccaaaccattaaataataattacaatccttgggcatgtgattagacatggggacatgagggaatcactttaaatttcaaaacagagcaacctaaataaaagtcagcacagaaacagtcattcagcagaaaggaaggcttggctggtctggacatggatagactagggagagtgtgaggtgcctaatcccatgcaagatgggccgaaaattttgagatggcatttagaaaaagacccatagaggactcatgaaatctatccttggaatgtcaggaaataatgagagacattcaggcagtggtctgcgattagaggcatgttagttaggcatgctaataatgggatggcgaaagttgggggtaaagcaagtcacctagacctagcagcctgaggtggacttagtgggagctttgtgccttgggggaggctgggaaggcactggccgtgatcacggctctcagtaaactctgtgataatcactcagagtaacctttagagttcaaacattgtagtacattttatctccatatgatttgtcttcctacacaaatttttattgtttcttttaatgtaattatatttatgtagctgtataactatatgtttagttatctctgaggatttaaaagtttacctcttgacgcagttaaatttatccaactaatatatattttttaagtgtttactaagtgctaggtacacttttatgtgctggagatatagcagaaagcaaagtgccctcctgaagcttacattctagatgggagagccaagcacacaaaataaataagtaaattatatagtagattagaaggtcataagtgccatgaagagaaataaaacccaggagggaattagagaatggtaatggttggacttggtaatgatgtcatttaaataaggtagtcattgcagacctcactgagagagtgacatttgagcaaaaatttaaaggggatgagggagcaa

SEQ ID NO: 122557 - DNA, 1345 bp, Homo sapiens
atgttaggaaaaggagataagttacagtgaaagaggctgtagtaagaaatacaggattttctggttttttgtaatgtctactcagattcccagatgattgttcattaccagcttttggttattgtggtttatgtattaatgtctaaaaaaatataccatgtgatgttttttgcatgatactatgtgagaagaataccaagaataattttttccttacttgaacaaatattatacattttcccttagtccaaaattctgttttccataatgaatacaattctgatgtagtatgtttaactctataaaatcagaactttagtaattttcttcctaattaaatttttttgttgtatttttaaaaatctaaattcataagctttattttcacatatggtttctacctcttatatgtttccacacctgtgccatgttcccttggctgacagacactttttttcctttttatctcacgtaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggtagatttttgtcttgttcttcttactgtggtaactctgcattagaaagaaacaaatccatatgacatctcagtggccagatcttcatgtacctctttgtgtatgtgtgtggggggaggtgttatttgttatttgtgttgccagtcttatgaatggcccttagtttcaaaagatgtagtaacttccatgtttaaagttagaaggaaaatatttagatgcagcctaatctaaagaaaaaataatttgctgaattgagtaaagagtatcatcgtgattgctgagaattctttcttccatattcagcatgtatatattactatcatctggtgttaggtttgattgatcccaagtagttaaaacattttgcagcaagacatttcaagtaattaagacttacttgc

SEQ ID NO: 122558 - DNA, 2481 bp, Homo sapiens
tttgattaatttataattaatgcttcatatgcttccaaacagatatgggatgagttgattaaacaagggattctacagatgtttttactcatgcaatttttaaatacacatttatggttcaattgcaataaaagaatttacagattgatgaaatttttttaaaaaattacataagctgcctcttgtcatagggctagagagagctcattttaaatgcttagaaaaaaatcagtgaatgcacctaatgctatgatgaattacatcttaacatatcacaggggtgaaggatggtggtttgcaagctttccgataaatttctggaattttgtaatgaaaagtattatgcaagagttggcattaaatccatatcagagctgatattttaggcctgttgctaagtacatgtagtcattttgaagtttataatattgtaggttgaaaagaattttttatttgatttatttcaaagcttagccatgtatgtagttgtttctgactttgactgacattaactgatcttattctattcttgacaccaagaaagaaaagatgtatgaaaacttatctgatatttgaattaccagattacattatcaaatgctacagtaactcactgattgatttgttcaattagtttaaaatagcaaccatatttacattatttagaaagaaacctttgtcatctagaagggtactttaaagtcctttttgttttagataagtagattttggcaaattaagaaattgatgtaaatgttccagagatagagcctgtagagaaccgtgtatttaatctcacaagaaagtaatggactgtgaaataccatttttgatggagattgtttagcacaatacagtaacatgagaattgtacaagactagtacagttttctcattataatgtaaaatatttgggtatataaataccaatgaatgaatgctgccattaggatgagactccttctatgaaaagagaaataaataacttgaaagaaatattataatttttacatagtttccacaagtccagatttattgatcactggaggtgtatagaaacttactaggggtctagtactttattcatggcaatattgatagaaataggtataactctaggccattatctagtaaactaaaagccaatttttgacttaatagagctgaacagttgacttctttctcttgaccttcaaggtaaaatcttgagaatttacctttacatctggtttctagttgcaaaagtgaacttggcttagaaagttgagctacttgaacattttgttttggcaggtactattattaagttgtgttgtttaataacttcacagaaattttaacttcttaaaaactaccacacccaacccttagacttttaaactttcatttagatttgtggttgaacacaattacaacacaattatgtgctgtaataatttaaaacaatgttcagtgattttacagttcaactacctctgtttcaattgctccattaaatcatattctcactatgtaccaagaagtacacaatgagtattgtcattgacttaggatataattcacctatatttgatttcagaaaaaacaaaaacaaaaaactagctgttacttacaaaagagatcaataattgatattatgaaagtaaaaaaaaaaaaactttctacaatagcttcatcaggctgaatgcattttccattttctttgaagagcatttttactcttttgaaagccagttactaagttatgttcattcactgattcatttgatcaacaaacgtttattgagcatctactgtgtatcatgcactgtgctagggtgctggggattcaaagttgaagaaatagcccagtaattttataatttttacctatggcaaagggtacaaacattgggttcttaaagcctaagctaaggatattttctctgctcagaattgagtgtgtggatcatttcataaggagtttccttagttttcattcatgacttaaacatttgtatcatgctgcaccctagtgtggtagaaaagcaccaactctggagtcacactgcctttgaatcccagctccctcactcttcagctatgttaattttcttaattaactttccagattaattttcttaatttgcgtgagcattagtgtcctgatgtataatgtggcagtaacaaccctatctaccttatagggttgctaggaagattaagtgcaataatcaatgtaaagtacttagcacagttcttgtctcatagtaagccctcagtaaatgagaataatgacaataatggtaattattgatgctgttcttttacctacctagtaattagaccctgtttggtttataatttggtatatgtaggctccaaggaaatagtatccatttaggattttactaatcttaattgctctcaaaactagaacatctgtttaactcataaaattttccccttggctttttccattaaaacgttcattgatgctcc

SEQ ID NO: 122559 - DNA, 1042 bp, Homo sapiens
aggatggatatatggggtagcccaggctacttttttcctaatctagcttaatcctttggtagaattttgcatgtgtagaaaaatgaaatgactgcctgtccaccaggcagcctccctataccttatgaatcttagccaagctcttggtagatgggttgctatgagcttaacattacactcctcagcaaattcttagtgattttccggagctaaaaacaaacaaacaaaatgtactcaaataattattggaaaacattacagatcctgaatcacttaagaaaggtgcagttaagtttaccatatttcacttaataatatgggaagatgaatgcatttaaaagaggtttaggataggattgtaactgagatcacttattgttcaagccctggttgataacatagaattatacagcatccatttccaagcagcaggcttttcatggctccttgtcttaatttgtaaaccctgaggaacaggtctggcccagtggtctttggatctgtccttgcatcttggctctgccattgtgttagccacatgtcctttgacaggttccttacactctgtaaacttggttcttcatctgtaaaatatgggttattcctcccacacaaggtcatcccaaggattgaatgaagtaatgcatataaagctcttagcattatgtgcctggcacatagttttactaaaaagtttgttattattacacaggaatagttacgaatatataactttattctcgctaggtttcttggtacacagtactccattttagctatgttgtcactctggagttgtgtttttgaaaagtatttgttgtgactctttagttctctctttatagtatttttccttacttatcatcagacagaaaataaatcacagaggaaagaaattacttcactcttgcattggagccagttagctacaggaaatcaggagaactggtgagggaaacaaagaaagttgaacttttggacagagaagtaattgtgttttttttttttttttgcaacagactgagtattaaattcttgcctg

SEQ ID NO: 122560 - DNA, 1111 bp, Homo sapiens
ctgctgcagagacttaaaaatactatagaagggtaaaataacttatgaggctttttacaacgatcaaattatttaaaatttacagaaacacacagccattgggaattcacttcttgaatgccgtttattaagcaggttgttgccatcagtgttacaaatggattcttgggcaggaatcaaggtcaggtgccctgtggtgggaggaagcagatgaagaggacccgagggagaggcataggcaggtgtacagattagttgagcagcccagttacagtgccattggacagttgtgtggtgcacagtcacaccctaaataggatgttctgctcacctaaattgttaggactcaactaatttaaactcttccccatctatttcaaatgcaggtgaagataaagttactctaataatgcttctttctaacaataactttaaaaatgttatgacagttataaatcatacatgattgaaaggaaatccgaagttaattttctttgtaagatatgtttattgactctaagattcagtattggtatgaccctcaagtcatctctgcgatgggtgactcacttgctcgcctacctcccgccctttcagtgtcatttgatacctttttaaatgcaacatgggcgggctttcagagttgtcagagggaactgtgctcaaggccagaggagttctcgtccctctttaattggggtataaatcagtgcccctcaccccatatgaacaaaggcaacatgaatatattaagtttcatgtagtctttacaatctgggtcttaaatttttctaacataaaaatctggcaagcatgatgtttgaattttgtggatgtcttgcctcattatcataagggaaaatgttagttggcaagtgccgcatgtatgtctgtattctctttcattgatacttcataatcactttttaaaagttggctttattttttggatgaaatattcacgcctaacaccacttaagatgtagggtcttgctgacattaagttcatgctaatgataacttgagagtaataatgacatgagtatgttcatggagtcctttataaagctgggtagttccttttaccttaggtatcttaagaatggctttt

SEQ ID NO: 122561 - DNA, 1043 bp, Homo sapiens
cccagtggtccagttggaccatgtggcactggtattttcaactctgccttcagtttgggcagtaatgagtttgcagatcagccctgagctggcctttctgcctacagactgatttataccttgtcttccacctttctctccaaccctatccagactgtatgatccaccttaacttcttccaccattacatgttctctagcccctcatccaacccaattcctatagttactttttatttaattcattggtttgcagtcataactgggttgcctggttttctgaccaggagtgtacatcttctagattcggctccaaagaaacttctttctagaaaatttccagattccatcttctatacccaccctccagtgtgattcatatgttccaaggaacccatgcaaaactgttataggttgttttgcctgcactgcaattcttggtttatttgtctcctctactggcacataagcttattgagggtagccccagcatttttcggggttccaagagccacatatggtatacctgccacaaagacactaattaattatattgaatgaatggatggatgaatgaatgaataatctgtcttatttttattgagagtctaagcttactgagagcagaagtcctggatctgtatacaactttgaaactgatttggtgccctgcgtactgtggctgctcctacttatctggtctcactttcactctgaagacgtgcctgtcatcagccgtttgtctgtcagcctgtaatcacagagacactgtacctttgacgtacttggaggccagtaggaagaatgtcaggatttgacatcttggtgcatagctcagcagagaatctcagattacctggtctttgaagtattcctcctgcacctggccttctctcctccctgatcccttgaattttggtgttcatcttcttacatgcatgtaatgtccatgtgtgctccttatcaggtaactacaacagagttttgtttttattcactttaaagccacctgcttcagtctttgaaatgaatggcggtgctgtt

SEQ ID NO: 122562 - DNA, 1196 bp, Homo sapiens
agtagagacggggtttcaccatgttagccaggatggtctcgatctcctgacctcatgatccgcccaccttggcctcccaaagtgctgggattacaggcgtgagccaacacgcccggccaatataagtttattgtatacttgctctgttctgggtattttattaggcattggagatacaaaaatttcaagacgtgttatgtatctcttttgcctggagttgttggtctatggaagatataaatactaatactattagcatattaatactagtagtgggataagtgctgtgactgggaaactacagtgtgtaatgggaagatctaggaatactttgcccaacattggagtgtcagggaaggctttcctgctgagtcctgaaggacagataggaaccagccacgtgaaggggaaaaaggagccgtgcttgactgttcaagcacaagtagctgctgtacaaaggcctggagataaaagaaagcagagtgcttttgaggaactgaaaatttagtgtagggaggaaactagcaagtgttgaggctttgggtagagagccagatgctgccaggccttgtctactatataaaggagcttggacttttttttacaagtactgtgaagccactgaaaggtgtaacagggcagtgacatgatcagatttatgtatgtacgttaaccttttcattgaaaaataaaagtagaatattatatgaataaatgtgtagctgataaagtattttgacgcaaacaccctggtaagtacaacacaggtcaagaaataggactttgccagtcactccctgaagccccttcatgggccacatcccagtcccagttccctcccttcccacaaagactaccctgatgccccagtgcctacaggcgtcatgtccttgtgttcccttatagttcatccaaatgtgcatctctaggcattatcatttaatcttgctcattttttaaatgtcttttaaggcttcaaaaaaaatctacaggccgagcgtggtggctcacgcctgtaatctcagcactttggtaggcagaggcaggcggatcacaaggtcaggagatcgagaccatcatggctaacacggtgaaaccctgtctctactaaaaatacaaaaaaattagctgggtgtggtgacacacgcctgtagtcccagctactggggaggctgaggcaggagaatggcgtgaac

SEQ ID NO: 122563 - DNA, 1063 bp, Homo sapiens
gcctgggcgacagagcgagactctgtctcaaaaaaaaaaaaaaaaaaaaaaaaaaaaaaaaagaagaagaagaatcttgttgtgggagtagattgccaatgtcaaaccaggaagtcaagtaggcctttggtgtttatctaaatgaaaacctagaataggaaataattgacaagttccagtaataaataattagcattcataagacttgacagttgtatttgagggccaaaggagacaaagaattttctttatgggatggtgggatctctcagtgggcttctaatacttggagctattgaggaatgctataaataataaaggtttggatttggatatacagaattgaagtgcctgtgggcccaagaggagatatccaatttatatctctcaagctttatttttagctgcttcctgtttgccagtggtacactgtaacttaagaatgggtgtgtgtatgtgtgtgtgtgttgtgcgtgtgtgtgtctcagtcataaaaaaatatatccaatatgaaatatgctttcaggtacaatatatatcctttctgttgatgatagaaaaatgcagaaagtccaaaggagatcgtatttagttcaaattatcctgctacaataaataaatgaagaatagctggaagaatgagaaatcgaggtgctgatacagcactgcagccacgtgggtgtcctcaaatcactttctggagctgaagccaaagaaacattgtgcaggctgcactctgggaggagggcatcagcttgagtgagtcgtgctgctgcttctcaagttgaaaaagaaaaaaggttcctgatgaagtgtagatagctattagggcttgtaacaacttagtgagcaatttttagttcatatctgtgattcatttacagtgagttcagtattacaagaaaaaaattgggaaatgaagagataagaataaataaaatctgtatgtattgctaatattttatattaacttcagcatcttcccattctaaatcataatttctagaaaccacatgaagtttactattttacctttttccaagagcctgttgatatgagaaat

SEQ ID NO: 122564 - DNA, 1028 bp, Homo sapiens
tatgattacattcagcatttggggtcaacttttattttcagtatagcagtaactctagatctaaaactggggaatgtgtttaatgcctggggcatattgaagttagctcacaagtttggctcataattttaatttatttattctgtttttttggcaacataggagataactataccccacaacattttttatgattcacaaagaaaagttctaaattaacttttatccactgtactgccaaattactttttaaagacatattctttgaaactgtattcccaggacaaaaaataaatattatgggttcagggtgttgtcacaggcattatttcattatttctcttgaatgtaagtggcttcaaagacaaacaaaattgttttggaggtcaagggatgtttttcttgtttttttttttccacaccatgacaaattatgctttccttcctgaattgactgagcccatttagtgtcttcatgcctgcccccttcatacaacaccatctgccctctactttgaacattctgaacttctctgatctcctgggttcctcctgatgatctcacagtgagaattttgtcttagtcctggctccagaccctctgctgggaagtgcctgggcagcctggatttcaacacagctcctcccactgaagcagccctccatgccagcagcatgcctctgatgggtggcttattttggatcacatttaccctctaagacagtggctttgaaactttttcactgtgacctacagtaacaaacaacccagtacagacataactttttttatttgtttctagtttttaattttatttttgtttctaattttattacactgtttatttttatttcaacttttagatttagggggtacatgtgcagttccatagtatgtatattgtgtgatgctgcaatttgggattcaatttatcctgacacccaggtagtaagcataatactcaataggaagtttctcaacccttgtttccctccctccctcccccatctagtagtccccactgtct

SEQ ID NO: 122565 - DNA, 1059 bp, Homo sapiens
agaaatcagttggaaagaagacaggtgtgaaatgtttaaatgattacaccatagttacagtaaccccagagagtgaaataaaagataccatgaaaagcgttatggttaaatataaaatgagtatattaacttggaattcaagaaagcagtgttctttcagtaattttcttcatgtaactttgaagatggataggagaacttaaggggaaattaaaaaacattccaggcaaggtattcgggtggcagaaaaaaaatacagggtatagcttcaattaacagtatcagtaccttgtattcacagagagttgcagtttacaaagtattttggtagacattgcctcatgtcttctgaagagggttgttgtaaggaacaaataaggaaatttaggtaatgtggtatcctgggaacagtgatctgattttaggcatcagtcacattggtatctggtgggagatggaagacacacaggaaaaggatgaagataattagaattttaaaccagaatggtagagaatggaaattgaaaactatccagaatattgacatatcaggtatgatgctgggtggcagaagaggccagggtatgatgatcagtcacctctgcatacccaagcctgacagctgcattgcccccattagtcaggagccaagtcttagcctgggacctatatttaggcccagagctggttagatctgggcctctggaagccccacacctgccacatagtaggccatggtagcgtggtcaacatgtttgtggaagtaaagcaatgtggctacacccacaccaggaggcattgggcttaattttattctcaagggttgcgtgttttaaaggaaaaccttaaatctaaagacctaggttgagattaaagttgtgttcatttttagtcatgtgccagaggtcttgaacaagtcagcgtttctgttttggggcaatgatacataattgggttgttaaaaggattaactaagattctgttcagtgctgtgtaagttataaatgttatagaaatatgaggagttggccgggcgcggtggctcacgcttgtaatccc

SEQ ID NO: 122566 - DNA, 1049 bp, Homo sapiens
gatctccgctcactgcaagctccacctcccgggttcacaccattctccttcctcagccccccaagtagctgggactacaggcatctgccaccacacccggctaattttttgtaattttagtggagacagtgtttcaccatattagccaggaagaacttcctaacttacatcatggactgtcacaacctggattacaagatgttatttatacactgacaagttggagttttacaaaacgcgatttgtaatataaactagttagataactcagagggttttattggccatatttttgtttatgctttgtcacaggctttagtcattgcttccatgtgttttcatccttcaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccaggtatagtgaggagtcagaagtgtgaaaacattaaactattgtaattttttctgattatgaaaatgagctagactaggcagagaaattaggtccttagagtttgtcatattgaaattaaatagatttttttaatcaaagaaaaattgaattcaagagttgcatatagccagaacattttggaggctaatgtgagtatttatgatttaggtattataaagtttggagggttatggattaaatacaatttctaggcccctcaatactttttttttatatatccaaacttgagtaatatacgaactcatcttcatcattgcaagcaaaatataaacatttgtgattacctgtcagttttcctttatatgtgatccctgatcaatcctattttaatttttggttttcagttttttctttcaaactatacagacatgattcaaaatgaaagattacacctacacat

SEQ ID NO: 122567 - DNA, 2968 bp, Homo sapiens
ggcccagtagtttgaatggtcactctgacatcatcaagtgaagatagtccatgtagagattagagcagaaatcatttcgggcccaaacccaaggatcacaaatgataaagaaatattcctcttccagtcaccaagggtttccctttgtgcatactggttgtccttggatatttttagaattgtccctaatatactctgcactgccagtgctctgggtagcatttgtgtgtcgcatcttccacattaccatgttatgtgttattttcactgccatcagaaaaccatttaatttttcaaaattaatttcaggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaa

SEQ ID NO: 122568 - DNA, 1053 bp, Homo sapiens
aaaaattaacaagcaacaaatgaaagataaaactcctacatgtaataaggaaaaaatgcagctaagaaaggtgaaggggtggatggggaactgtttagaaagactggtcatagaagatgtggtggagacttcctgtactcgtccatgtcaggttctctgcctttaaggcatgggaaagaaccatacttcctctttccattgcagttcggtgaaaccttgtggctagttctgaacagatattggtatttgaagcagggtgctttattaatttaaaaaccctaaaatatgtggcatgggcttcgcagttcagtggtggacagcatagaaattgataatggaggctagatagatgacaattcttgttatgtggtggttggtaaagccaacttctgtattaacttggaggaagattatgtagctaaagaaaataagactctaagggaaaggattggaaaataatgtgtctactgtgtgttagcaactactatttttttaaaggaatataaaattatttattaaccactgttcaccagtatttacaataaagtaaacaatatacagttgaataacattctgattactacaaagttgttcttcctggcttttgctgaaccagtaaagcaaagtgaagattgagcctacatgtaaggaatgagttggggtaaagaaaaaacatgcaggtcaataggttagattacaaaaggttgttcacacatttgtagcagcaggtcctaaactgccaacatctctaaccatctgatcaggtttctatgagccaagtcttacatattccattcatcattaccttttagtcaatgtagtaacagggatttcaacattttgttagggaatggcacactagggaaattttttaatgttcatttaatttagttttgtttagctagttaaaacacactagcatttgtctagtttcctcatctggatgaggaaaactgctgtgatggcagtgataaaatttttccttttaggaattttgcaaataaaccactgcaattatagatgatttaaaattatccaatttaaattgtccta

SEQ ID NO: 122569 - DNA, 1034 bp, Homo sapiens
taagtaattctaaataggacaatttaaattggataattttaaatcatctataattgcagtggtttatttgcaaaattcctaaaaggaaaaattttatcactgccatcacagcagttttcctcatccagatgaggaaactagacaaatgctagtgtgttttaactagctaaacaaaactaaattaaatgaacattaaaaaatttccctagtgtgccattccctaacaaaatgttgaaatccctgttactacattgactaaaaggtaatgatgaatggaatatgtaagacttggctcatagaaacctgatcagatggttagagatgttggcagtttaggacctgctgctacaaatgtgtgaacaaccttttgtaatctaacctattgacctgcatgttttttctttaccccaactcattccttacatgtaggctcaatcttcactttgctttactggttcagcaaaagccaggaagaacaactttgtagtaatcagaatgttattcaactgtatattgtttactttattgtaaatactggtgaacagtggttaataaataattttatattcctttaaaaaaatagtagttgctaacacacagtagacacattattttccaatcctttcccttagagtcttattttctttagctacataatcttcctccaagttaatacagaagttggctttaccaaccaccacataacaagaattgtcatctatctagcctccattatcaatttctatgctgtccaccactgaactgcgaagcccatgccacatattttagggtttttaaattaataaagcaccctgcttcaaataccaatatctgttcagaactagccacaaggtttcaccgaactgcaatggaaagaggaagtatggttctttcccatgccttaaaggcagagaacctgacatggacgagtacaggaagtctccaccacatcttctatgaccagtctttctaaacagttccccatccaccccttcacctttcttagctgcattttttccttattacatgtagga

SEQ ID NO: 122570 - DNA, 1142 bp, Homo sapiens
gtcttccaaatctcaagtcataggaagagaaaaacattcataaaattctaggtttggagatttgatttgtcggctgaaacctctttctgttaatgttgattccttacactggaaaattcctagactattatttgtatgagtgagaatttcttttctgattttcaatccaaaccacatggaaagaaggttaaaatggagcccgtgcactttgaatttattctcagcatttaggctgcagtatcacagcccaatttccaccagtaggaggcattatctaaacatgttgagaaatattcattcctaaggaatgacattgtttccttatctggctcaattcagtctgagaaggactgttgtttctgatgaagaaagagctccaccctcggccactgccacagctgctctgccaataacaaaggcacagcattttccctctgtgcatctccaacatggatgcttttcagggcattttaaaattcttccttaatcagaaaactgttattggctacagcttcatggctctgctgaccgtgggaagtgagcgtctcttttctgttgtggcttttaagtgcccctgcagcactgagaatatgacctatgggctggttttcctctttgctcctgcctgggtgttactgatcctgggattctttctgaacaataggtcgtggagactcttcacaggctgctgtgtgaatcccaggaaaatctttcccagaggccacagctgccgtttcttctacgtcctcggccagatcactctgagctcattggtggctccagtgatgtggctttctgtggctctgctcaatggaactttctatgaatgtgccatgagcgggacgagaagttcaggactcctggaactgatttgcaagggtaagcccaaagagtgctgggaagaacttcacaaagtatcttgtggcaaaactagcatgctacctaccgtcaatgaagaactgaaactctcccttcaggcccagtctcaggtaagaaaagacaaactcgcctttttctctcagcatgagctcgaagtattctctctgtgctcctttcagccagggctgtctgtgtcctgtcagaatattttgaaactaaatggaaactgaaacatgatgcagcattgagactatctcaggaaa

SEQ ID NO: 122571 - DNA, 1101 bp, Homo sapiens
agataaaacatatcaggctcccaaatgtcttgtgtcttttattgaagaagggtataacttacaactcttatgacagaatgattgatttatggtgtatgtcctcagtcaccaggctccattcagtcagtggcaggcccaaacacttatcattgtgtgagcttctcctctctaaacacaggtacaaggaaatcttgcacatcatgtcatagcttaggctgagcacactgacctgctgattcttcatcagaatgagaaggacctggggctgattcctgtgggaagatgcataaggaatgtgggcaagagaacttgtatcaatagcaggtgctgactacagaggttcagataggcaggaggcagcatatagtccagaccaacaataggtgtacatgtgcctggaggcggaaaagaacattcatccatgggtggggcagataaaaaatctagctggatgactctctattcttaaggaagatagaatggagtagtggaaagagctcagtcttggaattgtctggcgttgggtttgtatgctgatgctaccaatcaccagctatgtgacctagaactagtggttcgacctctttgagtcccagttttctcatagttagtggtaatatcacttactttggagagttgtcggaagatttagagatgatagatacaaatgggcataaagcttctggtacacagtatttgttccaagtcaatgaggaaaactgccatggtttgggggaggacatatgcaaaataagacacttttgagggctggtatggaagcatccaccaagctctagtttgactctgggtactgtgaattgagggaaagcatcggtcaatgcaaacgtcatgtgaaagggggaaggggacctgaagctgatggaatagtttataattcagctggaactggctcaggtactgagatgagatggcgtacagaagcctcagctgtggaaaaagaggaagacagacgatgaaggaaggaggaacatataaggtagccaaccacaatccattcagggactttcacttgatggtagttgtgcctcactcattaattataagtacagaaagatattatgagttcagtaacacatttac

SEQ ID NO: 122572 - DNA, 1015 bp, Homo sapiens
cctgaaatgggtgacattagtgctacaagtaaaggaacattttgttggagaagtaaaaatgatcaagaggaaggaaatcaggcctttgaaggaaggtgcaaagagcagggacagttgtcttacactagagaagggtgaaggtgatgaatattctcctcattgacaagaaagaatcttgcataggagtggaagtggatctttttcctgttcactgaggacagaagacacaggaaggaattcatcagaatggttgataagacatgaaaatcttagagaagggatatttggaaagcagatgttgtacatttttctaataggggagaatcaagcagacttgtttctaacttggtgaaaattgtgtaccattaggaggtcaaatttcgttagaatcttctttactcttttaaagacagaatatggtttctgaatataatttctaaatggggaacattctgggtttttttcatgggtcttttcctgctgagatatgaattcattttctttcctatgctctccatagaacatttcttactcgattcctcttcaaccttttcttttttaatctggagcattgaaagaactcttgttctatttccacatattgaagacttcattgtaaggtaaagcgagtagttcctcatggaagggactcgaggagcccttaaatgcattgggcaaggtgaggagcattcgcaggctacctcctgcagaagaaaagcaacttcctaaggggcctgaacaaaagtctgctttgattccttctttctccttcctcccctcttcccttcctcttttcttttctttcaactaatttttattgagtaaatacccagtaagaagtcctacattaggccccacataaatatgtacttcctattggcatatttaatttggctttcagctctgtaattttcctgtggctaatagagaatggagaatatcctggtcgaggaccacaggtaacaagaaagttttacatgagacttcttagccacctctgggaaggattcatatg

SEQ ID NO: 122573 - DNA, 1141 bp, Homo sapiens
gagatggcagtttcttaaggaaatttcctggaaactgtcagagggcatatctacttccatctttttagtgggaacttagtcatttggtgagagctagctggaaatgaaactgggaaatgtaatctttattctggtagtcagtatgctcagttaaaaatggcataactttaagagtggatattgggagacttttagcagtacttcccaaaatcttttttctttgccgtacttgcttcacgtttttttctctatagtggcaactttatgtagtgtccttggacaaatcacttagcctctccaagcattagtctctgtatctgtttaatgagaaataatgtaagtgaaaataccttataccttataattgtaaaacaaacatatgatactctttactagaaataccatcttagttgttgatttttccactaatatggcttcataatttcttgtctctttcaactaatgattttgatttccacttttttttagctgcacatgggcgttgccacaccttgaaaatgccatctctaacattttggcctctgaaaattactccttcccataacctttgtaccctgtagttcttttgttcccatgcttgtattgaacatgcgtctcatgatttctcatggattgatagttcatcagtttctttctggtccattttcctccctgttctatctggctccccaggtccggtagttcactgatattcttgctgacattcccatatcttttggtttcctcatttaccaaatagttactatatgcatttttttaggatctcagcttggggaaacagacatcagataaatttagggagaggggatggtctgagttgtttcagaaaatttaggagtaatgacaagttaacaagtaaatgagactagggaaagggtattccagcctgggacccacatatgcagaaacaggactctgagggatcagaatatgttcaaaggacaagtgatttgggtattgctagaacatgaagtgagaagtgagagtcatggaaaatgagacttgaccagtaagcagggaccacatcacagagggccttgtcagggacttagatgtgatctgacagggcaatagttcattgcccactttattcccacacagacaatatagtgcatattgt

SEQ ID NO: 122574 - DNA, 1029 bp, Homo sapiens
ttttttttaatcaatagcagtattttttttggaaatcacaaaaataaataaaagtaaattttagtaaagtttcactaaaattgtagaagtccctcatttggttggtggcatagcatgagtaatgaatgataatcagtaaaaagttagtaaaactcatgcagataagaccaagaagtataaagatttcacctatgatatagagccaggggtgtccaattttttggcttccctgagccacattggaagaagaagaattgtcttgggccatacataaaatacactaacaatagctgatgagctaaaaaaaatttgcagcaaaaaaacatgttttaagacagtttacgaatttgtgttgggccacattcaaagctgtcctgggctgcatgtggctctcaggctatgggttggacaagcttgatatagagtttagaattataaatcccctatactacagtgaattaaatagttactacatgtaaagaaaacctcatattttgaaatgaagtgataaagcaatgatttagtattagaaattgatgtgtattcaaaacatatcagttttgacagtgtattagttcgttttcatgctgttgataaagacatacccaaaactgggaacaaaaaggggtttaattggacttagagttccacatagctgggaaggcctcagaatcatggtgggaggtgaaaggcacttcttacatggcagcggcaagagaaaaatgaggaagaagcaaaagcagaaacccctgataaacccatcagatcttgtgagatttattcactatcatgagaatagcatgggaaagacaggccaccatgattcagttacctccccctgggtccctcctacagcacatgggaattctgggagatacaattcaagttgagatttgggtggggacacagccaaaccatatcagacagcaacaactttcttcttaacaatgaatagctatggtggtaaatacagtgaatacaatgcatattatctttgtttcttgtaataagaataaaaaatggactact

SEQ ID NO: 122575 - DNA, 1122 bp, Homo sapiens
tgggctccatactcagtcacacctttgatagcactctagagttccgtacttcattaaccttttgttgtatctgtcttgccagttgggaatcctttagcttctggcctttcagccttgttctggattacctgctgaagaaggttaagaagcagtattgatatagcttactgctaaatgctttctaatctaagctaggcctttactgataggcaacattttaaagtttttgataccttttccttttctgatttcaatgttttgtcattttcacctggatttttgtggtagtttcttaaattatttccctaaacctcttcctcctcctagtgccattacctattctatagtcactccctatgagatggtattcctaaaacccatatttaatcatacaatttctctccttaaaatcctttgatggtttccactgcttatagggagagaatgacctacacaatctttctcaaatctggccctcatctacgttactttcaggtattttttctcaggaatttcatcttccagttagaattattcaaggtcttatattttctctctgcctttgtgtatacttctacctaaaattgcttcatcctggctccttttcttcttggtggattcaaatttatcatgaagatatttcagacttcatttgctccatgatgcctttgctatgtctcctagacagagccagttattctttggccaggacttaattgtattacctacttcagacacactgaagagtgaagatgtttaatgcagagcctgggtattgtttcctgtaggctttagacattgtaactgaaggcataccattggctaaaaggggaactgggtgagaatgaagatcaaatcaaatcaattaattaacaagtatggctgagctttaacgatgtgcttatctaccactactggaagagataactcctcatacaggtcccatgatcagtgataatcaattttctataaccaggagaacatattatccttgtcttcaacatataaatgctacattataaattctagtaagctttttttaataactggatttttagactatgaactaggaacatgaagttgctcttaaaatttcagagtctctactgaccaatgcaaatc

SEQ ID NO: 122576 - DNA, 1047 bp, Homo sapiens
ttggagatttctgtttggtagtgccaatgagttttatcttctatttctgagtataagactaaaggagatttttttttttttttggttgccttttgcagctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaatataaaatgttcaaggcttcttactgttgagcacaaggttacgtatttaaaatcacctagtatttgagagagatcctgcctatagcaccaagactcgaaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatgaagtttagccttccttttagtccattttgtattgccgtaaaggaatatctgaggctgggtaatttataaaaggtttgccgggtgcggtggctcacgcctgtaatcccagcactttgggaggctgaggcaggtggatcacgaggtcaggagattgagaccatcctggctaacacggtgaaaccccgtctctattaaaaatacaaaaaattagccaggtgtggtggcgagcacctgtagtcccaactactcgggaggctgaggcaggacaatggcgtgaacccgggaggtggagcttgcagtgagccgagatcacgccactgcactccagcctgggcaacag

SEQ ID NO: 122577 - DNA, 1032 bp, Homo sapiens
taactctggatcacatgactcaaaacaggtcattaatggagattcttgtaccttctttttcttaacctttttttttttttgtccttttcctccagcttctttaaagaccctaggcacacaacaaaataaaacttaggaattatggaatctcgggcttgaaaaagaccataaagaccataaagtccaagcatctctccaggatgcttgtgaaaaataattgtctaccagtgaaagcaatcacgtctctcatctgtagatgctattgcttgcatggcttttgagttcccaacccaggcagtgctagggtgaccaccatctcagtttggctgagcgctgaaagttctttatcctaagaaaccccttagtcctcgcaaactcggagaattggtcactatacaagctacctggaacacatgccattttatccaagtctcttaaaatgtgatgatcaatagtctacatatgttctgcccatcccattatagctttaattttagaacttatgacatgtatagatttctatagatttttgcttccagagttacataatgatagggtcagtagaattttagggctagaagggcttttggaaaacatctaatacaactcatttgtttttgtaaatgaggagaccaagtcatggagaacctaatttgctcaagattccagtggctaacaacacttaccgactcttacctctccctccatcactaagctctagccccatggctgttccctctgcccagaaggcttcttttctaagtctttggctggctggctcctcattcttcagaactcagcttccatggaacactactaaaaagcttattcttttccttcatagcatttaatgtcatttataattttttatacagagagacagacttatattttaatatctgactctcccactagattggaggcccccagagagcaaggactctgaattttgtataccactatatacttagtggtagcacaatgctagcaactattaagaagaaatgaatgctttttctattctctcactct

SEQ ID NO: 122578 - DNA, 1100 bp, Homo sapiens
aatgttaggaatttcattgtttaggaatataaactataagagattaagctccctccactgatattctagcatttatgggtttacttttgtttaccttttggaatcatgagagttttgttctagaacagtttttgttctttcatttgagataatttgaataagaaggatcaaaggattgggaaaggaaaagtaaaatatttggcagaataaaaatgttttttttggtaatgaagcctttagaaaactaaagttaaatgaaaaaactgaagtagaactaaactcttacgtcttaggagaacttagatacatatgtgtcagagtctgactgtatttatattctaaacacacatatgatcacacaacatacatacagagactatttgtataactgtaaatagatgtgacgtatgtataacttaaaaatcttttgataggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgtaagtatctaaatatttatatgtgaagtttgaatgagatgaacttaaaagtttaaaacttttagtttaaaatcagtgttatcacttttttcttttttttctattctttttcttttttttttttttttttggagacagggtctcactctgttgaccaggcctgagtgcagtggcatgcaatcatgactcactacagccttgacctcccaggctcaagcgatcctcctgcctcagcctcccaagtagctgggactacaggcacatgccaccacacctggctaatttttgtattttttgtagagacggggtttcaccatggtgcccaggctggtctcaaactcctaggctcaagcgatctgcccacctcagcctcccaaagtgttgggattacaggcgtgagccaccgtgcctagcccactttgtattccttagcaccttattctgt

SEQ ID NO: 122579 - DNA, 1374 bp, Homo sapiens
tttaaagtgatgataaagctatcaaatgcttttagttatacccgaccttttaaaaacagttgttgagtagtataaacagtgtttctggttaaaaaaatgtttattcaagggtgacttcctcttgaaggaagaataccacggtggtccggtggcaaataggagatagatgtatagattgagtacacacacatttttctatgatttacaagtattttctgttatagagatttgagagaccgacaggaaaagtatttaggatctattttatatataccaatggctactgaggaattaaaatcagaaatcagcttctgatcatcagggttagaaactagaataaaagctgtgaaaaaattatgtgtagatgactttttaaaaatcaagtatggtcattatttactattcatggagattttatatatcagagaatgtttgtaacctttaggttagtcagcagacttattatgaagttatttaaatagttagctagttagaggaatagttaaatagttaaatagggagaattgttaaatagttatcccccacaaaaaggagttttttagataagtaataaaaatttatatttacttttcttcttttataggaaagtaatggctagaaacagttagttctaaactaagaatttgttgtatttgataactccatcgatgaaaatattttaaaatgccctttaaatgtgcattttgtcaatttttaataggtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggttagtattaatataactcatatttgacaatgttgtttataagataacaaattgttgctttcagacaggttaaggttttttgtttgtttgtttgtttttttagacagaatctcactctgttgctcaggctggagtgcagtggtgcaatcttggctcgctgcaacctccaccttccaggttcaagtgattctcctgcctcagcctcctgagtagctgggattacaggcgcctgccaccatacctggctaatttttgtatttttagtagaaacggggtttcaccatgttggccaggctggtctgataatagcagggagtattatgacattaatctgtttaatttttcagagctcctttgacagtacaatactttcttaggtaattaagattgatatttctacaatacttcattgggtaattaagactgatattcctgacatcttcaggaccttttgcacttcttgttttctgtgtttagttcacttgtccttcattgttcatc

SEQ ID NO: 122580 - DNA, 2223 bp, Homo sapiens
gaagtggttacagtgatcagtatttcaccttttcatggtgcaaggcacagctacaactattggttcatttaactgtttttatttattgatcttttattgtctttattaaagacaaaaacccattttcttctaggaaacccttcattcaagcaaaaagaatttagttattgtctttggtgccacatgctatgagaaagttatggggcatataataagatctccctacccataggcttcacagagtctgtagagtatgtaaatatacacaaagaattatagtattctgtgactgaatgttgctggtaccttggggacacaaaaatagggtagaatcagaaaaagggtctatgaagacagtagcatgtgaaggatctataattttgaaacataaggagaatatactaaaagcaggaaaggggccgagtcagatgtcccttgtcctaacaccttgtttttccatattatagcacttgttatagttggggtcgatgacattttaaaggatattatcatatttatctttttgtacttagcatttagatagtgccaggtgtattaaaaagtacttagcaaatactgaatttgaaaatttaataaaactctatgggccaaattatgtttaatgtgttcagttaggccacagccaaaattacagcaagaagagtagtgtgaaataaagataagacagtggatagctttctgtagacttcatataacatagattagaactattctaattaggtttataaggctattaataagattcctaaacctattgttctgccttaagaaaagttgtcttctgttgtctcaaacaaattaattaatctccccaaatagcaaaatggaatatgttactaaagggttgaaatttagcgtattggagtatgagatatgtttattattcatgaagtcaagagtttttaaatgaaaacatttgtgtattctcatgcttcgaaaattgcaaaatctgcaaaataaaatcttaaattacaaaaaaattaaaactattggtaatagggagctattaatattttttgattgggagcaaattgattaagactgagtgatctccagtagtctatacaataaaatggagacacaagaagaacattcattcaacagttgtactttatgtgctgggccctgcagatgcagaaaatttcaatgaactgtaataaataatatgctagtgttaggaaacttggactgtagtaacaagcaaggacacaaactaaggttatagcaagaagaaggtgaagaagatggaattaacaggatttaggtatggtgcgtgaaggagaggttgatattaaaaatgtatgagatagcaatataaaggtgataatgactgcttctgaatctcttttctactttaggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgtgaaatctagtactctgaacttgtcatctgataaaatacatatgatatagaatgatatagcatacacaattaatagctttaacagttagtggatatttatataagaaacctgaattctggttagaggaagagaaaatgatagaagatgtcaggaataactgtcttaaaaaccgtaaagttccccgagtacataatacactgctaaatattattcagtactttattaacagtcatgtaacatgtttgcttgtgtaattttaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtatgtaccttaaaacctaaataaatgttatttccttatcggggagctttgttttgtaaaattttattttttagcaaagagatagtttaaaaataaaattaagtagcactaaattaagtagcaatgaaaatcagcagcctattcactatcttgtgctcttctctaccctcaagttctgtctctcagaggcaactgtcacttccattgtttttaaatggtatgc

SEQ ID NO: 122581 - DNA, 1025 bp, Homo sapiens
cccagcactttgggaggctgagacaggcggatcacctgaggtcgggagttcgagactagcctaaccaacatggagaaatcccatctctactaaaaaaaaattacaaaattagctgggcgtggtggcacatgcctgtaatcccagctactagggaggctgaggcaggagaatcgcttgaacccgggaggcggaggttgcggtgagccgagattgcgccattgcactccagcctgggcaacaagagcgaaactccatctcaaaaaaaacaaaaaaaaaacaaaaaaaagtgaaaaggaacaggggaagttaatttaaatagtttaaaccagtgtatccatgatattattatttcaacatgtaatcaacattaaaactattactgagacattttacattgtttatacattcttcaaaatccattgtgtattttctacttcacagcacaactcaattgggcagccacatttcaaattctcgatagccacaaatggctattggctattttattgtttgtacatttttagacactaacaactctatatacattgtatcatttaactcaaaacatcctctcctgtactgttatatattccaaatgaggtcactgttgcttagagaagttacagtgactttgccaaagcaaggttacacagctggttattcctaatcaaatcttccttgccccataatatggcttttttctgatgagtattaaaatttttttctttgtatatattagtatattaacagactttttatggaaacaactttgttactgtcacccagattttttgaatcttaatgttttgccatatttacttaaaagtttttaaagcttcaacacctttgataggtattcaaagccctttatgtacactttttctaattctaatttgccctccccacaagggaactattatcccaagtttgatatttatcagtctcatacatgctttagtactcttaccatgtatgtacatttccataaaatattttgcaggtgtttatatataaatgggatacaa

SEQ ID NO: 122582 - DNA, 1019 bp, Homo sapiens
ggaggctgagatgggaggattgctgcagtgagccgtgatggtgccactgcacgccagcctgggcaacagagtgagaccctgtctcaaaaaaaaaaaaagcaaagaaaaaaattaaaataaaaaaataaaaacaacttaattatatctctgatacagactgtgatcaaccactctatgattgtcctatgtgtgggctcatatgtacaaattaccatattcttcaggaacatgttgacttgcatttggaagaaaacagctttcagcaaggtatgtttatatgtttgaagataaaaatatcatttaatttctactttctaggacacatatctaatttttagatttgtgatatggaaaaaatattttaaaatacatcttttcctttaaaagtgttttatttacaagttgaggccatttctttagcagctagaagtatctgaatattgtatttggtcagcgaaaattgttgaactagaaaactgccatatggcacataaaattttacaaatgaatgtgaactatataaccaaaacatctttcagtgcatcttgagctgcttgaatagcttctaaatgacttactggttttattgtgattctataaaagttttcctttctcccctatgttttttaatagtggcattgtttaaataatcattatggtggcttagaagtggaaaaatcctatatgaatgttagaagcccactgaacgaaaataaaaagtagatcccaagagaaaccaattgtgttttaccctatttcagttttttaaggtacgtagatagcttctgttaaggcagaggtctttagtgtccagtatcaatgatcctagtaccagtatcggtgttcatggacaatgttactgctcactcaccctaagccaaatatgagattattggggcaaagatggaaaagttccctgctctggtggtttctgaatgtctgctaattcttactcttatttatgataggctttgtatgagcacgtatattacagtgtaaacctatagtgggtaataaga

SEQ ID NO: 122583 - DNA, 1201 bp, Homo sapiens
ctcttacatccgccagcattacttatggaagctgtataccattatttcttactgctgcttttggaaatattttctgagtacttaatacttcattttctcttgagctttgccattgaattttttattccaatgattacatcttaatattttcattttcttcatctttctattttttcttagtaactttctgtcctggtttcaaagattcagttccctcctttatttcagtgagcattttgaacatacttattttacagtttattatggattactgtagctccatttcttcacaggtaactttttcagtttgtagatttcttagctgtttttcttggcattgcagcccccagtgagtttagcaattcaaattttagtgttcatctgttatgggagttttatatgatcccttccctgtgaagcagtttcatggttccttcacactggctgttcacagtctctgctttcagaccaggccttacatatacagattgctctatgctttcactctgtgtatatgcacaattctgggtccctcttctatgtcccttatctgctaggtcttggtcttatagaggaacaatttctgtttttggcaagctagacctgtctgcctgcagtgctatgtgatggatgcagctctttaatctcctgctcctgtgtagacagtattaccccaattcccagctttatgctggatgtttaagttcagcaccttaccactctgttgggtgctgagaatttagtcctaaaaacccatatccagactgggccctacttaccactttggttttcctttctgcttctcttgttttgactacagatctgaatatttattattaatatttcctttttttttggagtggtatgagaggtttgtgctatgctcagccttctatctcgaccctagaagtagaaaaatagcttttaaatccactacaaagagcttttacttatataaggttaataggtggtagacagtctttgacatggggtgaaaaaatctaaaagttataaaaataaaaccaacttggctgggcatggtggctcatgcctgtaatcccagcactttgggatgctgaggcagaaggatcacttgagtccaggagtttgagaccagcctggacgacatagtgagatctcatctctaaaaaaaaaaaaattagctgggcgtggtggcgcatgcctttagccccatctactt

SEQ ID NO: 122584 - DNA, 2477 bp, Homo sapiens
atcagagactgtatccatttgtctggagagaaatgaaaaaaataaggacaatgtagggaggtattttaaaggtaaatttatttaaatgaagtgatagtgtcattacttttcctgtttgattttaaatagtctttagctgaacgatgacctgtagtaggaaggtggtggcgaagtgattgctttttttaaaattatttttttaacacttttatgtcagtagtcagtactttatttgtccataaaatccaaaaataactacctttggattttacagtagtctttgactgaacctcagagagatgagattccttacccaaaatgatgaatctgaaattattacccagttctcttgactctggaataagtgcttttttctactataccacttctgcttttattcttggggctgagagtacaggctgtggagcacgacggggttggcattttggcttccacctttttctgcttgtggtgacctgtctgagccagaatttctttatgtgtagagcgataataatagtacttaaattacaataatagcacttaaatagcacttgatacatgtaagactctaagtttacagtgttaaactctacttgtaagatgtgtttatttacctcctcaatataatcagcttcagtattcagtatttagatatatcagttgataaataggtttcttctcttcatttttttcttacctgatttatcttacctggacaattttttaaacgttattttttctccaccttgggccagagacattttttgaaatattttatttttaaaattacttgtattcattattattgcctttttttaaaaaaaaataaatgaaattttggttgatatttataaataagtttttgtatttgaggaacagtaagtacattgaaaacttcttcatcaaaataatccagcgttaaagaccaagtaattgtctcaaatcattttatgaaacacattttttcttcaaatctttgaaacctaatgttatgttcttttctagctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaaggtaaagttttcatttcattataaattataagtttacagcctcaatttaatatgtggtattttaaaagttggtttgtaagtcagcttactacagatgtgttttgaaatccattttatgtctataacatttttcatttgctgttactgaaatataaaagtacattatggaaaagaattttaatgcagatataaaatgtttcagctacattgagagtagttttggaactttctgtctagtttccagagggtattctttttattgtcactaacccagtagcatctggactgtcctggactctctgactttgcattgagttctattttgactccattattctgttatgattggagaacaaactctctgtgatatcagttcttttaaatttgttgaggcctgttttatggctcaagacacgagctatcttggtcatgttctgtggatacttgggaaaaaaaagtgtattctgctttgttgggtggaatgttatatgtatgtcactagatcctgttgtttatgttcagattatttatatccttgcttgttttctatagtagtactgtctagtagttctatcaatttttgagaaggggttgttgaaatccctgattataattgtaaatttatctatttttcctttcagctctgtcaggttttgtttcatgtattttgagactctattgttggtgtgtacacatttaggatcttatgtctttttcttattgttgaactttaagaatttgtggagccaggtgttgtggctcatgcctgtaatcccagcaagttgagagtccgaggtgggcagatcccttgagtccaggagttcgagacgatcctgggcaatgtggcaaaagctcgtctcttcaaaaaaaaaaaaaaaaaccaaaaaactagccag

SEQ ID NO: 122585 - DNA, 1045 bp, Homo sapiens
agggtttagccatattacgcaggctggttttgaactcctgagctcaagtgatccacccaccccggcctcccaaggtgctgggactacaggcatgtgtggttgcttagattcttactgggcttcaaatctttataattttataatgttagggttgtgataaaatgctaccatctgtgttataggcaatttcgtattagacttttatttattgtgtggttttaggaaacaaatggtataacttaacctgaatgtttataagcctaatcaatacaattaattaattttttgtgtgtcagagtctggtgaccccataaagctatactgggtcctttgtagggcaactgcttgcctatctggtgtttttcttgaattaaagttttaaaaaagtgtccacccctcccgttgtttgcagccagccaggtccaggcattggggtttagtggccagagctgggattatttcggctccttatgccctgttcttctggatccgtttaactaaaggtacatatttacatagattgtttcacataattttgacctttcataataagacattaagttgatcattagtttttattccacttgtataaattcgtaggtttggatttagtccaaatttattaccttgatatacatttttgtagaataaaatacccttcatttgtgtaatgaatttgtgcaacctaaaactccctgcttctctctccaccacaagatttgcaaatggttattagctaaagtattcccttgtgatttaagtgaagaatcaaaatgagcgcttgatctctgaggaaacttccaagtgtagattcaaatcttgcatacttaagaattgcttcaaaaccctctgcccaactcttaatttgttatttagaaggtctgctgttaaatcatctgtcatttattttgggttagacataggatcagctgatagatgatgttttaggtgagtggcttttttaaaaatcagcacaaatttattctgtcaccttctgtaccagtgtgtgcactcacccttctgttgtctcatctggacagctagc

SEQ ID NO: 122586 - DNA, 1048 bp, Homo sapiens
tcacttgagctcaggagtttgagacagcctgagcaacatagcgaaatcccatctctagcgaaaatacaataaaactagccaggtgtcgtggtgtcctgtggtctcggctactcgggatgctgaggtgggaggatctcttgagcctgggagacagtggttgcagtgagctgagattgagccactgtactccagcctgggcaacagagcaagacccagtctcaaataaaaaaagaaaagaaattaaaacctggacacggcaaagtaatgaaattgtatgtctaatccaatgttgaatgtaaaagtctgaaagtacgtatgtaaaatagagaaattcattctggcatattagaaatttggcattgagggtgaagggaaaaatacagccagaatttcagatttttttttttttcattagactgaggagtagttttgcctttttccaaactgaggagtcatgtggatgttatcttccagatgtttattgtctgctttgtatgttaaaaaaaatagttgtttgccttactgggtgagggagacttagtttatgggaaaaataaagcaaacgcatgtgatgacttcttacccgatgtggaaatagagtcgtgactgtgagcgctggtatgctgaatctagaaccaactgtcaaacttgcctttcaatgggagttgaagaggaggggttttgtgggattgtggggtaagcattggaggattccctaagatccatgaaagcagagatgaatctcagcctcttctttcaccgctagcacccagtacggtgcctggcacatagcaggctccgggtaactactagttcctgagtcagcgcatgaatgctgtggttgaggtttgaaaaaattgaaaggaggataatattcatgttattttaaacagaaattgtatatatgactattgtggagcgttaggaaacactgtgcaggtatttaagaaaataactaggccgggcagggcggctgactcctgtaatcccagtactttgggaggctgaggtggacagatcacttgagtccaggagttccagaccagcc

SEQ ID NO: 122587 - DNA, 1053 bp, Homo sapiens
ccaggggagaaaaagttagaaaagaagtcataggggaacacagtttgagggagttacttatgcaattaagcctgaaattcatagtctttggtttatatttgaggtgatcacatttgccatagaaatattaagattttttaaagtccttactggtagctaaccattgcttttatagcattgcaatacatccagcagtgcagaatatggaatgtgcaaaagcagtaaagttttcaggactggactatgatatgagttttatgaggtttattttttctctcaactctcatgtttcataccttattagatgtatgataagacaccatatgtctccccagtgagatttgctattttcttgtcagtaaacattgattgcttgttccgtggatatggtgcataaacctacgcttgcacaaagcttcccatcctatttctttgtttattttccacagtatgctcaagtaattcctgaattgacacttttatccaggtttcagaaatgccattttggcttaactatagatcgtggaacttattgttgcctgtcctagacttataaatgaaatctggagtgaaaataagtatcagatacagatgtgttccaattttaggaatagatactaaaattaaaccatacaaaatttttatcttgaggattttctttcactttaaaaaatattcatggcaatatccctcttaataaggagggctttttcagtctgttgctactcagaatatatcttacaggatccaacagaacagtcactaataagagctttttggaaatgtagaatttccaggccctgcattttgacaagatccccaggtgattagtttgcatactgaagtgtgagaagtagcactttaatacactgacaccttcttttacaaagcatctttcaggagctaagcaaagtgaacaacctttgttggaagtaaaataggcacctctcattagacctttcccttaatagtctagtaaagagtacttcgataatttaaaaaaggggatgatagaacttctcatatcataatttttacaaaaaaactcctaat

SEQ ID NO: 122588 - DNA, 1036 bp, Homo sapiens
gtgtatctgtatatatatgtgtgtgtgtatatatgtgaaataatttgtaatcaatttttaaaaactatcattatcagatatggttgtcatgaaggctaaataaggtaatatgaagtccttagaacactgtatctgctactttttacaatgaatgtttggtaaatgctagtttttagtaagggccctttcataattttatttttttcctttcccaataactttttggctctcaatttttaaaaaactattatctgtgaaagtgaaagctcacatctatgtgcaaaggagaagtgtttacagttttaatttataaaactcagtttaactttgtctttacttggtaatattggatttttctggactccagagagaaaagtcaatatcaatattacactttatctgaatattggcagtatgcatatttaacatgaaaccaaggtgagaaagctagcatgttccagcggcaggaaagatttcttgacttatcttcagctgaagcagtggcagcttggatattacatcaacatcctgacattattaacaaaggtcagcagcctcttttctctgacttccttattctaagcatctattcaacagagataaaacagttgtcttagaattgtttcgctgtacaaacaagttttttttttttcttaaaagtcttctttgaaattaagaaacttctcttaaccaatgtgtccagtttgttgtagatgcccacaaaggacttgtaacttaataacaacagtgagaaaagtcttgcttttgaatcaagtcacataatataacttcagtatcatttttagaactccagaggccaaagtccacttctccacgtaagatcttcaatcccagaagccctatcatgggatctctctgtgtgtcccacttgtgagagtctaacccaggagttcaccagtatgtctcacagagcactactcccaggagatgccccaagaggaaagagttttctgggaaatactgtaaactgcaacacgcatcagagcttcactatacactgtaagggctttgagat

SEQ ID NO: 122589 - DNA, 1855 bp, Homo sapiens
aggctgaggcaggagaatcgcttgaacccaggaggcagaggctgcagtaagccaagatcctgccactgcactccagcctgggcgacagagtgagacttcgtctcaaaaaaaacagtgacaccctaagattttcttttgctgacacatgtcactttaaaaaaataaaatttagaatatgatagtcacatgtaggttgactcatataattgctccttatttcatatttaactgttttctgaaaaaaaaaaagtttttctcttcctcttttatgaaaggagaatttcatagtcctaagaaaagtgacatttaaatatttgatcaggagattttttggtggcttggagaggttgtgttgtgtttatattgagatgcatatttgtttgtactaattaccctaggattgctttatgagggtgctcaaaataaatgcttacaaaggtagggcaggtaacagaaatgagtaacaaggacctggtgaagaactagggtgtttggctcctttcaagggacagccactgtgtcactagccctgtgagaatgcctgatcatgtggttgtcacgtctttcagttgtcattgttgttgttgttgttgttgagacggaatctcactcttgcccaggctggagttcagtggcatgatctcagctcactgcaacctctgcctcctgggttcaagcgattctcctgcctcagcttcccgagtagctgagattacaggctcgcgctaccatgcccagctaatttttgtatttttagtagacacagggtttcaccatgttggtcaggctggtctcgaactcctgacttcaggtgatccgctgccttggcctcccaaaatgctggaattacaggcatgagccaccactcccagtttgtccttcagttttaaagagaaactataaattggatattttattaaagccctttaaagccgacaaataattcagatttcaaatcaaagccccgtgcactgtgtgctcctgcacactatgcttctctcttgtatcattttcatttaattcttggcaattttgtgtttaccaactgccagggagcccaaggaatttagccgtcacctcaaacttaaccaaacttacaacctttgggcccaaacctgctccctctctggactctttttgctgtctatattggcctctgtgttgcaatcatttctggactgaacaaggccttggtgttttttctcctttgttcttctcaccatagttcccccaaacctgagtctgttgattttgtctcaagaatttgcctgttttctgttcccttccttcctgttccagctacccccattgctagcctgcctactgctcctctgatccagattctgtccccattctagttcctgtagcgttgtccagccaggttgatcatctttttctaatacctgtttcgttatcttcctactcaaaaaattctatgtgtctttgttgcctaccatgtaaatttcactaattctgcctagatctcagggcttcatagtagttttatcttggctgtctaaagttccccccggcacttcttaacccattggtccattaaagccaactctatttccccaattcagccctctgtcaggggctgccaggaatctcgtgggagtttctggataatgggtagatcctttccctaggccttggctgttgagatgatgtagattctggagttttcaaatctttttcttttttctttttattttttaataaacctctattaccatttggccccaacacctcaaggcaagaaggaagtggaataaaggaagactcctgaatccacctctaactggggaagaggctgggagggaagagggctgctttgaggtcctcagattcacag

SEQ ID NO: 122590 - DNA, 1932 bp, Homo sapiens
tcagaaaagtcttcagataatttcttgttttgatgaaatgctggtaattcgctgcaacattctttcttgcctctctcctttgcattttgtttagacccctgatgtatatataacacatagcacctagaattatagttatttgaatgtgtgactatttgccattttactctgagttctatgagacagcaagtgctgcttttgtgtttccagcttttaataccatgtctggttatgaaaagcactcaacatagtagatccttgacattttctgattgtacatcccaagtctatgaggaactttagaatctgtgagtgtcattaactaagacatacatttcaaatgattattaggctcagtccccagctaaatgacttgtagctaaacaaagttacatcagcttaagcctcagattctaacaggagcattttctgtacattatctcatttaatcagcacaaccaccttctaaagtgagtaatattttttctccattgtgaattattacatgacatttggcttggcaaatgcatgcaaggcctgctgagcaagtttggacgggtggagagatagatgattagaaaaaataatgattaaatgatttgtttcctaagggctttccgttctaatgtgtgaaatgttttgatcaacaagaagataaaactggaaaacaagagatgaaataacctgaaacaatagatattgtttaataattcagtcttctttttttgttttttggttttccttctgcccaaaaacaataaaatacataacttggagattgtattggactctcaatcctcagtaagaattaatgaccccttcttcttttattccccccttctttttctttaccaggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtaagaaaagagaactaggtttctctgagcatcaaaatttttgatatttgcagagaagggcaagtggtgtgttaattaacgctatatcatgagaagattagaagagaaacttgcttctgtaaattcttgggggtaacttagaaggatacatttgcttcataagctgaaacagcaaaagacatctaaggagatgtgagccttgtgtgtgtgtctcagaacctttgttagagtttcagtgctgctaggaagagaattagagatacgtgacatttggtaaaccatctatacagttcattattcatttgacaaatatttattgaatagaacagtgaccatgtttcaggtactctgtcaggaactgggatgtaacagtgaaaaaacaaagttcctctatgaaacttgcatctgtggggagaggaaggcagaaaataagcaaatgcatctgtagtatgagagatggtgagaaagaaaaggaataatgaaaacgaaggcatccaaaggtgatgtagagcctgcgtttgagtgtttttgtgccacttcaaatgggatggtagggaggcatcatcagtaagtggacatttgagcagagacccaaaacgaggtaagggaatggactgttccgttacgactgaggtcagaattttctggggaagaaaacagcaagtgcaaaggtcagtttcctaaatagcctttgaaatttagtgttttgtgctttgagatgtgctgttagcgcactgcaacctgaaatcacagtaacaatgaccctttgatcctaagcccaaggaaatagctcaggttggacaatttgaaaacgataacaaaatcttacatacattcttttgagtatagagattttctgaaatt

SEQ ID NO: 122591 - DNA, 1004 bp, Homo sapiens
tgatcgcttgagctcaggagttcaagcgatacagcctgggcaacacagtgagacccccatctctacattgtaagagaaaaaaggcagaaaagaatggaattagctacgtatctcaagctagcttgcaaggtgatcatggtctgcctcagggtgttatcctccccatttctaggttcttgagctttcaagcttagatgcatcactagaagatgaataatgagttgcaattcattcgcagcaataaagccaattaatttttctccttgaatttttttctgtataaattgaacgtttgtcttttgaaaataaaatgtatgctcatctgtattattattatcattcattattatagaaataaacatattcagtgcctattgtatgccaggcacctgcttggctcttacatatattttctagaatcccctaatccaccttccaaggtaaatattatcaatgcctttccacaggtggggaaaccgaggcacagtgtgattaggtgaacatgcccaagatcccaagagtgtacaattaggggtgaaagagagatttatatctgtgtctctgtggctgcaagacacctactcccactgctgttgtctcctggtttcaccatcaccaaaaaaaccacattgcactatcatccttcccaggtggactggcccattattacattatacagcaatttcgtctaaaacacaagaagtaggtagtatttttgattgaggatgtgcttaagataaactatgtagtgatgctcagaatttgtgttgtggctactttaaagatttcctttgaccaaaaacactaaccagacctatattttaacttagttaaataaacccctggtctgtttgaacatcctccaggaatgcagaaggaggaggagacagaagtgctttgtctttcagtggctggcgctcagagagtggacattcctgtgcagctgttgcccagcttcctggaagggtggaagggtgggaggcacctctgcaagctgatgtggc

SEQ ID NO: 122592 - DNA, 1977 bp, Homo sapiens
ccctaccctactcctcctggtggattcctggtaatccaagagtttgcccaaatcatgccaagctggtggcaagggttcactgaaccagaactagctccatatacaggttttcccagcctcatgagatgaacagagaacacatattctccaagccacagtatattcaatttggttgttttatttacttcactgccactgccagtctacgtctttgcatctttttctccttgaagaacctcttgatttttctcctctctcttttcaccagtctcagttccttccaggccatctaatgttgtgtaattaaaaatagttgcaataatttctttccttagttcaaaaattgttaattgtgccccacttctacagaaacttgctagcttagcgttgatgcatcatcttgctttcttcttcactctcacttctagcctcatctctgagtccttcatctccatgccatttcccaaatgcatcatacggtttcatggcctagtacatttttacagtcgttgatgttattccttccatgtccccctctttttcttcttttcctgctttttctgtcccttctaacacacacagacacagacacacacacagacacagacacacacacacacacacacacgtaaaagtaaacccttcaagtttcaaattcagggctgcctaccctagaaccttctctgatgttcatcagtttgtcccttttctgtgctcatgttctctttctaaagtttcagtagagcatcagtttcgggttgggataattattttagcttctctgtcagatacgggatgccctgagccaggaattacgttttattcatgctcttttattcacctaatatttagcatcgtcttacaattgcagatgttcagtcagtgttttaggactgagattataagtagcttgattttggcaaacatattaaaaaatctggatttttacaaaagagaaattggagtgtcattattcacactgtagggaaatttacactaagattcctctataaacattccctctgcatttaaagaaagctttggtttacataaaattttaaaactatgcttattatgtggaaaagaccatgtaataatgtggaaggtgcctgtgagtgagcattcaactatgtgcgatgcactgggcttagtaaaccttagcgttactacctcatttaacccttataacagccctgtgagataggtcctgttaccaacctttacacctaaggaaactgaagctcaaagaaggccaactaacatgcttgtaagatcacttagcgggacctgggattcaagtctgggcatttgaggccctgctcaaatgcccagaggccctactctttagctctgcaccatccgattcagtgtttgtgttgaaagccatctgttcctgtggcttgtgcataagaagacctgaggtgtagttcttgttcgtcacttgctggaagaaatggaaacttctccaggcctctccacaggagtatccggagaataaagtgggagtctgagaaatcacttacgtagagttccagtataagttgaaagttcaaaaaatgttttttagtcaaaatgctaagaggaggcatggtggccagtgatagaaagaaactctttactataggatcctaatggaagttaaattggttgtgttctgcataatgatttgcaccaggaagttcaaaaattgttctcctacgttttctgtacctccacttccaatcacaatatttttttaagcattgtcagtgacttagaagcacaatcatgtgaagtcaactgttaatgtttatgttacactaggaatgagagaaataggaatagttggaaataatgcgaagtggttagactcataatcacaacaggtttctgcatgtcattttttagaatgatacatatctgacatattgcaataagatctaataattacaacttatctgttgaagttttttaaatcccaaagaggggaaagcgcaa

SEQ ID NO: 122593 - DNA, 1054 bp, Homo sapiens
tagaagtgcgtcctcctctatggttgaggctactttggtggaaattattgagaaggactgctttttctttgtttgttttattttgccttttatgccaagatagaattcagaaagaatcttgaacatataaaacgttatatcagccagaatgctgtactctaggtattttttttaacacaaccataagcctcaaggagaaaaagctattgggttcctcctcctctttccccataaatacttccctggagactcactgtgattcagtttcagtaattgccatctttcattgggagagaagtaatggcttaagtgggttgtgaactcccagcgttgacacacttcttgacctgggtcctgtagccccaaggaaagccacacctttgtctaagaatccgcctgcttcatttatcatctgtcactgatttttgtgtgggaatgagagaccaaaattctccagggataccacttactgttacgtgactatggttttaatggcacagtccaggaatatcccttttttatgctaatttctctccttttcaaagaaaatggccttgaaaattctgtaatgttgtacaatgaccctactgcaattagcaagcaaggacaaatctgcgatttgactgcatcaaaaacaaattgaaaatggacacaaatctaatggtgtttgcagcttcagcatttctggagattgttttatcagcatacctctgagcacagatctgggccacgagaagtaccactcgcctggcagccaaatattccatgtggctgtctccacccacatgtactcccagggagggtcacttaggtcaatcaggcatgttcttatctgtcataagaaagaattgtgtgcttcagatgatgctccagaaggttaatgagggttttttggaggttttatgttgttgttgttgtcgatttatgacagacctttcaggagttaggtttttatttgatctctcagtggtttttcccactgacagtatggtagttaaaaaaaaaatcagaaataatactactaagggaaagaggtttctttgtttctctaatg

SEQ ID NO: 122594 - DNA, 1046 bp, Homo sapiens
tgatgaaatgatcaaaataactcttcagaccaggcgctgtggcccatgtttgtaatcccagcactttgaggaggctgagatgggaggattgcttaaagccaggagcttgagaccaacctgggcaatgtagtgagacctcatctctacaaaaaaaatcaaaaaattagctggacatggtggcacacacctgtaatccagcttcttggaaggctgaggtggaaggattgtttgagcccaggaggagccgtgatcacgccactgcactccaacatgggtgacagagaaagaccctgtctcaaaaaaaaaaaaaaaaatcctctcaatgatgatatttatatagagagggtatctcctacccctctagttacaattttgcagcacagtaataaaaatatgaaagggattgatgtctgtgtggtaagggtaattaaaggggcatgtgtttacattttccttctttgatctgcttccagaaatagttacatgcctatcataactgggaggatgaaaccaaattagagttttactatatttacatgtttttggtctaggaaatcatatatattgcacaacaacttagtatgatggtatacactctcatttgtgtaaaatatgtatactttttgcaacttttcctttcaactgtttcataaaatctaaaaaaaaaaatctaagcaagttctcactgataatcaatttagacttgcttaccttacagtttgtgggtttttttttttttttttgagacggagtcttgttctatcacccaggctgaaatgcagtggtgggatcgtggctcactgcaacctccaccccccaggttcaagcaattctcctgtctcagcctcccaagtagctgggattacaggcacccaccaccatgctcggctaattttttttgtatttttagtaaagatggggtttcaccatgttgaccaggctagtctcgaactcctgacctcctgactccgctcaccttggcctcccacagtgctgggattacaggcgtgagccaccgtgcctggccacctacagttttcattaga

SEQ ID NO: 122595 - DNA, 1059 bp, Homo sapiens
aagttactgtaaaggaaaatcagtgtgtatgctgcatgtgaatgctgcatgtgaataaaattcttaccatgctttgcaaagtcttttaactttaaaacttccccgaaaaaatgatttttttagtttatttgagcaaatttaggaggcccctagaataacatttttgtaataaaattttctttactacctaatgtgtttgacctttgtcttctttttacaaaaaacaaaacctatctcttgggttgctcacagttaactagttccagcctattgcttgtctagagtaagccactttcccccttggcttagttcacaatcagtcagaaattatcagtctgagcgtcaagctaaatttcagttggtaaagattataatcatacatatgtattgtctagtaaatttggcctttcaaggaaaaaaatgccatataccagtcatttgtgctggtataaattttgaaatgtgccacaagtgtgctttgtttttaggtccatactgtggaagtatgactgttcccaaagaactcttgttgaacacaagtgaagtaaccgtccgctttgagagtggatcccacatttctggccggggttttttgctgacctatgcgagcagcgaccatccaggtataacggaagaatcaacacaaatctctaaatgttatctgtctaagaattcctcttgccacttatccccatccctggacataattgtggactcagatgcagaattaagatatgagggagaagaggaacatggtatctttgtaaatggttaggtctgaactgaatcatattgcagcacaggtgtgtccaatcttttggcttccctgggccacattagaagaagaattgtcttggggccacacataaaatacactaacaatagctgatgagctaaaaaaaatttgcaaaaaatttttataattatgttttacgaaactttaggaatttgtgttgggctgcatccaaggccatcctgggctgcatgtggcccaaggggcatgggttggacaagcttattagcatgttagattgatcagttgacttatatgggatagga

SEQ ID NO: 122596 - DNA, 1053 bp, Homo sapiens
ttttttttttctctttttatgaaagagtgtcttgctcttttgcccaggctggagtgcagtggtataattatagctcactacagcctcaaactccagggctcaaagtatgctcctgcctcagcctcccaagtagctgggacgacaggtgtgcaccatcatacctggctaatttttaaatttttttagaaatgggtgtctttctatattgtccaagctgatctctaacttctggactcagcttcccaaagtgctgggattacaagtgtgaatcatggcacccagctatgactctctagagtgctttcctagtgctcgatatagctgtctgcacttagcacagagtaagtagctcttgtgaccatttcaacatgtctgcaaggaaggttctgttacatcctaaaaaccaaagtacaaaccaattaagacttgctgagggctacacacctcgtaagtgtagcctgggagtcagacttaagagcctgtggtcctatctcagacatttggacattctaatgaatgagattattttatgtgcagaaacaactctagtgttaactaatattatgtctaatagggggaaaaatgaaaatgagtgataattaaatattggttttaaagttactgttcatccaatatacacatatgccagtattatctattatagctatacctctacagtcccagttggtgatagggcctctggacatcaaatggtcatttcctgttctcctaaagaaagggaatatatccaagcttacagggtggcattatggtgccagattatctcagctttagcccagccattttgtagtgtttagattaaagataaggcctggtgactgatacaggtccacaagccctcatccataattatgaagtatagaaagttttgaaagccttttgtaactcatttggtggtgattcttgattaatgtgaccttaaattcgtttgacagcaaaattggactagattaacatgtctttacatatgttatttaatatgattattaaggcatttgacacaagtattttaatgttttttattaatgtgtg

SEQ ID NO: 122597 - DNA, 1001 bp, Homo sapiens
tgtgtggcccggttcctaacaggccactgaccagtaccagtccacagcctgggggcttggggacccatgcactagacaacatccagtccaggcttgtcattgtccagaggaatgggaagccaggtcaagagcagtggaatgacttgcatatactttgtggagttagaggcaaagccaggatgacaagataaattgctaaatttaaattcaggacttttcctcttcaactggctcctctgttttgtttggacccaggagtccaaactgatgataagaaagctttttaatgaaagaaaattcaggaacaatatacagaaaattcaggaaagatgaaaaagcaacctgcattcttattaaagagtacgatctttacgatctttttctcttctaattttaattctttttttcctccaagattagggagggtagtatttgcatctgtttcagtattctcattttttttctttctgtggtgaaatctttcctctcttttgttaggatagcagttattgcaaaactgactcactttgccaaacctaatctagtttgggaaatatgaactctctaaattgaatatcacaaaattctcaactttattgcaactatattgcaaaatatgatttgtctcattagtccttatactgttgtaacttaagtctaagggaacttttccattgtaaataaggtaagcagcattgtcattaacaaaaagagaaattcttgagtccagttactgagataaatttcatgagctgcctttctatgttggcattaatagtcatgaagaagtggagcatagctaaggtttatttaggaaattatgtttcttatcccctcactcctgggtctgagtgccttaacactcttccacagaggtctacacttggggacccacaggcctgggcaccccatagaaagttctagtcgtttctgtagcgccacttcctgacagagccgattccaatcccacaaccgcctgtaaatcagagccagtctgctgt

SEQ ID NO: 122598 - DNA, 1316 bp, Homo sapiens
ttaaagtttacatcctgatttatagtaaaagtgatcacttatgcacagtaaacctttaaatgccaacttgaacttgacttttgagaatgtattcctttttatgttttttgatggtttcttctgttgatacgagggtgctacttcaggaagataacaggctctagcctgaatttgtcaggtgctaccacctccaaacagggacaaagaacttccctttggctctcaatctgttttttggaatcgtttgtctgtatttgtatatctttgaatgccccttttgtaggaaaacaggataacaaaaagtttaacttggattttatcttacttttgaacaaacattattaaaactatttaataaattagactttacgttctcagttaacttctgctacatcaactggacttaatacatacatatataatatattttatataatttgaaaagtatatattatatattttatataatttgacgttaaacttccatgcaaaaagtagagtacacaaatgtaaaccattagtgaattagaaagggttttgcttcatattccatataattatttgtactaattgtctcatttttattttggggggagtagatagaaagttcagaattatatcaagatctcttatttctagatctgtgattttgcactgagcaaatagttaactgtatgttcacacagcctcttccactcatttagatttgaaatcttcagggagcagttgttttcatctgtgttgttttactcctggggaaacactgtacatgcggtcattgaacttatgttcccacacatgattgtttggcattcaggaaaaaccagagaaggaagtattgcagctgaggaagaaggagtccctaaagtaaatatccaggggtcttctgggattcatctccggtcaggtcatttccttgatttgaagagaccagaatggtatcaggaagagagactgacctcatacagaggacgatggtgctaaccatcagaagtgaaaaccttctttctgtttccatcagattaatcttgattgcttctgtagccctctgggaagcctccttattcctgtaatctgattgaattcattcactctaatgtgtgaatgcttcagaaccctaacctccctagggtgtttttagttttaaaagagtaggcttattaacctatagaattctttaagtggtctgtatttaattcgttcaatggaatgaaatggaaaaacattttccagttgataacggaggaaagccaggcagagagctgttagaagtagagcttttcctggtttcttctcaggattaactccaaaggtat

SEQ ID NO: 122599 - DNA, 1124 bp, Homo sapiens
accctgagaaagtgagaaaaagaccaggcagggctggtgtgcaggtttcagataatcctgcacaccagccccgtctggtctttttctcactttcccagacacaggtgcccaagcaatgagttagccatggtccagagagagagggcagtggggcaggacccctgagaaagctcagggaccatttgagactccacctccccagggtctaaacaccagctgcagtgtctcctctgcctcacagatgccatgccagtgcagattgtcggagaccatacccagatgatctcacaaagggagaatctgggacctgatgagggcaaaataccttttaaaggcacagcggaaagcatggttagagtagtgtttgctgttgtggttaatgaccttggcatgctgttcttagcacacacacctgaggaggacattgatcactgtcagctgtcaggaggcagcctgacctctgactcatcaaggaacatgttctggaggacgcgcattacatttctgacatattcatttggtttatgttacctttattccagactgttggaagcagattaaatatccctttgccagacatcagtcagctgagtttaccatcagctatgataatgagaaggagatgacacaaaagttagatctcatcacaagtgatatggcaggtaagtgtcatatttctaggactgtgctattagattggaggtgctgcttgtgggggagggagacaggagagaaataaggcaaaatccttttctatttagatagggtccagtaaatctgaaatgtgttttttctgcattctgcacagaattacaaactgacactgagatattacttaaaagccctattcagccagtcttttcacctgcaggggatatagtgacatccatagtgatagccctgatgtactacttgtatctggaagccctgaatctatttttgttaccaaagctttgattaaggcactggtacagaggggctgaaaggaggaattaaatacagttcctgccctgaggaaggtgagataggaaataaaggaactctctcagtatgagaagggcctcagtgtccctgacaagccacatcaagagtcgagcttcccaaaccatctatggggaaatgct

SEQ ID NO: 122600 - DNA, 1108 bp, Homo sapiens
ttggtcctcatatcctattaaacaaactactctgtgtccctcatactctggccatatcaactctattttcgaggctgtttttttctccatttccacactgtgtgacttccacctccatagcttctccagagccagtttcagagccacttcctccctgaagtatgtccccatgccccaggacgtcgtcgtcgcccccatctctgagaagaccctgcgaagcttcctgagcaggcggtgcggttgtgtactgcctgcgggtggcttctgtggctttcacatcagggttttccgcagtgcctgggacacctgagggcacccggggggaaagtcagtcaccacgacctgaagcagagtatccccgtctgccactgacaggccggcccgtgtgtggtgcccgctagctgccatctgtcttgtggtttcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcgggcaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagac

SEQ ID NO: 122601 - DNA, 1411 bp, Homo sapiens
agttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaaatggtttactttgtagagtttacatggttttatgcgcacactaattgtaataaactatgccaaaccaaactgcccctgactctcactagtcagccctgctcgctggggtgttagaggcactcaaggttcagcttctgtaaaaaggcaggtgccacagtggaaagagaaagagcttggtgccagattaggccagaccccaatctaccacagaagagaagtctggctgcttctataatgatgagactcggtttcctcatgtttgaaaatggtgttgtcgtgctttcttcctccaaaacttactgataaaaattagttggaacatttatcaaagtgttgtctatagtaggtccttttttctaatgtaagccttcagtgggctgtttacagaattttaatattggaatattagaccataagcataggcctagatctacagcccttctttacaatagagctgtcttcatctatcacagttcttctgcggcac

SEQ ID NO: 122602 - DNA, 2460 bp, Homo sapiens
attaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaatattttggcttgttattt

SEQ ID NO: 122603 - DNA, 1100 bp, Homo sapiens
aagatttatatgatgtccttatggcagtgtacaaaaatcattttctaggggtttcttgaattagttaaggaaaggtttgtatgatatccttatttaatatctgactatttagatgtatttgctgaattgctgtgtgcagtacaaagtagcaaataactttaaaactgaatacttgttccaaaattctataaatttaataattaagcatcctcttaaattttagatctattagcaaaaagactatggtcagtagaaagagctactataatgtttaaaggaactgtagagaggattcacgaggctgatcagacatgatggcctcactacctctttagattctagaattttattatttattttctggaaatcagctatctcttagatctctctacccctaagccttcccacaaagaatttggaaatcctttttaaattacaattacaataacttgactttctcattttcatttcctgttttagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggtaaaaatcactctaaaaattattattaacatattcattattattaaatgtttaaaatgtgaaggcctcagaatttcttcagtaaaactgttttgtgaggaaatcaaaggaatgaagagctttcccttgtttattgttttattgtatactatgctaacagtttatttaccatatatgttcttctatattcatcttggactgttaagacaagtacattaccagttactctactgcaagtgatccttgaaaaataaataaaattttttctagactctgaaacaaagaccaatatactattttgagtagatctatcttgtagactacattgtctgtctgtcttgatgcaaattcatctctcacaatgaattttaagctaattatgaataagtatgaagtatactgtcaccttatgattgctattagaatcaacttatattat

SEQ ID NO: 122604 - DNA, 1541 bp, Homo sapiens
gccaagtagccataaaataccatatgctggacaccataagtcataccttatagtgcaacaatgaatagccagtcactaatcagtgattgtaaaccaatgagaattcttatcaagcaactttgtatctgccttgttcctttttccctttaaaatctgcttgtaactcaggtgccagagcactccccaggcatctgggaaatatgtgttgagtagctgtcctcattttggctcaggtaaactaaagtatattttgtgcctcagccttttccttttaggtttacagtaggaatagtaatactagcagtagtaggtgtgttggaatagaataaagattgtgaaccaatactttaaaaaattcacctctgccttgaaagagtgttctgcctgttactccttttttaaagtaacagcacaacaatacaccttctttcacatcctcctttccctcagcaattgctctgttagtatctctttgaagtgatttattattcatagccaacagtagagaaacttttaactttgatctagagccacattgataatgaactggtgatatgcttgtccctttgctgctttaaatctgtcctgtttttaaataggctgttttgcaacattgaagcttaagtttaatattgatccagtacgcacttatgaacacgaattatgtgccagatgctgtattgggcacttaggatacaatggagagcaaaaaagggatgtagtcatggcttttatggagtttggattatattggaggaatttgttgggagaataatcatgtaaatgagaaattgcaactttgatgaatactatgaaaggtacataagagtaaatgagaccctattttgggatgtcagagaaggcttccctgaggaagttattgagctaagacataaaggaattatgtgtaaataggaatgaattaagctaagagaaataggaatgccattcaacattgccgtagagggaatgggaagtgaaaagcacctgtggtgggcaagcgcatagtgcatttgaagattcgagagatagttggtatgtgtaacaagagaagagggcaaaagaagcaaggcacaagataagtttgaacagacagagagggactatttctacatgactttatggccatgcaaaaatatttggggctttatcataatcgtgggaagtcttttaaaccagttcgtagcctcagatatgaagttagaatagttcactctgactatggtatggagaaaattgcagagaatgacatgaatgaatgcagaaaattgtttagaaggtttctgtttatgtgagattatgatagtgtggagtaagataatagaggtaggagaaggtattcagaacaagagaaactggagaggtaaaaataaaaaaaacctagagatggattggaacagagggatgagggagttcaggataaatccaagtgacaatcttgtgcagctggttgcctgaatagatagatgaatgtgttatattattagcaataacaatattgccaactttattgatcagttaccatgggccaacctctcttc

SEQ ID NO: 122605 - DNA, 1114 bp, Homo sapiens
ctactcctcagaaaccgtttctgtcggggccgtgagaggagacagtataagacttcctggacccaagggacgccgggtcccctggaagcgcccatcgcattgaagaccacgtgtgccttgctggggtcccattcagacaagtcccgggtcgttcgctcatcgccctccacgcgaccagggggcgcccgcggtatcggcccggctagttcgcaggcgtgcgccttccctcactgcgccggaacgggccacgttctcggacccagaagccgcgtcagaattccacgctggccaatcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtctgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtgaggcccggtgcggtggtggggggtggccgaggcgtcttggaccgctagaccgctggtctggcgggtggtgcccatggcacgagttgccgcggcctctctgcaaatcacagcgctagcgctttcgaggaagggagatcagctttattgaacacctactaattctctggatttgactcagtagcttttta

SEQ ID NO: 122606 - DNA, 2106 bp, Homo sapiens
ggatgtcaggtttgattttcaatcagatcttgaaagcattggaatttctttaaagatgtgagaagaatgatttaagagtattggtatgaagggaagaaaacaaaagttttattctctgttcaataaattacctgtgtgctctagagaggcatacatctttgtcagattggtaaatttaagtgcagggttttgtcagaaagggaaggcataggccagacagtaacgcttacaggctgatctctgattgccctatcatctttcctgcagcccgcaaggaacatgatgacgcagtagcctgtcatcaccaaatgatgatttgccctatagggtaaagtttgatatattcagagactgacatttatggaacttgctaaagaactcagcagaccaatagaaatcatgagactgttaggagatgacacaatccatgcctaaaccaatgcaaccagttttgcttggggaaaaaaataggtgaagcaaaagtggacataaaggcattaagcaacgtggtggattgatgtacagccaggtgattcttttaaagcaagtatctttatcttccagtagggaaggaaaatgtatagctaaattgtttgacttgatgaccgtgcctactagtacagactataatgttgccacatttccttgtttctgcaagtcctgtgtttaaattgctgatgtgattcagaagtatcctgtgtcatagttgctaaaagaaaaatgattagtaattaaaaggaagaagtaagctaagccaagttttggctgagaactgaaaggcaccttaaggagcattttcagtgaaagggcttacaggattttgtatcttaactgtaaaatcagtttttttgtttgttttttttaaaagaataagaaatattcctgaaataagagaccttcaattagtccattcttggttttgattcgttcatacattcatttacaggtgacagttggggtctgttaagtaccagatactcttccagacatgggaatgcagcagtgtactcatggaacttagatttcagtgggagtctgacaaataatatacgtgggtaaatatgtggtaatgtaagtgcaatgaggaaaagtaaagcagagaagggaagataggaatgttgaaagtcagtggtgtaggaaggggtacagttttaaatagggaggccaaggagaggctctttgaatatagacttgaaaatataggccatgtggatatgtaagaatcactcagagggagtatagacatgtaagctttatttagtgtttctttttcagtggtttttttttttttttttttttgagacggagtctcgctctgtcacccaggctggagtgcagtggtgtaatctaggctcactgcaacctccgtctcccagattcaagttctcctgtctcagcctccccaagtagctgggactacaggtgatgcgcgccaccccgccctgctaatttttgtattttcagtagagacagggttttgccatattggccaggctggtctcaaactcctgacctcaggtgatctgcctgcctcagcctcccaaagtgctgggattacaggtgtgagccactgcgcccggccatattcagtgtttctaaataaatgtctatttaagcttatttctagatagatatttaactatgaaaaatcctattgacatactcgtaaatgccactgggatacaagaagtacaagaaatggtgtctcttaaagagtttccactcaagtaaggatgtccattaaaaattaacacaagctaatatagaaatgctaagtgaatggcagatactttaaggagcgaaaaatggaaaatttcccgggttacctccatatttgtctggtaaggaagggagcaacacctgagctggacctagtcaaaaagatagaattgggattggcgtgaacagtgttctctgtgtgtgtgaatggggatttccctaatggcagcattctcattagactaggttcagtaatagcattgagtagagtgttgggagcagtgaatttatgtaatgaacagttgggaaatgaggtaggatgaaggcttggacagctattctggttacctactgctttgtagaaatctacccaaagcatagtgtttt

SEQ ID NO: 122607 - DNA, 1017 bp, Homo sapiens
cccagaacaaatgtttccagagacttggccaaaggctgaagctgaaagatgtcttaggacctaacctaggaaatcatgcagtgttatttttgctatgttctcttggtcagagaagtctcacatctgttctgcatcaagaaagtggagaaatggacttcacctctcaatgagaaaatggcttgtgtagaaaggttgggtgaggatttgaagggagatggacgggcagccactttgaagacaagcttaccaccttacattttattctgtcctacacccctttgctctcaaatttgtacttaaattcgttctaattatggttggatctagataacaacatttaatccttagactaaaagatctattatattgaccttaatttgactgccagcaaactgatctttttgtttttcactacctgcaatatttcttgattataatagagtctgcaagtaattctttcatctttcaaaaattcaggttgttctctcaggacagtgatcaggaattttttgagttcagaattctagcgagatttggctgttctgtctatatgattataatttaagaaatgaccataactgggatggtacaagaaccaggggttggggtaaatggattttattgttctagccttagcagtgttgtttgcctgtgtctcacatgcaggtacacttggctccaagttatctggatatgtattgttatcttaagtgatggaacttgttcttatttcctggctttattgtgccttgctgggaaccttgctgttgattggtatttttcaaaacctgtctgtggaccatctgtgaattagtcattggggatgcttataaaaaatgcagattcaacacacttagtaatcaaacttaatgagggaactgggacctgggcgtctctgtttttatcaagctacctgtatgatacttctgcacactgaagtttaaccctaacacagatcaaaggatactctgctacttgccttacattagattatttatatttcatgttccttttcat

SEQ ID NO: 122608 - DNA, 1272 bp, Homo sapiens
tttaaatcgaagctaggttgcttttgaaatggtttttgggtacaggtttctcacagtaacattttaaaagtctgcccagtgtatcctatcttttcaacctgtttctcaatgctttgcataccttttgctatgtctgtatttaggtatttaatgttccagtttcctggaactccctcttctcctttttctggcaaatggctgtatgcctaccaagaggctattgttcatcttttccgagtcaatcctaaatatcaccttgtatatttttgcctttcttgactattcactccgttccctatcttactatatctctgaatctcctcagaacttcaaacatctctaaaggtacttctgttctctgctttgtgtagtcatatttgtatgtatatgtgcataaactttcttactagattataagctccacagatgctatccatccttctcatttttgcttttcttacagagtgtatcttggtgttatgcatgtaatgaatagttaatatgtgttccttgaattcaaagaagggccgcatttcctgtagataagaataatgaactgagttgcactctctgcttcccaacacaatacccagaagccttaaagtaatggaggaaaatgaacatagtttaccctagtttacttagttggcacagtgacacagatgctattgagaagtatgattttcttaagtttattctccttatgttgaaatacagaggtgccggaaatgttgaaagtctaaatataaatgtgattacatttgacatactgaatagtacaacctagtgtttatcttccctcatgtggaaactcatgtaagggagcattctattcttaatctctacctttgtgtagttgactttttgtacagtttcacatttatcttaacatcctgaaatgtcctcttcacctttttctggcaaagggctagctacctgtcaaaagactgttgattcttttcttttttgacatggagtctggctctgtcgcccaggctggagtgcagtggtgcgatctcggctcactgcgacctctgcctccggggttcaagctattctcctgcctcagcctcctgagtaactgggattacaggcatatgccaccatgcccacctaattttttgtatttttagtagagatggggtttcaccatgttggccaggctggtcttgaactcctggcctcaagatccacctgcctcagcctcccaaagtgctgggattacaggtgtgagccaccgtgcccagcttgttgattcttgtaagttcatcc

SEQ ID NO: 122609 - DNA, 1037 bp, Homo sapiens
gagcttttgtgcttaaccgttacattattttgatttccactggtaaaagaatgtgacgacagtagtcacttttagtactgtttctgattcttttgggtcatcttcaagctttggtaaacaggcacttatctacaggttatagaaattatttgtaaaagatatttaaagactaatagagatttcttcatcccactagtgtacatgttcatcctttgagttataggacacattttttaaaaaaccagctaaaaatttaatgttatggtgctccagctttgtgttgagctgttagtttgtcaggtgagcagattctgtaaatatattctcattttaaaaatgtccaacaagatgccgaaaaaacccacatggattgttcattttacatatctcttgtgctgacaagctaggacttaaatctagccctcattttgttatatactttgtcaccattacacatacctgttctcttactacagcactgcagtataattttctacagtataattgttgttctgtgaggtgtcctgaagggctctctcctgaaataaaatagcttaatggcctatgtattttgttatgatttattttcttatgactacttcagtcatgtaaaattttaatggtagatttttttcattttaaataattgctccataaatatatgttttcttctctgaagattgctctctagtcgttttataattgagttgttagaggtaacttaggtgactagtttaaaaagaaaaagaggtaggccaatttttagaacaggcatttatttataaatagagattactttaattccataaccagtgaagtgcttaataatgaggagagattgtttcaatgcttatctcatttttttctcttgtttgttcttgtaagtacttgctattatttcttaaaaagtctgtttctgtagaagggaataaataatcacagtaaaaattccagtttcagatttaaaagagatagtaaatgtattttaaaagtctcattttatagacttgattatacatttcacataccttttaaaa

SEQ ID NO: 122610 - DNA, 1421 bp, Homo sapiens
atacagtatgtaacctagtaggtagattaggcaaattaacttctactctactctgttttcttctaatccatatgtgtggcttctcctctgttgtacttccaaatgttgtggtgtcctagagtttggagctgtatgtatgcctttgtctttctgttactcactttgttgcaactactcaactctgctagtgtagtcaaaaatggccataagcaaatgtggctgttttccatagcagtagtttgctgacccctgtcctgcagataatctccccaatcccatggatttaaatgtcacgtgtgtgctgacacacaggtttgggctggaaatacagtcctgatatctcccataattccagacttctatatctaactccttgtctaaaataatttattaggtcaatcctatgccttgtatgtctaaaacagtactttttgagacctaatccttgttttagtctccattgcagccatccaagtttaaattaccattgttctttcacctggattactgtagtagcctcctaattgatctccatttttctatcctggtccctgtataatccattcttcacctaccagcgaggtgatctttttttgatggcatcatttggactgaataaaaccctccaacagcttctcgttgtagttggaatgctttcgaaattcattaccaaggcccacaggccccttcatgttacggccactgctgacatttctggtgtccatatgatactctactttcctcgaatgtgatgagaaacctgactgctgagagaatatgcaatagagtgattcctataatagcaatcacctggggaagtattgatttttatattttaagaactgaaaaaaacagcaaaaaactttttgtttaatacagttgttaaaataatcatgagactagcaccaaggaaggatacatattacacaagtaaaaaaagcaggatacaaattgcataatcatatacactaggattacatatgcatgtggacaaagactagaaaatattgagaagtcgaaatagttgtgttacaatggtaaggttagggacattccagtagttatggggaaggttagggaacattcccttattatctaaacattgaacatcttattttttaagactagaatttaaaacaaatgtttcttagaatctaaaatgaagtcttcatttggcccccaaaatgcatacctgctgtttattaagaaataacaaaagcatggtagtctttctgaggtataactttgctagaataatattcttctttcacggaagttgaagattttgtggttttacttttatttttttcaacttttattgtagattcaaaggatatgtgtgcagtttccttactttggaaattgaagattttctcgtgtgtgttttgtcataatggctatttgatatatcttttctttct

SEQ ID NO: 122611 - DNA, 1983 bp, Homo sapiens
atttaatacaagtagtaaatctgcagaaaaggtacattagactgtgagtgaggaacataacaggctctagaccactgctgcagtttataatttcttggagaagaaccttaaagagtttaggcctcagtttctgaatccataaagattttaagtaagtgatctcttaaaattcctaagtctaaatttctgtcatattcacatgccactacttaagtagttacctctgttcttttttttgctggaagccagactcttgtattaacaaagttttgttgtcatgttttccttttagattctagtttaggactagtcattacagctttgtttgacattcgtttagttctggatctagtgttgttttcatagcaagcattcacttgaagaggaaaaattaacctagttgtgttttacttgcctttttcttttttaaaggtattttcaaaagaaataattccagattgatggatgaaattttaaaacaacagcaagaacttctgggcctagattgttcaaaatactcaccagaatttgcaaatagtaatgacaaagatgatcaaggtaagcatgagtgtataattgaacatgtaacatatgaagatgtgtgttttgtgtttcatggcaatttctgttactctgtcatttattcattcacgttgctctgttactctttattgtcaacatctttaatcatcagatttagactttctcgtcttaatcttggtaaaaagtgaacacatgataaggattttatttaaccaggcaaattttttaactggttccacagagaatccatagaatggacacatttgtagagatattgaaatgaatatataaatagaggtacaactggttgttctatggagtgaggaaagaaattgaatctttgctggacaagaaagaatttgcatgtctatagataagaattttgcagtgttatctgagaatcccatcaattgtaagatagctcctataaaagtagaattgataaaggtatgtatgctataggcaatgcatattccactctaacagttttttcttagtctttattttttcttttattctgtgttactgctaacgatatcgcaattatacaggaaattttagatgcgtgaaaatttgttagctagcctataaagtttctgttttctagaggatgtagtcacaatgtatagtcattctgaacactttgaaaagaaggcagtgtataaatatatacatggatgtgatttgggatatatggatcctttcagaggagaatagctaagtatgttttgatattgaaattgaagggcttaaaaaattcttgtttactgtaagaactgtatgtttattttggtttaaccttgtatttcttaaaactgcttttgaaatatacctggaagagagtgtttttaaaatacattgtttgttttttcttccagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagtaagtttttttatatatatatacatatatatgtatatgtatgtgtgtgtgtttagttttgtcacacgaggatacagtatgaaagaaaatatttttgtttctttcacaccataaagcctgattcttttgttgttaatacctgttaaatttctgaaatttaaagacctatgtaaaaatggtttcgagacaatgaaatttgtagccactcactcgcatgaggatttaatggtaaaggagatgacctttgaggatcttttttgtagtgatgaatattcttgaaaataggacttctgcttgttagccttcctctccctcttcccctttctttttagtttgaactttcccttaactttgaacttaatctttttatgaggtgatcccaggaatataatcttactgttaccatgattcc

SEQ ID NO: 122612 - DNA, 1004 bp, Homo sapiens
ttggaaccttagtctcttggattatagtatcttttttctgtactcttcaaattttatttttaagctattgaaatacccttgtcctttttttccccaagtcaggtctcatatggaaaccagttcatgaaagagataaaaattgaccttgtccttgttgaggcagatgcttggtctccttttcctctctgaggctgctctggctctggggaccaaggaagacatttgtgatgtatggctaggagttggtctttttgggttcatagctgtaaaatgaggtgcatgagggaaggaaggagaatagatattttaaaatttccttttcgtctctgaagttattcaattctgtggccagaatcaagcagtcacacctttagaactgtagtaactttcccaggattccaagagaacacctacattgagtcttaaaagatacatgtgattttgggggcacctattgggtatagtgtgggaggtgggttaccctttcttatcaggtaatcaatcaagttaaacagacttttgagaaaacttccacatttggaatgagcatagatattaaagtatgtattacagagttgggggtggggcatggagacatacagataaaacttctgaagaaaacaggtagtttaaagaaccaatttgattaatacattttgcccatgatctgtgtgtttctgtgtgtgtgtgtgtgcacatgcagtgcatgttaagttcatgtgtatttatttatttccaaggttcaaatggttgtcctgatcctgatttagtattgaagttcggtcctgtggacagcacattaggctttcttccctggcacatcagattgactgagattgtgtaagtaattaaaagcgtactgactttgtttagattcagcaagtgtttcttgagttcagcactgtactagatctggtggggatttccaaagaattataatactggatcctttacctcagttatttcacagtaccactggtaaaataaagtcatacataaatgag

SEQ ID NO: 122613 - DNA, 3487 bp, Homo sapiens
cccaccctttcagtctacatattatgattaagacattttccgtgcctgtcatggtgctgtctggtggaggataatttggtgtattctattcttaacttctttttggtccttatcttctggttcccccctacattacagtgtatatctaattgcttttctccccccgtgttttcttttcagctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgactttttttttttgttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaatttccaaattaaaaacgtatatgtgtactcttttaaaaaggaatttgatagttcttgtcaaatgagaaaatttaaaggtaagagttatggtttgtcttatgctgcatagactattcacctcctaacttgaaggtctaat

SEQ ID NO: 122614 - DNA, 1072 bp, Homo sapiens
acagggaaccctgtggctgtggcaaccacagggtcagaggagtggtgcagctggaaatgtggatggaatggtttgggagggaatgtgaggtggaggtgttgagaatatgacttttgagaaattttgtcctaacaaggaatagagtgtaaggagagtcttttaatgggagagataatacaacaggtctgtgtgcttatgggaatgctgtactgaagagggaaaattgcaggaaggagtgagataaaggaaggagggaaccttgagaaggctcagatggtggaattcaaagcatggtggggaggaactagtctttgacaggactaggacactgtccatagtacagaggagacactgagaatgggggtgtaaatgaaggtaatttggtagatttcatgatttcgtggtgggaatcataggcagttcctctctggtggcttctctttctctgtgaactctgaggcaaggatatcaatagtgaacaaagatgctagttgttgggggaggtgtgtaggatgtttgtacaaagagaagtgggaaacagtcatttcgaagagtaagaaaggaaatatactaaagaagtgttatgtgtaaagttgacatttgtggtggggattcagtagagggcgtgatgagcagaaagaagctaccgctgtttagaatctgcgaccttggaaaagatgaactcagatctgtgcccaagaagccagaaccatcatcttataaatgaggatagtggggcagtgcatatttgagggggctcagtaggacttgggtcctgattgtactggggagtggggtatgagagagagagaagagggaattaagataattttaaaataattttttttttaagagacaaagtttcacgccatcatccaggctggagtgcagtggtgcaatcatagctcactgcagcctgaaactcctgggttcaagtgatcttcctgcctcagcctcccgagtagctaagactacaggtgtgcaccaccatgctgggctaatttttaatttttttttgtagagatgttggtcttgcaatgttccccaggctggtcttgaactgggttcacgt

SEQ ID NO: 122615 - DNA, 1115 bp, Homo sapiens
gctttatttgacctcagctaggaatgtgcatgttgtgtgactcaaattttttgccactctagatgtatgtctgtgaatgatcatgaaagtggcaagagtattgaaatggggttataaataagttttagcaagtaagcaacttcacagttatggagtccgcaaacaatgaggatcaaccatacttctttgaaagtcaccttctctttgttcaagtatgtttgaacaaaaagatgtttgtggttctcttgattgaatttggtgccctctcttatggggctggttttcttgaactatttgatgattcctgtatgtgctcattgctgtatttgagattccttgcttactcacctgtaaataacatttctgcttactaggatctgcctttgttggagggtgagagttgggatgtgctgccaagtgtggtgtttaaatgctcctcttctgcatatagggactttctgtttcttgtgaacactgacagtccaagtccctccaaagtctactgtcctcacatgctgtgtaggtccaggggtggatgcttctgctattgctgttgggggtttgggtagttggtggtaggattatagaaggtgtgagggtgggatgtgctaaactgttccccagccaattactggcccacttccctaggacttcttcctgctgccttgtctgtcatccctgaattttgagtgtctcagagttgctctcatctttgcaattgagttctcctccatgttatctggattgtggttttcctcatcaaagactgaattcttgtcagtctcgaaatccataaaatttctgttcatcaattccacccattcttgttatctagcactgttgtgaatttattctttttaaaaacagatttttggtatttttaggaaattgaggtgggagtagataggcataaaggcttagtctgacatttggatctaattccctactattttaattagaaaaaattacagttcttttaaaaaaaaactttgtattttaaaaatgttcacacaaagatgtctcaaatctggatatcaaggcaggatttgcatggaatcctttattgatggcttatgtaggcatctataagaataaacaagtagttccaatttatt

SEQ ID NO: 122616 - DNA, 1030 bp, Homo sapiens
cctctgtatggttctattcccaagcatcattggagggcttctgcatgtttataggggctgaagtacgtgggacggcaagcagtcatgaaaagaaaaagaggctacgtgaagtggaatatagttaatggttaatgttttatttttggagttaatgttaagctttacattttctaaactctgttaaactatgtaacagtggtcaaagacttttttttgtatattcataccacaacctacactattcttttataatcccaatcttttacagtagttatcagcattgtttttacattgcctttttttcttattttttcccaagaaatcattttggggcagggagaaattctccatagactccatggtgcctctgctgcctgatggatgttaaggattctgatgtcagtctgacaagctaggcattgcattctctgtatgtttcaagatcacagctccatgcttatgcttttaagaatacaaaaatacgagattcatatttaatctgtgatctattacaacccccaaatctgtttctgtcaaacttatatttaaaatatatttatttacagtttctgtttttctttctaaataaattagcctttctttatttctttttacattgatgtgatctgtaaatcagttataggaaatgaagtaattttgactctaactttactgggtgtatttctgtcatgtatttcttgttagcttttccttctgagatgacaacaaatatttttgaaaattactgaattgcagatggtatgaaaggagaccaagaagtcaatatttaatgaggattttgactagcattgaagcctttatttcaagaaataaaaactatgattttagagaacagcaggttcttttccctaatcttcattcttcgtttccatgcacataaaatgttatggaagtacaaagggtagaaactattttaattttccttgacaacagcattcagaacattagcagtggtgaataatgtgggatgatgagttgacatttaattggagcagaatctgtggtatgg

SEQ ID NO: 122617 - DNA, 1479 bp, Homo sapiens
atttcagagcctgttattggtctattcagagattcaacttcttcctggtttagtcttgggagggtatatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttcttctttattagtcttgctagtggtctatcaattttgttgatcctttcaaaaaaccagctcctggattcattaattttctgaagggtttttttgggtctctatttccttcagttctgctctgattttaggtatttcttttttttttttttcctgcctcaggtttatttgtacaaatagcacaggaggaccccagccccatgcagatgatagcccaggggtgggggtggggggtcgcaccagtccttctgtcctcatgttggcagagatatctactctgaagcctttgtaggggcctgggtacctttgggagcctgagctggaactgaagctggagctgcagcctgggccttggtttgatccttggccttggccttggcctttggccggcacagcctgagccccttggcaatacgggcaagagcacgcttcccaagcttggggtgggcaacgtaggcatgtcgatcgagcttgcagctgactccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagtgcctagaaccggaagagctgattttaggtatttcttgccttctgctagcttttgaatgtgtttgctcttgcttttctagttcttttaattgtgatgttagggtgtcaattttggatctttcctgctttctcttgtgggcatatagtgctataaatttccctctacacactgctttgaatgtgtcccagagattctggtctgttgtgtctttgttctcattggtttcaaagaacatctttatttctgccttcatttccttatgtatccagtagtcattcaggagcaggttgttcagtttccatgtagttgagtggttttgagtgagtttctgaatcctgagttctagttggattgcactgtggtctgagagatagtttgttataatttctgatcttttacatttgctgaggacagctttacttccaagtatgtggtcaattttggaataggtgtggtgtggtgctgaaaaaaatgtatattc

SEQ ID NO: 122618 - DNA, 1084 bp, Homo sapiens
cagaaggcaagaaatacctaaaatcagctcttccggttctaggcacttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggagtcagctgcaagctcgatcgacatgcctacgttgcccaccccaagcttgggaagcgtgctcttgcccgtattgccaaggggctcaggctgtgccggccaaaggccaaggccaaggccaaggatcaaaccaaggcccaggctgcagctccagcttcagttccagctcaggctcccaaaggtacccaggcccctacaaaggcttcagagtagatatctctgccaacatgaggacagaaggactggtgcgaccccccacccccacccctgggctatcatctgcatggggctggggtcctcctgtgctatttgtacaaataaacctgaggcaggaaaaaaaaaaaaaagaaatacctaaaatcagagcagaactgaaggaaatagagacccaaaaaaacccttcagaaaattaatgaatccaggagctggttttttgaaaggatcaacaaaattgatagaccactagcaagactaataaagaagaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatataccctcccaagactaaaccaggaagaagttgaatctctgaatagaccaataacaggctctgaaattgtggcaataatcaatagcttaccaaccaaaaagagtccagg

SEQ ID NO: 122619 - DNA, 1067 bp, Homo sapiens
atccttattttgtgatatagtgatatctcaacagggatattgtaagactcaaatgcaaaatgcaagtgaaagtaacttaccaatgtaagtcactaagatattgttattatttatcagtctttgtatggaggtcctgtattttgcaaattcagtaattaatctggataaatatgcaccaggccaccttcaatttgttaaatttttactaagcttatatttcttcttggaagttgatgattgcacaggatgatttaggtgtctgagagtgctcttttgaagttttcatttttattcatttcaaatcctgaaattgagtaatctctaaatgttcttatggagaaatatccacaaaaacgtttggggttacatttaatatccagaatgtctgttttatcactgagagttttagtgatgactgaaagtgctaagttaaattgtgtatattttgcttattgtctgaaacttaaatcctatgtaaacaatgtactaaccattgttttggaaaacaaagttctaatcctactagattctgtcctaccatcacctaaaattcagaaaaactcagtttaaaatttattcaacaatcttgttttcaatttttttattttttattttttaaaaacagggtctcatgctgtagcccaggctggaatgcagcagcctgatcatagctcactgcagcctcaaacttctgggttcaagtgatcctcccacttgagcctcctgagtagctgagactacaggtccatgccaccaagcctggctcattttttaatttccttgtagagatgaagtcttgatatttttcctgggctggcctcaagtgatcctcccgccttggcctctcaaagtgctgaggaatacaggcaagccaatatcgtacctggcctcaacaaatacttattgagtgtctgttaggtgctagagatagatctagttgctggtcatacaaaatcaaataagggaatatacagtctcaggcagagaaacagacaaacacataaaaacacatgcctacaacatggtggatgtcatgacagaggtatttagtcacaggcatgctagga

SEQ ID NO: 122620 - DNA, 1011 bp, Homo sapiens
taagctagataaatgtttgagatgatgtatatcccaattaccctgatttgatcactagacattgtatacatgtatcaaaatatcatatgtgcccccaaaatatgtacaactgttatataccaataaaataatttttaagtagtacacagcaaaaaagaaaaaaaaaaagcagcgactatcacattgtatttataggctccacctgcctgcaagggaagaagattatgtagggtgtgcacagcagggggcttgaatttggaggagcaactgagaaatctgcctaccatgcccatgcatgacattgatatgttggggtcaatatttaaattaatttcaggtttgatgtttacaaacagtgcagaagctggactctgaggaagttcgtaataaaagttacagcatgtggctgccatcactcacagaatattgggctagacggtccatgggcctgaccttatggagccatttaataatattcttgctgaaatagcccaagaatgaaaatttagctcacaattcaggataagagaaccttttctggaatttacttagaaaaacagaattttaacctatatttaatgctagtgacagaccagattagacctaagcagatggtcagtgacaactgcagatggcaacagcctctgtttaaaagtctatccattgctttggggaataacaatctttaatattttgcttccactgtctaaactccctctggagtttgtttctttgtactttccctcagaatatggctcttctgctcatgttttcatttctgttaatataaactaaagacctatatgaaggatttcagatggtactattataattattgaacatatcacgttggagaacttaaaatagttacagcccttagaaatatcttttgtgttgatactcgtgtactgtcgtgaagtgtcatttatcactttctgtatctatgtccagttaacgagcaacaaatcaagatactctggtgattttggtgtgtcgaattattcatttatt

SEQ ID NO: 122621 - DNA, 1029 bp, Homo sapiens
gcatgattttgtgggtcagcaatttggctggaattagctgagcaattcttccactggtctcacagggggccactcgtctggctgcagttgtttggtggctccgctatggctagataatctaagatggtctctcttccatgtgtggaatttggtgctggttgtcactggggcctctgtctttaggggagtgaggtggtgcggagagtggggaatttgccagatctctggaacctgagttcagaattcttgcagtgtcaaacttctgccacattttgttggtcagagcaaatcaaaaggctacccacattccagggggaaaagaaacagagtctacttcttgaagagaggattgccaaaaccacattgcaaatgggcatacatacaggagtggaaagaatctgtggcaactaaaaaaagtttgcagtatatcacagaacatgatcagagttttgttacaaagtctttctgactacagcatcaaaatgaaattggtgatcgggaagaaaatttagactggaaacctgaggactaatccggaagttttggtagcaaaccaagagtaattattggtgtattagtgaccacaattgcaaagtgatgaacacatgtgaacagactcaaaatcaatattaagatggtaaaactcggaaatggatttgatgtagggaagggtcaagaaggaagaccaagtgtctggtttggacaagtggggagcaaagtgatgacattgaccaacacaaggaagactgaagaaggaccaggcttggatggcaagttgagggctgctggaatattgagtctgagaggcctgcagagaggcagagctctcacctgaggcagagctctcacctgaggagaaaaggaagttgatggggtttaaggaaactgctgaaatagctgtcactgggaatggagactacaggacactgggaaactggaattatggacagtgctgagcacttgtcagggaatagaaatcatgaatgcaagtgactcaaggctacaagcttggacaattttttttttttt

SEQ ID NO: 122622 - DNA, 1016 bp, Homo sapiens
taattcttttttttcttgtatttttagtagagacggggtttcaccgtgttagccatgatggtctcgatctcctgatctcatgatccgcccacctcagcctcccaaagtgctgcgattacaggcgtgagccaccatgcccggccgggcaattttttcataatgctcagccacccttatacaggaatagagaatgcagcgaatagatcctgtcatttaatatgtgggcttggtaaaatttctttgctcaaggtaaggataagaagtttaggtggagatttctgaagatcaaagtaaggtatcttaaaagtcagtgaaggagaccagctgcataatttgctggacacaaatgcaaaacgaaaatgctgacccccttgttaaaatattgtgtagagttcaagatggtgacaacaaagcattaagccaagctgagacccctctgagagtgtggccctgtgtggctccataggacccaggcctgtgaagctggtttggcaatagggaatccttatggggattggcagaatataatcactgagagaaaatttggatacttctctttgaacatctttttcctttcccctcttcttttctcaaatatataaataactaaggtaataaagatgatgatatatgctagggaaatggtgggcatggaagggatttggtggcatgatatatttaaggactggccctcactattcatctgtgcctatttaaatggaaaaactgatgtctctggcctcaagtcctatatcacagtgtctgctccgtgacagttgggtgagttcccaagccatattaatattaaggttatcatcttaagcacagtattcctaaaatcttctgttttcttataaacctggagccttcagctccattgtctttgagtctgtctgaatgccgacttctttgtgctgtaaaaaaggaaactgctctctagcttattgaagactattcccggaatcaagggaataagaaaccaattttgaaatcaatgttgagttaggtctgctggg

SEQ ID NO: 122623 - DNA, 1041 bp, Homo sapiens
tgaaattcaaaggataacattgaacactgagattcttgcagatgagttgtatggtgaaatttgaagaattattgtaaattaagcatctgaggaagtatagtaagaagaaaaaaaaattctcttctaatttgagaagagattaatctggctaaaacgctattgtcttagtctttggccttgatatttgggttaatgaggttttgaagtgcagtaagaggttgctatggtggaagtaaaatactggacaaatcctgatttatcaaaagattctgggaaaaatcaagagtagaggaggtctgttttttgtctccagtatatcctgttggtggaacaagtttgtgatttttcataggaaaatctttgagaaatgaagacaactagttactagagaaggaaaagacatttgaggaatggatttctgttgtgtagagacagaaggcttgtggaagacaacctcctttgctaaatgtgtggaagctttcagattaaaaggcaggcagggatgtttggggagggtgagggatgagattattcagcagcaggagatattccttcctttgaggggctaggaaagcatccacgcactttcctgttatatcttggtgaggttggtacacggaaaattatcccctggggtgaaggaagaaagtaatacaatgtctcttattctatttaatctatttttatgtatttttaatgaatataatataatggcacatatttatacacatagaatgtaggaataaatgcatagaatatgagggggtgcattttcaacttttttaagcgactatggtaaaaatatctaaaaattttgggtttttagatttctctttcctccagtaactcagcccggcctctctgaacatactccataaactaggaacccaaggaactggtttgttttcaatagagagcacctgtgaatcttgtaaattattgttttaacttaagaactcatcttatttctgtcttatttccagacatttgtttctcagagtccctattttctcatttctttttttaatcccattgctctgt

SEQ ID NO: 122624 - DNA, 1032 bp, Homo sapiens
ctaagtgctgcctataaagccactccccattcctccttacttctgtgctacctgccgtggtagtactgaggtgaggtaggtgtcaaatgatctcatgctcacttttgtgaggtttggatgttctactcctacaatagcagctttcccaatcttgcagctcaagtatctcccaaaactggaagccacagctaatcaggtctccatcactgctccatgtcccttctgttcaaattcctgggatcgctgcactagatatccacacctcctgggggttgcggatctagattttttaccatcccccaaagcatgccaactcttctgtccctctcaccttccttacctagaatgttggcctcactttctcctccacacctctcttgttagaggccttgtttctaggggccaaccgcttgcccatgtgtgggaagatcctgtgttcctacagctgtttttttgaaagagttttcatatcctttttacttttgtattcaatgcagctgaccatcttatttataacaatttatttttagtaaatgttatttctttaaccttaaaagtgaatatcagcatattttatctttctaatgatgctttttacctatcatttacttttaagggggaggagggaggaatcacaaatagctcaagaagaatcatatgtattagcccaggtgccttttttattccacaaaaccatggatgtggagaaaattccttacactgagcctcagggaagaccctgctcctacccagtcaactacaggagactgacaataccaataaagaaacccagacagccagatgaaaaagataactctcttatgtttttcccaggatatttcagtccctctgagagtgggtttgtgcactaaaaacccaggtctgtgattgacatataatcagattcacccatggaggtttagcaactcagtctctcaaaactaaacttagataatagcaaaatagttttgaacattcttctttagaatatttctatgggagccataacagaaagattatgtccacgttatt

SEQ ID NO: 122625 - DNA, 1020 bp, Homo sapiens
aaaaaaaaagaaaagaaaagaaaagaaagaccaatggagaatgtgaacagaggactttttaattattttgagacagaggagcaaagccagtcaggaaatggttgaaattgtgtcagaggccttatagcaacttacttaaaagaaaccctacattataagaattgactatatttattaattgtcaataatatactcattacacaggaattatttccttattgtctttatttgaagacttcaaaatgctaaacataaagtagcactttactatggtcatgatttttgaggtgtatagattgcaaaagtatcacattttacgcagggtggaagtatcacatggatatattacagaacttcagctcaatgcaaaacagtacctacccagatttcccacaaagtgtgaacataataaggcatgtgtcccaccttcatactcaccccttttcacatagagtggccttaagttgagttagattccagcgtgattcaaactgagttgtcatgcaatggcctgaggctccagtgattcagaagagcctgtgtggatgactacaaagaagaaccaaaacaacagaaaaaaaaagttccctacagcttcatttatcatttgacttcacatgatttatttataaaggatcatcatctcaattccacttctatatacatgcatattcaaaaggactgaaatcagagacttgaacagatacttgccccagtgttcatagcagcgttttatttgtgatggctaaggtggaaacaactcaagtgtccatcagtaaatgaatatataaacaaaatgtggtatatccataccttggaatattactcagccttaaaaagaaatgaaattctgatacatgttgcaacatgagtgaaccttaaaaacatagtaaattgaatgtcagacatgaaaggacaaataatatatgattccacttgtatgaggtacctagaatcatcaaattcatagagacaggaagtagaacaatggctcctaatggccaggtaagtggggaatat

SEQ ID NO: 122626 - DNA, 1057 bp, Homo sapiens
tgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccac

SEQ ID NO: 122627 - DNA, 1018 bp, Homo sapiens
ccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaattttttataaaaagatttatgtcctctaagagcctaatgttagtataagaatgtatttgtactttcagactctctattctgaattctcaatgacaagaatgtgctgtcttgacttttaggtgaaagctttgtataaatgcacaggagaatctttgactaaaacatggagaattctgccttctatcttataatttctttccaattacaaaaaagctttttctcagggccttctcataaagggtactgagattttctgatggcaggtactgtaacataggaaatcatgcctgtgtccatttcagttaatagcacagtgtctcctttctgactttctagaatccctgtttaaaccaggagtcttctttctagttttccaacagacagaatctgacttcagtattctacgttgctgaaagttttggttggcaagttaaatcttttattttccaccctctaatcaaaggttaagaacgta

SEQ ID NO: 122628 - DNA, 1036 bp, Homo sapiens
ccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaa

SEQ ID NO: 122629 - DNA, 1060 bp, Homo sapiens
tttcccttttattctgcccacttgtaacctataaacatgacatgataactctctgtatctactttttaacctttttaaaaatgttctttctagaatgcctgttcctttttccattcttgccagaatctgtttttcaaaatctgtctcaaaagccacctctccagaaaagcctttttcctcattcgctcaatgtcttcatgtatcctactttctcccaatactttgtacttaacatggcctttatttggctaccatattcattctgttctatattacaatcatctaaaggcttctcatgtctctgattaaaatttgagtttgtaaagggtgagtctgccatctttgaaatagcctggacatgataaatgctatttctgtaatggttgagttgcatgcttaccttttgggaaagtatcagttcttcaaggcctagttcaaatttacttctgtaacaccctcccttagctactgcacatgtaactatcttagcacttagtttcattgtctttttttggtctttttgtgtatgacacattaaactggtgggatctgattttattaactgtagaatccccagcacctagcacaatgcctaacgtatgtgctttgtaaatatcttttaaataaatggaaaaataacctctttctttgcttttacagtactttgttgatatctttttacagcacttaaccacatgctgatttgtttgaaggaatatttgtatttcctgccttcctcttccagattttaatcctacatgggggagagggaatatcttccccttgaaaagaatttccttcaaagccttgctcatagaagcaataatacatttattcattcaacaattattttgtgagtacttattttgtgccatttttttctatgcaatagggaatataagatggacactttgagatggacaagaatccccgattcatggatcttactttctagttagagaaacattctattaatacatattgaatttagtattagctggaaatgattaactgtgaagaaatttttctttagtttttatttatttacttagaactttca

SEQ ID NO: 122630 - DNA, 1034 bp, Homo sapiens
tctaaatgaggccttcccagtgctccctgagtttggcagctactaaatatatatataaaatgtttacctgtaaaaatgtctctgtttcacctttacacattttgaaatgttactttgatggcatactttgtttcttcaaattaactcacatagttacaaggtttataactaccttttacattgcatgttcatgtcaaagttttgtcattaataagttataaattatatgcttaaattaacatgttctagattacttatattggttacagtgatgtagaaacatgatagattactttgaaattctaagtagaacagcatagcaacagtaattttatgatttatcaatatgtgaattttgatacatgtttttctatcaaaacaagtacctcggttttctgggatattgtcaagatgtatattttactagtaatatataactgccatgcaatggtatgcttctcaaagccagttatgactttactgaataaaaattcttgttttctaactacttgggaaaaaatgtgttactaaagggatataggggagaagttatttgaatataaaatcctttcctcttttctatattaggaagcaggattgtcttctgccttaatagaaggcttctttgttctcctagagttctgacagcgcctaagaaccagcttgtaggttgttatcaacttcattcttcatccatgcattcttggtgtagggtatatatgtcatctggccttttctcttatctcatggctagttgcagatgtggagttgcaccaaagtgatgatgagataggaacttacagccacgacagtgcattctgtcatctatagtgcatctttgggacttaaggattctcttctagcagatgaggcctttatttcccttcaatacttcttctaaggtagaaagtgaaataaagtataagtatttcctgtattatattttttgttgatgtctaacatacagtaaagtacataggaatattaatctttaataatagctccattccaatacacacccacatacatctccc

SEQ ID NO: 122631 - DNA, 1131 bp, Homo sapiens
aggcagaaatccatttaatcaaatttgtgtgaaaataagatagttaagaatattcgtgtgtcaaaataactttttaaagtatcaaattattctctaacgtcagattttttgtgtttgtgaacattgttttaaaatttctaaacttctttatgatacaatattgaatttaatatcagtaactcaatttattaatagcatggaatttttttagaaatgtttgttaaaagttgactggactttagaggggaaacatcctcaagggcactttaaaagtagcttgtattatatattctgaaactccatttcattattcactgtatgaaattatgataatattggaataggcatgctgataatgtgcatgttgtagtcaaatgactattcatattagttcagatgtaaatagctcagttctgcactgtttctcagcagagcaataaataacaaaattaagtcattgtttttgcatggagaaattaaccactactaccaaatatggtaacataattggaagattttttaattggcagaaattcacatttgaaaagcaaaataaaagtgaaagataaatttaaatgacaaaccagtaaccaggatcaaagatgaatatgacctttttcatttcaaagttgtctcatttttcctgtcactaaatggataagcatttataaatttaagcactttgtcatgtcattttattgcctaagattgaactgatattcataaaattaactcattttaaaagttcagattatagaaattataggaattaagaattatagaaagtaagaattaccaaagtcagcgaaatctgtttcttaccttggcagctgtgatcatcacagtatagagtattgtgttgtatgaagtcttacgggtgtttagctggggagttttctgactctgtcacccagtttatgggaacagttgcagtaggtggaggagaaaaagtgttctagggaggtcttatgatgtcacataggaattctgaagtttcgattggttagccacagtctcagtcttatcacaaccaaactttagaacttcttactttaggtatggaaaagtcattaacactttgtgcttcatcttttgtttttaatttaaaacagtatatggtagataaatgaa

SEQ ID NO: 122632 - DNA, 1046 bp, Homo sapiens
acaatgctttacaagtgtatttacaagtaaaatattcttcttaaccctgtaggagttggaaattcagaatcttttctgggggaagagaatatggggaggtagtattgagaaagtcttaaggatttaaaatgaatgccacttaataaatataccccctattaatgtgagtgagttagtcaacctttttttttgtgcgggggttgggggttgaaaactaaagatggagtaccttttcaaaggcactagaggtcctcagttgactatgagtatgctgtacatccaggcttcattttcatgtgtttatttggtaacacatgcttcagaattactctgggtaagaactttgaaattgtacaaagagactacttgattctagggaacctagaataaagtatcgaaatgtgatttttgtgaaagttttgaggagatgttaacttggattttaggtatcagatgaattgaaggcatgagtattttagcaatgaaacaaataaaaggaaactttgattgattggggtgtgttattttttttaaagtctgtgcagttagtttgaattttgccttccaggaggtattgcttaataactaagggcatctgtaattttcgtatatttctggttttgaaaatgatcagtagaatataatttagactattaagaatgtaatgctatgcataaattgaatttaaatggagtggaatggcttttaattaaaatagaagtttgtattctctgaatttgccttttgccttttagaatatcatttacagtatttgggggctttcaaattttgtttgtcagtgtcatggtttactttaagccatgctgatcagtatatagaggatgtgcatgtggcttagtgacaaaacctaaacttctgccaaggtttccctgttttcttagttctgtgatcttgagcagttcacctttttgcatctttcctaaattgtagaatagggatgcagtatcaaatatataattaagaggaccaaatgaaatatttgtgtacacgagtatattaggaaattgctctttaagaataaaaaa

SEQ ID NO: 122633 - DNA, 1107 bp, Homo sapiens
agaagatgccggggagtgacttcattctttcactcctgagcacattgagtgcctactatgaggcagatactgttcccatgtattggggacatggaacagatattccttgtcctaggtgtttacaatcagtcttggctattctgtggaagaagaaattgtagaggagtggggcaagaacagcagtagggaagacagctaataggccattgcagttattaggtgagagatgatggcttgagttagaatggttagattggatttggagagaagaaaatggatttggtatatacatgagaaatcttaaggatttactgatggtttggagttgtcaattaagggaaagaggagtcaaaaatgacatcttgattttggcttctgtgattataatcgatagtgatgccatttcctgagatggggaaggttagtgggcagagggcggtggggagagagtgtaaggaaaataaatggaatcaagagttctttttggccatgtgaaatttgagatccttttgagaaattcaggtgagatgttgaatatgaagttgggtataaatgctggagctcagtagggaggttgctgggtgagagataggaatttgagaattacttggttataaatggtgtttaaaggtcatggatcacaccgagagaatagagaagacagtagaggactaagccctgggacactaacattttctcttcaggcagaggaagatgtgccgtccaaagacactgagaaggagcagccagggtggtaggagtaaaagcaggacaatgaagtgttctggtagagaggagtctgaaggcagtagtgatcaccagtctcatgcttccaggcagccatgtaagatgagtcagaagaaaatgcatcaatgcatttggccagtttcagtgagatacttaaaaatataaacctagcagaaattagagattatctaatccagtggagctgactttattgcataaggattgatacataagtgcttaataaatgtttgaattgctctttaccacttattaagctagggtgaccagttgtctgggtttgcctgacgtttcagttttaaaactaggggttgtgtgtcataggttgcctaggactgaagg

SEQ ID NO: 122634 - DNA, 1025 bp, Homo sapiens
gcggggacccgggcgggaaggtcgctgcgacagtgctgcggcggcggcccgggcgcgtctcggaggggccgcagttccgcgccctcccgacttctggtaggcgcaggctggggttggctgtgcccacgcccgcagccgctacttttagggcgcgttttcgggagggaggatgctgccagagatgcggccgctctcagccacccccaagggaacttcagcccctcggaggaacctggtcgccgccccgcagcccctgcggcgtaagaggagggcgcgtcctgcagtagccaatggaccattgagcaaccgggttacgaatccgtttggctttccgtggccccttcaaggaaaattaggggtttgctgcattccgtatctgaaggggtctgtttgtatcggacagccatttcatgcttgcgtcgctcagaagttgtgtaggagccacaaaattaggataaatcctcccctaacttgggataaaaaataagtcttgggttgcctgtgatatgttctctaaagatgatggtctttccaggcacttttaatcttgagttttgaggccttttgagaaactgagttatatggacattctgcgcagaaaaaacaatgccatatatacatacgcaaaattttccctacaattttagctgtttctgggactcctgttaagtaaccttgctccacaaagtgtttgagctcgacttgtgtaacttagagatatttttgcatacatttccaaagctgttatttacaaaacaaaaaagcagaagcagcatttggaaaggggtcttttgatggtaatattttctgctatttaaaaaaaatcaggcactgaccgagtcactagtatcaggctattgaaatttcgaataatgcaattctttgatagtttagatatttgtgatgtgtggtttttaaaaagacatatgtacattttaaaaagccagagttagatttgaatcattcacttaagtttggtcctgaaacacttaatgtatgttaatgaatgatttgaatcattcact

SEQ ID NO: 122635 - DNA, 1021 bp, Homo sapiens
cccttttctgcccctaaagtaatctataaacgaaggaatacagatgaggatttaaatcccaatcctaattccaagggaggctggaagccccctcagccgcgccctggcttggctttttcatctcgagcggttgtgacgccaggggcaggtcttccacgtgtcttcacagaggtgcccggagggagggcgtgagggattacccaagggaggggcgagtatcgcaaaataggccaagtcgctgccctctactcaactcgcagggcgggaggatggagacagagggatgcggcgggagggcgggacagcccagtcgccgccaaggaggcgaagcggggtcggggtagctcacccgccccccgcagtccccgccccccgcagtccccgccccgcgcggcgccgcgcacgcctgaagtcattgcccgaggccccgccccctcgcggccccagccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggtaaggaacgggacagcgccccggctggggtgggggtcacggccgaccgcggcgcctcgggacctcgccgccgctcccctcccgcctcaggcctgtcttaccccggccgcctccccgacgccgccgcgtgcccagtgtcctccccg

SEQ ID NO: 122636 - DNA, 2031 bp, Homo sapiens
atgagctaataggtaattaattggtagaaatttggttggtagaatttgtgcctgataaggctttgaatccggcatgcaaagaatccacctctaagtaccccctggtatgattacacagtaatatttttcaggtaacagctttgttgagatagaattcacataacatgtaattcactcatttgaagcatctgagtcaatagtttttagaatattcagaggtgtgcaaccatcatcacaatcaattttagagtattttcatgatctcaaaaagaagctttgtagcctttagcacatccccctccccagcatatcccccaagcagtaggcaagcactgaattactttttgtctctatagttttgcctattctagacatttcatataaacggaatcttataatatgtagtcttttatgaccagcatctttgaagcataatgtttttgatgcttctttcatgttgtgttatatattgatgctttattcctttttattacccaataattttccattgtataggtataccacgttttatttatctgtcagttgatggacatctaggtggtttctactttttggctattacacaaaatgctgctattaacatatgtgtacaaatttttgcatgggatgggacaaatgttttcatttttctaggtttatgcttaggagtggaattgctgggtaagatattgtaactcctttttaggagctaccagactggttttctgtttgtttgtctgtttgttttgagacgagtctcactctgtcacccaggctggagtgcagtggcgtgatctcggctcactgcaagctctgcctcccaggttcacaccattctcctgccttagcctcccgagtagctgggactacaggcgcccgccaccacacccggctaatttttttgtatttttagtagagacggggttttacggtgttagccaggatggtctcgatctactgaccttgtgatccgcccacctctgcctcccaaagtgctgggattacaggcatgagccaccatgcccggccaccagactgttttttaaagcaggtgtaccattttacattcccaccagcattctaatttctccacattcccaccaacacttgctgttctgtctttttgattatagccatggtggtgtgtgacatagtatctcattgtggttttggtctatatttccctgatggctaaagatgttaagcatctttcatatgcttattggccctatgtatatcttctgtggagaactgtccattcagatccttaaccactcccttcaccccttttttaaaaaatacagacggagtctcactctgttgccctggctggacttgaactcctgggctcaagtgatcttcccacctcaacatcctgagtagatggaactacaggagcatgccaccatgccagctctttgcctattttgaaaattgggtcatctgtctttttatcattgagttgtaagagttccttatgtgttctacatacaggtcttttgtcaaacacatgatttgcaagaagtttctctagttgtttggattatcttttaattttcttggtggtgtcctttgcagtgtaaaagcttttaatttagatgatgcccatttaatctattttcgttatgttggattgtgcttttgatgtcatttctcaaaaaccattgcctaatccagcgtcatgaggatttacacctgagttttcttctaagagttttattcttttagcaccttacatttgggtctttgatcaagtttgaattaatttttgtatatggtgtgaaggggtccaaattcatacttttgcatgtgcttgtccagtttcccagcagcatctgttgaaaagactattttcctaatgaattggcttggaacctttctcagaatgaattgaccttaaatgtatgggtctatttctggacaatcaattctgttctgttgatctgtgtccttatactactgctacattgtcttgatgaccttaggtttgtgtagtatgttttgaaagcaggaagtgtgagtcctccaacc

SEQ ID NO: 122637 - DNA, 1059 bp, Homo sapiens
taaactagtgcttagggcagaaatacatgaaactagttagttgttgttttagactgaattatgtctcccccaaattcgtatgttgaagcactaatccctagtacctcagaatgtgactgtatttggagattaagttaaatgaggtgattggggtgggccctaatctaatctagctggcgtcctcacaaggggaaatttagatttacagagaagcacaagggtcacacgcacacagaggaaacacagcaaaaaggtggccatttgcaagccaagcaaagaggctttagaataaaccaaacctgccaacaccttgatcttggatttctagcttccagaactgtgagaaagtaaatttctattgtttaagccacccagtgagtgatattttgttatggcagctctaacaacctaatatagctataagatatttttcccctcagaattaagcttatttgagcatctaatcttactgaatccaaatattggtcagttcccaagcacttcctgtgggtgaaatgatgtggtcctttagccatgccagtaagggtgtggcgtatgtggagtggtgtgctgttgccattcttcagaggaagtatataccactgggcatatagcttgaattctgaagacacaagatgcagcttacttgcatggattcaagactcctctacagagaagtgaaacttgaagtcaaattgaggtcatacacaaaacaagatgaaagagcgaattcaaatatactaaaattgaattaaatcaaaatgtgccaaattaaaatatattagaactaggaattaaattgagtgtcagcccgtgtctactgcaaaagttatcataggaatggaagtactaacctctagcttttgttcaaatctagatttccacctcgggtaatcactgtgttgaattgtcttctcatttgtattattaccaacttaaaaaaattcctcatgtaaggcttgttttaatatggtctttagttagtttaagaggctcctttttatttattagaaataggatgtcaaaatttaatgatagttttaaataaaattttctgta

SEQ ID NO: 122638 - DNA, 1024 bp, Homo sapiens
cgggcctcccagcccttattccactcactttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaaggtgagtgcggcgcccgtgcgcccgggctgtcagttgcgggctgcagacgttgaaagtttcccgggccgggcctcgcgctgggcggctgtgttcggcgcctggcggccgcgggctgctctgcggagggaaacttgaagttgatggacgacggccgccgaggcgcgcgcggctttccgccgcagcccaggcgcctgccgggctcaacttgcgaggaacttgtttgagcggaggagcggaggtagccatgttgtcagctttgtctgcgggcgggcagctcggagacccgcactcgctcccgctgcgccgcctgaggtcgcgccgggctggctccgcgccgccaacagcctccgcgaccctccgggcccgagcagggaggctgggaagggagaggctgtgcgtgtggtcgcgccggcgagttcggagcggagccatcttaccccgagtcgagaattgggccagcgaccccggcgcacggcgcctcctcttgccccgccgcccgc

SEQ ID NO: 122639 - DNA, 1014 bp, Homo sapiens
tttaatatctttagtaataaatatttagaaagctaaaacgacaattatctttgctttaattatcttttactaaagtaattcagtgcttcatttgccagttttgaaggggaaatagtttaacttcatcgatgagggacatactttgaactagaagtatatgtaaaaaatgcattgaagatgatttaggtaatcgtggcatgtaaaacttttcattttaaaaactagtttttaatctctaaaatgtatatatcatatgtaaggttaattttaattataaaacaatatatattcattgtaataaacttttagaaagttgtacaggcatatataaagttaacagttctctgtactcagtgccttgccctatctcctttcggtaatcacaattattactttaacatgtgcccccgtttttttttttttttttaaacctatatagagcataaatgcacatacatatatagggcaaattttgaaagatgattcatttattaaaataatttcaaataggccattgataacactaaggggtatttttcttattactctgaagtcatttgattactctcctatgatactactattaatataagcattgcagctaccaggcccatttttcacacccaacagtaattttttttttattgccaactgcatataaaaatagacaaaagaaaaaccattgatcggtccattccaacttataccacactgtttttcagatataccaccagaagttcttcaaattacaggtatttctcaagtgttgccttccattttaggagtcagctctgaacaaagaagatagatgactcaggatgtcgttacagggcttttacattgcatagatgaaaccagccattcataaagccaaaacgttccatttttaactgggatccattcagaacccagctgaatcacatcagggatttacagtactggtgtcaaaaacatacttatttccaatggtatatttcacttcctaggcaccattactgagcatttatttagtat

SEQ ID NO: 122640 - DNA, 1024 bp, Homo sapiens
aacctaactgggaagataaattctttctagctctgaaattagcagtggaataagggaatttatttgcaggggaagtgagagcagaggagatggagagagaatctagccttaacaagaacaggctgcaactcagggaacacttgtacattgatttttatgtttatgggatgcttgctacagttgctgagttttacatgctcaatacccttttatacattggcatcagtttttttgttgtttttttttttaacccagctttcatttaattcctctgccccctgtatttgagggaggaagggtaaggtcagatgttttacataagttctcaggtgaagaaatttgttcatttattttaaagttaacttttatttaatcacagtaatcatgattaaatgatttacccagcctgaaagtatttacatttgtggtgaaagagtgagtgaatgagggaagtcatcaagagaatttttagctaattacactacttgggaagacctgtggtctagtggaaagtatgtaggctttggaattagaacaagctgaagttggaaagtatgaagcaccatgctcaattctggtatattataagtattcaattgacagtagctgtaattaagatatatatatatataaatttaagaatggcaggatggtcaatcaaaacttgtacagtcttggtgaccatcaagcacatccagccagggtctcaggctgtcttaacccttgatataagccctatattagaaagaaccaaattatcttaagaccagatattcctcaaggctttttctgaagcaaagctacagggcagctcttaaaggaaagtgaacgtttggggctactgatgaaagtatgaaaaacggtggccaaactctgctttgagacttgaggcaaaataacttattaagaaaattcttttcaaaatattctatagtttgggctgggtgcagtgggctcactataatcacaacactatgggaggcaggggtgggaggactgcttgagcccaggggttcgagaccag

SEQ ID NO: 122641 - DNA, 1423 bp, Homo sapiens
agcatgtaaaactcagcaactgtagcaagcatcccataaacataaaaatcaatgtacaagtgttccctgagttgcagcctgttcttgttaaggctagattctctctccatctcctctgctctcacttcccctgcaaataaattcccttattccactgctaatttcagagctagaaagaatttatcttcccagttaggttttcagaagaagcccggggtttgtagttacagaggcatagcttggattctgattctttgatgtacaaattatgaatttgtgtagattacttaacctctcagagtctcaagttatttgcataatggggataatttgatctacatgatgaagctgttgaggtttaaacaataggtatgaagtagaactaatgcccagtatatagtaggtattttctaaaataggtttataaattatggctatgttcctatgccagtccacaaatgcgaatttataccacttaggatcaagggcattatatgtagtgatacaattatatatgaaattaaaattcatgaaaacctttatgtaataattttttttttttttttttggagacaatctcgttccattgcccaggctggagtgcagtggcgcgatctcggctcactgcaacctccgcctccagggttcaggcgattcttgtgcctcagcctcccgagtagctgggaccacaggcatgtgccacccctaatttttgtacttttagtagagatggggtttcaccatgtttgccaggctggtctcgaactcctgacctcaagccatccagccaccttagcctcccacaatgctgggattacaggcgtgagccactgcgcccagccactctatgtgataattcttagtcttatcctcacttggctagtttagtacctttcacatcactttcttaaaacagtttcttcacttggcttttgggtcacctacctcatttgccacttgttttgtaacttaatttgtcctcttatctttggagggctcaaatctcactccctagagcaagcccatgtatttttatggctttacatatcattgacaggttccaaatttttatcctgcctattcagtatctctgcttagaagcagacatctcaaatatgtctaaaatgaactcctgattgctcccctaccccacatcacctccctgcaaaagtggctcctgctgctttcatcttcaggattttatccagaatataactgttgcacagccccatggccacacgaggtccatgccaccataatttcttgcctcaattattgaaatattgtttcttcccttgtcctcttacactctatattgaacacagcaatcaaagcattccttttaaaatgaaagttggctcctgttactgctctgctcaaaacccttcgatggcttcccatgccacgcagtgtgaaagccaga

SEQ ID NO: 122642 - DNA, 1167 bp, Homo sapiens
gaatgtatgacacaggggggtgccgtaagggaaaaaccctaccattgttcgttgacagttgatgagctgaagccacttacttctgagccatgagggaggttttactaataatttttctactttggagctctgtgattatttggatctctgcagcgtagtatagggctgcccttccaaagtgtgttgagaagggccttaaaagatgatatacaaaaaaagggggattccatagccaaataaatttgggaagtgctggattaatgttactggtgttctttactgaaggatatctcagaaaacttactgtgccagcatgctttatgaatcctcaagacaaggtttacagcatttcccaagtgtttggctatgttatcttgtttgtgaggcactgtccaggaactagtgtttcacaaaagagtattttgagaaactctgatcaaagtgtgaactctggtaggaactttataaggagcatttcactgcctttctggattgctatgagaagccaattttaaagccagtaagtggctaagtggacattaaaagggtctttgatgtcatctggtaatgtaattactgaatatgaaataatgctttggttttttaaccctagacttggaatggaaaattatctatgtgggctctgcagaaagtgaagaatacgatcaagttttagactctgttttagtgggtcctgttcccgcaggaaggcatatgtttgtatttcaggtaagattaatcttggtaaatgtgtatgccaaatatgtttcgaagtagactatattatctattatcttataacccttatccctttccttttgggttaaagaactgcttctgctgcattcactttaaatctgtttccatcatgttttaggcagtctctgtgtcacagaggaactcttacttcctggttttatatgctgagagatgttaatgtgacgtttactttagagagatgaacaacctacagtaaattttatactgtatcatggcacacagggtggtgaatttggggctcttcctgtgaatagcacctcagtatcagacttccaaggtggctgtctagcaacccaaaacatggattcaaaatatctaaaactaactggcattgttagtaatatgcatcttcagtttatggtttcagccactggaactgatggtgat

SEQ ID NO: 122643 - DNA, 1052 bp, Homo sapiens
aaatacctagtggggtagtaaatttgcaaaagtagtcctcttataagataatgtagattataagatgctttagtaaactctggaatgtcattccaatgacccaagaccacacatctctatccactaaacgtatctgttaacctagctcaactactgattatgctgaaataaagttgtttttgttacatcaccatcagttccagtggctgaaaccataaactgaagatgcatattactaacaatgccagttagttttagatattttgaatccatgttttgggttgctagacagccaccttggaagtctgatactgaggtgctattcacaggaagagccccaaattcaccaccctgtgtgccatgatacagtataaaatttactgtaggttgttcatctctctaaagtaaacgtcacattaacatctctcagcatataaaaccaggaagtaagagttcctctgtgacacagagactgcctaaaacatgatggaaacagatttaaagtgaatgcagcagaagcagttctttaacccaaaaggaaagggataagggttataagataatagataatatagtctacttcgaaacatatttggcatacacatttaccaagattaatcttacctgaaatacaaacatatgccttcctgcgggaacaggacccactaaaacagagtctaaaacttgatcgtattcttcactttctgcagagcccacatagataattttccattccaagtctagggttaaaaaaccaaagcattatttcatattcagtaattacattaccagatgacatcaaagacccttttaatgtccacttagccacttactggctttaaaattggcttctcatagcaatccagaaaggcagtgaaatgctccttataaagttcctaccagagttcacactttgatcagagtttctcaaaatactcttttgtgaaacactagttcctggacagtgcctcacaaacaagataacatagccaaacacttgggaaatgctgtaaaccttgtcttgaggattcataaagcatgctggcacagta

SEQ ID NO: 122644 - DNA, 1055 bp, Homo sapiens
ggggtgaagtatttcttttttaaatttgtttttgtagagatggggtttcgccatgtggcccaggataatctcaaattcctgggctcaagtgatccacccaccttagcctcccaaagtgctaggattacaggcgtgagccaccgtgctcagagcgtgaaaagattatcaccacgttttaaagaacctgtgtgattcatatctctagaacaatggtggagttaaaggaggtatgaatggagatattggctggagacaaactgagaagggccttgtcaatgaagttaaagaactgagattttatcccttagaaaagggaatactcttctgagggttttaataatctgaggttttaaaaccaaagagaaagaacatatctgtgttaatgctggtagcagtgcaaatgataggctagagctggggagatcagttagaaaattctaagcaatattccagataggagatgacatgaattcagcctccagaaatgaaaaaaatgttgagactgactagatgtaggagataagggagtgaagctgactgaggtttttagcctaggacactaggtagcgattttatgcctttttgtatcatctacctgtgttaggcatacagtaaacaacagtcttcaattttcacaagctaaggcattggctaaagtgctcatctaggcccaggaatattccttggtgccctggcaacaggtaagctaatttgctgggacttgatccatttaccacccagaatggctgcctcagatgcctcagccatcactgcctgtgttccccagtctggctccttccatccggtcgtctcattactacctgcaccctaccacggatggggccctgcccttcgctcatgctcttagtctagtctaactcagtttactttctgcattcctcaaggttcaccttacaatagcttgatttaaaacaaggtctttgacatctgcctaaagcaatccttaccttcactggtttccacattatgtgtggtttaaagagcatactatattgtagagtctagcaaagtaactattcataatagaggattat

SEQ ID NO: 122645 - DNA, 1050 bp, Homo sapiens
agcatcttctgaagcattcattttcaaaaatgaggagattctttcttttagaaaacagaagtataggagttaaatagttaaaaagccagatgaatcccctcagattctccgtatcttgtttctgttaatctaaaataacttctttgctacagccctagtcgttacatcttattagttatatttaaggtacttaacttgaattatacctttgtatatgaacttagccctttaggagtactaacatgaaccattttattaagcttctatttgtatatggtgatttaactttcttagtgtttaccatttgtatgtttcctttttcctctagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaac

SEQ ID NO: 122646 - DNA, 1431 bp, Homo sapiens
ctacataattacttaggaaacattccacataattacttgggaagcatctttatttgttgttggtatcattttatacagaactctagaacactgggtcatacggatttaaaacgcatgggaaatattctttatatattcttgcctagtatcctgaagtttgtctacccttctcaattccaaaaatccattcttgtcaatggttaatatactgttgagttatatttcaaaacctgagacctccttaacagttttccacttatacaggaccattaattggccattttctgttgtatgataaattttaaagtgttagtttctcattagaaatttgagcattcattagcccaatggaagttaatctgactcccttaacaagtagcaaacatttttaaaatgtgtgaagccaagggtctgttttcagaagaacagaaacattacccaatcaaaactgtaaaaatacaaaatagcatcaaacatattttttaaaataatttttttctaaattccctgggtcactttatttataatcaaatcttgacattctacctgcaaaggcttttaagtgtacttgctaaagaatcattacaacttatgaatgaagctccacattgcaatgatggaagtatattttccaaatattaataaacattccctacctaagaaatttcagtaggagctactgttgcctatcagatttatgagcatgaaaatgccttaagctctataccatctatctacttggtaaagtgaaatatccccctctttagtttaacattccagttgctgagtcttgataaaatgccagatgatacggactttttcctgcataaaagtatgaaggtaatcactagagaatgagaaaattgaataggattgttcaaaactaagatgcaaagtgaaggtggagcttgcaagatattttcttagagctaccaaaataacattgcatatttccttccatttttagtggtaactcaaaaattagcttgaaatttatcctattataggtagtttttcattagaaaaaaccattgtgttaacttctgaagtaatgttaaattacttgaaattgtcacatacaatacctgcactagtagatccaattcctgtggtcagcacagatcttggtgtaatctttgctgcatatttgaggaactgagatttccctgtgccaggatccccaaccaataaaagatgagattctcctaggaaaaagcaaatacatgaagttttaaatttctataaaagggtccatttggaatgccaacaaaatattacatagtgtttttactgtgtacttttacatagggtcgtttgagaaaggatttaactagaaaatcttcagaaagttaactgtcataaacagtccttaattgattactcaatgtgacatagaatctaaattctattaataaattatgtgctatttcc

SEQ ID NO: 122647 - DNA, 2071 bp, Homo sapiens
gggtggtaatcccagcactttgggaggctgatatgaaaggattgcttgagcccaggagtgagaccagcctgggcaacatagtgagaccacgttgctccaaaaaagaaaaaaaacattagctgggcgtggtgctgcacacctgctgtcccaactactcaggaggctgaggcagaaggattgcttgagcccaggagtttgaggctgcaatgagctatgatcacgccactgcactccagcctaggtgacagagtgagaccctgtctcaaaaaaacaggacattttgaaccaaaacaaagttatttcctcctttaatcctgttggtcatttggaattggacctcctgatcacttcacatagtagagtatatttaaatgaggatggtcagataggaaaggaagggaaatttcagttggggtttcttgaaaattattgctgatttctgatctttctgcttttcctaggaaggaatgtaatattggctagcttgtgccctcaagtgtttggaatgtatctagtaaagcttgctgtggccatggtgctggctggtgggattcaaaggactgatgctacaggaacacgggtcagaggttagtacctatttagaaattttgagtaatattgacacatggatggaagctagaactttttctttcccaaataaaaactgctcgttgggttttattttccaattgtaatcttataaaactgacagttgtctgaatatcttatacttagtctagcatctgtatatcagaagctactttctagagttccagaaagactgaaagaagttacatttttctatggcatatacttttgctatagcctataaggatgccacaaaataaaatctttgtttctattactgtgttttttgttggatccccggtctgttttcaaaaggaaaaagattagaaatagtgtattttaatgtctccagtcagcgtctctccatctgtggctgtcactgtgtttctcttagactgctgctttcagtcatctgcctgctgattctccttctgctggtagatagcaaatgtgccatctgccatggggtgctgctgcaggtcacaccttcaagaaaagattactcttaagtgtataattatgtccagatggcagaaagctcttttgcagctaacacacttaaccagagtctggcatacgggttattacggccctgtacgtgggccataataaccaaaaattaaaccaaaagactaaaagggcattgttataaatcaggctgttagtagggactcgaaaaccatatagtacagtatagaatagtaagtataaggcgtccttatatgttttgatcacctactgttttgcaaggcactctgccaaatgttgagcttaaataggggtttcctattaatgtatttaggaaacacttgagaattgctgaagaaacttggtcagtgaaatcatatgtaccataggatatgcacgttatttatgttacatttgcaaaatgagtacttattttaagatacatatttcactaagttactaaaattttcataaatgaaaaggtcttcacttaactgttagaatcataatttgatatttgtaaagtacttgtaaaatccctaatacttctaagtgcttaaataaaaatagaataaaatacttatatgacttgtatgcaaggatttaatcatagtagtttgatatttaaaaatagagtaaatcagaaactttataagccaaaaattttttgtttgtttttgtagacatggagtcttgcccaggctggtctcacatttccgggctcaagtgaccctcctgccttggcctcccaaatgctgggattacaagtgtgagccaccgcacctggccccagatattttttaaaatgttaaacataggcctgaacatctggaaatagcacataatttattaatagaatttagattctatgtcacattgagtaatcaattaaggactgtttatgacagttaactttctgaagattttctagttaaatcctttctcaaacgaccctatgtaaaagtacacagtaaaaacactatgtaatattttgttggcattccaaatggaccct

SEQ ID NO: 122648 - DNA, 1030 bp, Homo sapiens
taccaggaatggtgggagggtttcctcaggtaggagagaaccatcagcaaggaacaagcaggattgtatcttgtgcttttatattttgtgggaaggaactttgaagcataacaggcatttattcatttcttagttcattgtttctttggttcactaaaaaagatgtgggggggcagtgagtaaaatattagcaaatgagttaagtaaaaatgaacatgtaagaaacccaaactacctgccagtcatcacaaggttatctcttttcctgactccaaattatagtttaaccttctggctgcagttcccacatctcttctctaaatgagagctaaatggttagagactcagaggatgaacatttcatccaatgtaactgtgatgaatgaatcatccagtaaactattttcccagtgaaaagtaataattttgtaggattatcatgtagcaggttatgaaaaataggaaatactgacttcagcttttcactttacagatacatgactgtgggggacaacagtcaagaatctggggtgctattctgcccctgaattgttttctggatgagtgtacatattgtaaactctagtaagggagtggtttatttctaatttctggtcctttgtcattttgagtctgtgctcagcatgcaggatgctactgctggactcacttgatgctttttcctaggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggtttgtgtttaagggctaaaactgattattattaatggtattacattcagtggttaaatatgatgtctgtgatttgacagtcttatatgccgcataactcaatgactgagtttaaagggtaggattagtcattacctctagc

SEQ ID NO: 122649 - DNA, 1041 bp, Homo sapiens
cttaacatgtatttaagcatactcagaatctgttttcttttctttgctaggttcaaaggctatctgttggaagtattccacgatctatgaaggttattctggaagatgacttagtggatagttgcaaatctggtaagaagaggggaatttttttttagcttgtgtaggtagtcctaaagtattgattaggaaaagccactttttattttcccaagatcactggcaagggaaatgtagagctgtaattgctcaccttgagattagaaactggcaggtgggaagtgatagcaggaagagagctgggctagatctatacaacagcagctagtccaggtgcttgttttatgaatgaagaacctgacttgtctaaggtcacttagagagttaagtggcataactggaacatgaatccagaaccactgatgtctaatttaaggctcttttcagtgcactatagcttaacagcaggaactttaaaaaatgtagtgaatttaatgggtatttttataaaatgaattagagaatgtgactctgttaaatgctgctgcgtgtcttattggtgcctagaagaaaggacatcattcctctctgctctgtgctggtgacaccgtgattggagtcactgattgtagtctgctgtcttctgagggtcctcaatgttttcattggccgatacctgaattgggagggtacttgaaacccatactcaatgaagaactatacatggttagcatggagaaccctgaggaaggacatgacagccaactttcaatagttagaagactgtcacatagaaatagaattgtaattacagaagttgctgttgggtttcagtggggtaagccacaaggaggtagattttgactcaatacctaataattagaggtgtctaacatgggccttagatggtgatgagttctttttctcatagacaatcaagcacagcatatacagtacattgttagggatttaggccctacagtggcagttgatctggataataatctgcaatgttccaggcaatttaaagactttctgagc

SEQ ID NO: 122650 - DNA, 1025 bp, Homo sapiens
tgactgaaaaagtaactttctagcgctgtggaactctgtggtcgtcatgctaccatctctttatcggtctgctgcgtgatttactaaaataatcatcagttgattttatctgtggcaagtggcaatatattttttgttaaatgccgttaaaattatatactttagatcctactgagatagccctcttgtgagaataagtcctttttaaaatcctggttattataacttctagctatttgctttaaaacatggtctactcattgtgcagtatctggattaaaaaaaaactctactgataactgttatttgcaataattctttatattttcttaatagagttgatgatctgattttttcttagtaaaacacaatcttttttttccccctgaaattaaaatttatctttcaggaaataggagaagaatatatcccttggagtcaaatctcaagattgaagttgatgctgtttttttgttttctccatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggtaaataatcacataaacgagataaataaatttgaagaagtgtttttcagctatgggcacattgggaggattagggaacacagaatggatacaaatgtacttgtgttgtcactttgtggaagatcaagctcgaaactgttccacatatatctgaatatagtctttagaaaccatgcaatcatcctttttaggtggaacattgacaagaaagtagtgaaatg

SEQ ID NO: 122651 - DNA, 1016 bp, Homo sapiens
tctcctttgactcctattcatattgcatttttgaccactggtagtgcactgtttcgttttatttgccccttggatttctgaggacatagagaaccttttactatacttttcatttgccagcatagtgccttgtacatgatagatattaggaaatggacattgaattgggtttatacatatgtaatttgttatccgtctgtatacatgaaactagaatggggataggtgctttttatctgtagatacatactttttaatagagtgccaggggaatgagataaagtaatggtatatgctgtatttattttcaataatacttttttattatttgaagactcagtgttttttcaccttcctatgtttatctgttttctttgcattgttgacagctgtttctgcagaacccagtagatttcctacggtaagaaagagaaagaaggaaacaaattcacttccaagtatgaatttctaaggacagtctgttaattattcatgtcagaactggctgtcagtctgattaatggtatgtgtttcagttacatagcagaatacacatgagtgtgtgtgtataactaaagagagagagagcacacgaaagaatgacactgtgttcatataaacaaaagctagaaccaggactcttgcaaagaactccactgttactgacttaagccaaaagatatgtttcagattttatacttgagagcaaatgtgtgtgtatggaatgtggcctcttacatatattatgtaaaataaataccattatatgtcatttaatgatggggatacagtctgagaaatttgtcattaggtgattttgtccttgtgtgaacatcatagagtatatttacacaaacctagatgatacagcctactacacacctaggctatatggcatagcctgttgctcttaggctataaacctgtacatcatatcattgtactgaatactgttcgcagttgttgtaacacaatggtatctatgtatctaagcatagaaaagatacaataaggat

SEQ ID NO: 122652 - DNA, 2006 bp, Homo sapiens
aaattaacaatccatccttattgtagaactttaaaataattttttgtttactaagtggtttttgttttttatatatgtttatttttttccctttcttgtttaccaagattatttataaatatatatatatatatgcttattgtcaaaatagaaacatacgtaaactctgggaacttaaatatacttatgcaaaaactaaatttagaaaaaataaataattttaaaaatttccattccaattttttaccttgcagttgttgattaaatgtattagcaaattttgaatgaaatgcaaatttcattagaaatttagccattagataaagtcagaaagtactgttgttttatgctcatcttactattactgattttttgctgctttatgttttttttcttattcttactaaatcttagcagtgtcactagtaatagtcttacaaagtaggcaggtttttttaggctaagtgattagtgacatagttaatgattaacaaaaaaaatagcaagaatgaaaattagtcagatacacctctgaatttgtctcctgctaaatattttgtgttgcttattttcccttgtgcatgggtatgttcaggtatcagtaagatgcatgtgcatgagctcaaggaacatgactactggagtttccattacacattgttgcgtgccttgtaattttccccaaagacggtagggattcttttgttttcttaagtagcccaaagaatctttagttagaattaagaaaagtataaactatataacatcaataacgggggaaattatatttttagtgttctccctttcctggagtatttgcatagggaattatgaaatgaaaatttaatgtaaaatgcatatagtaaaaaatactagtagttactttagttatatttaaggacacatctgtacgatcagctaaaagagaaaaggtgctgaaagagaggaccattattttattctctcgtttcccacaattcttactgaattttttattcaaagaaggtgacatttttgcagttgttttttgttctttgtgattgttgtgatgtggctcctccttaactgacttcatttgagctgctgatgcactcttatgctctcatggagtggagaaccgattctagtatagagggggtagcaaatctttaaaacacgacttacaacatggggaacccgttgtggtaatctatgctgatgttttatgtgcttttgccttcattttgcaaaatgacttaatgctgggttacatgtctctctttttatgaattcagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaacaatgctttttatttttttctacgtttgctttaatttttaaatattttttaattccaggtaagacttgtcaacaagttttactgcattataatcatgtcatatcaaattatttgacttcagtaatcataatagaatcaggatagggaaatagaaactcttgttccagtacaatgtgtaattttaactaaattgttctctaaatttacaaagctagaatgaaagtgcttgtgtaaattgtggactttcaagtgtataaaatactgttgacttttaggtggttttttttttttcagttttgatagttgagatctagaactttagtacagttagtatctataattaatactatgttttatggccaaaagtcactgggtaa

SEQ ID NO: 122653 - DNA, 1669 bp, Homo sapiens
gttatctccaaatctttagcttaggctgagtttttggagggattttatggtactcaaatacactgagattcaggtacctctctagggttttgggtgggaataggaatgtataactgatttctggaagatagatcatctacaagttactcagtattcatgagtgaataattttttctaagaatctttattaaccataattttattgaataatgttattgaaattttaagttctatcctttatatcctgaaaacaagatttttaaaattgttctaagtatttgcattttctaaaattgaaagtgctttttctgaaactaagccagcagtttccatttgtattctcttcagtctgccccatcctatattcttagactcagcaggatgtgtcacctgcttataaaaagtggcctatattttaacgttcaaggcattcaggcctattaccacctcatatcattcaggacagaataggcttagaagggaacataattcttctcttacctgatgaaactttttttcagtttgtatgtattggctgataatatagaatttttaaactttcttttctataaaccaggaaaaaatgacgtcatacatgtgtgtcctttgttttgctttcatctgtatttgtttcttgtcctttttatatgttaccaagccttgtgttatcacacagtattgtattgtgataagcacttgtaatagtgagcctgcctttctagtatcaaacctgttatttgtcaggttagtatcattcaacatataatttcttctgcagagcttatctccagatactgctcaccttttctccaaatactctggaatgacttaaaatgagtgacttcttcagaagtaacctgcaaagcctttcatagtaccatctacccctttaactcctttaatgcaactactgctcttgaagcagtcatgtcattatgcttaaaagttttaaggaaaaaagaagttttgtttcagatttttgtgtgtgttcaactagactaatttttttaatgtaggtattacagaagaatgtatctgagtgatatcaatgagctaaagtctttcttgttttcagattagaagaaatggaagaaaaatatctaatgagagaatcaaaaccagaagatatacagatgattacagaattaaaagccatgcttacagaaagagaccagatcataaagaaactaattgtaagatattttggttttagtctaaccatgttagtaatcaatagatattgattgggaaaatatgggacaatctttttaagtaatgctaagtgaaaatagaaaacacagaacatgtgcattgtgattgaaagttcattgaaatgtttatgaataaagtaatttttaaaatttaaatttggcattagggtaagggaattgtacgtctttcattttttttaaaagaaagtctttttgatacatattgaatgtttaataatatgtcactgccagtatacaattaatataccattgaagtgtgtgtatgtatgtgtgttgcacatgtagtattaggattggctagcaaagaaaagccagcacattcatgcattagcctgtattgtacactaacaggttgagcatattgatttcctaaaatgtgtcctagcaaacactaatccaaaatttttactctatagaaaaaaaatgttccataatct

SEQ ID NO: 122654 - DNA, 1092 bp, Homo sapiens
accgagccgagatcgtgccactgcactctagcctgggtaacagagtgagtgagactccgtctcaaaaaaaaaaaaaaaaaaaaatcatgtccagagtaaaaaccatgttaaagcaatttttccatttaaattagcaatataaatttaaaatatcattttgtatttttggaaggtaaaaatatgaggtgactgaaaatgaaattacattttcattttcccccatattaggagggaggggtatgtaggtttttccaatggtgtatcaacataaaatttcaatgaacttctgaaaaatgagcctatgttgtaaataattttgccaaatatatcctaggaaataggattaaaaagatataagggtgtctcttcttcctttccccctaatataaaaccagattattattaaatccttaatttctagtgattatgtcatatttatttctggcttccaaattatatggtcagtcaagttagtgttggcggttttcaccgcaactcatttctcttaagagaaattctccgtgaacctacagcaaagtgggcataatgctttgaatagttatcttgtagctttctgggaggaatttagaacagtaatatcccctcttggtccctcagtaaccatcatcttttaaactgaactctgatttatatggcctagcctttagtagtttgtataggtaagtctgcaagcccacaaatatatcagacattgttttaagggattatagataatttagactgtgtgtctttaatttctttttgtttagtttgtttcttagaactgttttcaacttgttttctcttgagcacattataattaatgttctgtgttttactctcccttcttattcctctttctttcacttagttgatttctgaatgtttccctttattcctgtaatcttttcttcatagcggcagtctctgggtgaagctttgcataaatctatcagcaatgtaagtgagcggcacttacaatttgtacacaagggcatgttgcacttttcattttgcataaacaacatcactgctttaaagcttcaacttatataaaaaatactgtttggcattcaataagatatattttgt

SEQ ID NO: 122655 - DNA, 1036 bp, Homo sapiens
ggatggtttttaagatatttttatctaaaattttgttttactcttttatataatctttatcttgcttcagcttcttataggtattttattatatggtggaactaggaattctctttgttaaacaaaggtatatctattcctttacatggttgtcatgaaaaaagaagatcttaaatgtgaaagtcttttcaaaacacagcagaagaaagctgtcatggttatttgagtgctttttccaaattaatcaggaaatcatccattcagtaaaattacaactaaataaaaaactttaggaagaaattgtaagactattttgctattctattacaatgaaatatattaaaagtactctatttacttacagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggaggtaatttcataattctactgcaatctaaacagcggcaaaataaaaatagaatttagccatttgacctagagctatttaaacagcacattgtatataattagtatattagttcttagaactaccataacaaagtactacaaactggggaatttaaaacaacagaaatttattctctcatagctctggaggctagaagtccaacatcaaggtgttggcacagctatgttccttcctaaactctaagggaagatccgtccttgtattttccagcttctggtagcaccaggcattcttggcattcggcaacataatttccatctctgcctatcttcacatcttaaaaggataccaggcatattggaacaagggctcattctactccagtttgacatcatcttaacttaatacatctgtactgactgtatttccaaataaagtcacattctgaggtattgggagggtaggacttcggtatatctttttggggacccagttcaaccgataacaatt

SEQ ID NO: 122656 - DNA, 1154 bp, Homo sapiens
atcacaagaacagcgcaggaaagacccaccccataattcagtcacctcctactgggttcctccctcaacatatgggaattgtgggagttacaattcaagatgagatttgggtggggacacagccaaaccatatcaccagaaaaaacggagtgtgatagcaactataataatatttatttagtgcttactgagtcccagactttgttttatatagcctctttatactgttctctcctttaatcctcacagcaaccctgtgcagtaggtaccagttactaaagcatagaaaagttaaaataacttgcccaagtcagcacataataagtaggtaaagccagaattccatttcaggtagtgtgctttcagaactcaattcttaaccctactctttctctcaattagtatataaagaccaagaagaagggatgccatgctgaggttggagatttcagcaggggctatgttgtggaggtcttgtaagccccatgaaagattttgaaagttatcctaagggcagtgaaaaacagttgaaagatgataagtataaatatgtggatgcttgtgcagtggatggggcttatgctcgtgtccatatttgtaatttataaaaaactcactgtagtgttgcaaggagagtggattagagaagaacaaatagaggtagacggatatttcagggaggaggtttctacttactgtattccctcagtttgtacattaatatggagaatctgagtatttatttctattgcaaatgacagaaatcctacctcaaactagcctaaagaaaaaaaaatttattgactcatgtgactgtaaagtccaaggataatgttagcatcaggcaagactagattcagaactgaaattgtgacaatggaacccagcttttctttttctcttaaattgggtttgttcttgtgttgacttcatgcttcaatcacatattccctgaggtatacgtggagctggcaaaaaaccttttctgggagctccttttaaagtcctgagatcactgtgactagataagcttaaaccatgtgcctgcccctgaaccaatccacatacaaacaaaatgagatgaccttattggtttacgtttcaatgaagcacttcattctggagtttaagttgagcgcttactaagaccacat

SEQ ID NO: 122657 - DNA, 1071 bp, Homo sapiens
agaacaatgttcaggtaagtaaagaatattatattcaacacatggattttttttcttttaaaaatatttgttttgtaggctggagagcagtctggcccacttagaatcagtggcttcacaccacttagacttttttttttttttttttttaacttttcctgcttttcctttgtgagaaaaatcaatgacaggataatttgtattaccctgtagttgttatttcagactttcagatattaggggcccaaaaagacaagcttaaaaccttgtctaattattggctaggcacagtggtacacacctgtaatcccagcactttggggggcccaggcaggaggatcgcttcaggccaggtgttagaaaccagcctgggtgagtgagcttagcgaggtaatacgctgttcctgggggggggggcggacaatattgctaattatttacaaaaggattttaatattgggcttaaagtttaaatacatttttttcttttcctttcactaataatggtttgcctgctagctgatatttagaatttgatcaagaaattgcttgctttctaaacctgaatttaataggggtattgcacaagtctgggggaaaaaaatgccggaagtccacaagttttgttttgttggcttagaaaatttcatagccatgtttttaatatctgtgcaacattagaatggattagaaagtgtggaatagcctttcctgattgggtcatgtttatgaaaacatcaagttataaatcactaatacttacagatttaaaaattggtatatagtttagtatgacttctgaataagagaaagctgacccttataatttaaatgaattatttagcttagtattattcctgcattttaacaatggctatttaatctttcttaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtatgtgtgaccacagtttttgatgtaatgcttagctaaaatc

SEQ ID NO: 122658 - DNA, 1040 bp, Homo sapiens
ctgtttgagctgcatcctacaagttttgatacattttgttttcatttacatccaatggcttcctgcccattctcccaaagagtttttctttttttctctttccccagcctcactaggttatcacatttgccctggggctaaaggtgccgaggtggggcaggggtagaaaaagagggtttgttgcccttaccctagtagcttatggcttttgttccttagatgagaaggatctgggtagtttttgtgctttccctgcagtgggaggcctgtttctctgagcaaagctttctctgtctcctacccagtaaacagtttttcttgtgactacccactgaggtcatagaaaagagactatgagtaggcaaacttgattgtgtctgtggcttccctgggttccattttctcacacttgcccatgttcttaccttgagcaatttttagtaaatttttgctgaattcttacccacttatgtgaccttctcattttccttctgtgctctgccacaggtgagccaatgcctgtgtcctgtctgtccttggaggcttttcttagagtgaaagccagttggttgcattgtgatctcagctttctgataggttcatgaaaattgatgaatttataggttatttcatagtcattaggtagaacattgctccatttatatttctacattctaggtggaaactggaaccccatcagatttatttttaataaattgaacacacccaaatgtcaatgtgaatagatatttaattttcttcagagaattctttaatctgctgcctgactcttggcattcagaatttgggcaggtgtggggagaactcgggacacattgttcaggatgcagatttttgaaaaatagactttactcttttagagcaatttttagtttcacagcaaagttgagcagaaagtacagagttcccatccccttttctccaacacacatggcctccctgactgtcagcatcgtgtagtagagtgatatgttagaatcattagacctacattgacacatcattatcacccaaagtcc

SEQ ID NO: 122659 - DNA, 1021 bp, Homo sapiens
tagtttcctcttgtaccctgtgcttattgcactctaattaagagtcctgcatttggcttcaaaggctgctgccataaacaataaatatctaaatgtcattcacctttaagcccagaccagtttcttatcatctgacagtttataatgggcatattgtctcattacattaagtggactttgatcctctttagattactcttgagaatatttttttaattggcttaaaggaaaattctaaattatttttaactagatgtaaatattacaagactaaatttgcggcacactcttatttgtattaattttctccactttaaagtaggccaaactgtgttcatgtgcccagagaggttattgattagataaagaggttttcttaggtggttttcatgtgaaatcgcttggaaagtacttaaacacattactctctaatattggttgggtaagcaataaagtggtggagggtgtcaatctgtactaaaagagtgataaatgaacaacatatttggtgctagtatccaaaatttttgctagattcaaagggattcaaattatagaattcactaatctgagtttctgagtctagtgagcaagaaagtgataatttcatatttatgtttgataaagaagtttcaaaaaatggaatttgtggtgtaagcataagcactatatagaataatccttaagaattataaatttgcttttcaagtttttctaaagaagggaaaataggtcccttttcaaactgaagacgttacaaaatacattattgtgttgattctaaaggaaaacagagtaaaagagaagaggcaggagtcaggaaaattatgaatttagaagctataggcagccagataagctaatattagtgccttatgcttctgtaattttctatagcctacaaggatttccaaatatacacacacacacacacacacacacacacacacacacacatatatatgtgtatatatgaaatctcattaatttgatttaatctaatctggtacaagcatgaata

SEQ ID NO: 122660 - DNA, 1024 bp, Homo sapiens
agattacagaaaaattgcatgtggtgaaaaataatgtgtcattttcatttatgtattcactgatgttttgaagttaaactggatgaaattgagcaaccatttggcagctgataataatttcttcttggcaacatgcatgaatttttaattatatattgtatccactctcaatcccatttactaaataccagtgacttacccaaattcacacaataagcactggcaaaattaatagtgatattagttcactaaaattccccctgttcctttgcctaatcaagtacactccttgaatcagctgtacttccagctgtgagactgatttatcatcttaagttttcctgtagggcaagaagcgacatttcatatttatctacaagattacttttcaaaatgtgctgttggtgtcatttgtacatatatactgttttgcgaatcactttattttcacagtatggtccaaggtatagggaacagctggcctagagctgctttcgtagttttggaaggctgtcaccagcaaaagtttcaaaggagtggggaaacatatatctggcaaaatcatattttcttaattaccttctcagaataagagaatgtagaaagctgcccaggagaagaaaaaaggagggcttaaagatgctttttagactagctgtgcattcattgttgactggctttgaaactcttggcaagaattaccactggagagacactgaatgtgctggctgtaatatcataattctgctcttccctctcaattttgaatgtgtctctttgtcaacatctctatgttaacaacagtgtgaacttattggtattatctgttcacattcctctggtattctggttattgcctaaagataattggtttctttaccttttctttgtcaaaactaagcatttatttgagtctctcctgtgataaagatttcttactaagtcctgggaagagtttctacttctcttcactttattcaagaagataacagacatgttctttccctcaggggactcacagcct

SEQ ID NO: 122661 - DNA, 1009 bp, Homo sapiens
aatataccctttgctctacttttttttctcctctccatacactacaagttattgatacagggaattgtcccctttgacaagagttacaataatttgtggagaaaatggcacctctgttttttagcattttctatatactacaaatgtatttccttatttgtatacaaggaatgtcaatttatctaaattgactgtcaaccaaagtcatttctttattgacttccactactaaatgagagttagattccaaaagatctgtggtatgcatgaggaaaattttaaatttaaaaaaaatttttttttaagattccaaaagatagggcttgggaagtagcctcaacattggtattactggattaccttcagtctgggagcccaagtgcctggatgtctcagtggagaggctcaggacttagagcaggagttagacactgaagcccttccctctggagaagccacacgtgacttctttgtcgattgctttagtgaatgcttccccagtggctgacagagaactttgcctccattttccatgctcttcagggctcctccagcctctctcacttcttccttgtttgaggaggaaatggtacgcttccagtccaccatgctcagtcatacggcttaaaggagaggggaacaggtacctgcttggtgccacaactatagcaggcctttcttcagtaaataagctagagcttttctttggacctaaaactgaggatgggcctcatctaattaatcttcctaaaacacagttctgcacactagactttcattatttttccattctaaccagaatgaaagttttagcctcgcatttgtggccctccatgttttggcctgagctgtggatgcctgacctcatttaccagtatcccctttttgtcagggaggctgccccattccctgtttattctgtagggccccacttgccgccttctgtcgggaggaggctgatccctcagggattccctctttacttttcaatcttcactccggtctgtgg

SEQ ID NO: 122662 - DNA, 1056 bp, Homo sapiens
cttcatggattaactaacaaaccagatttgcttcttaaacaggctcactggacagactattagatccatgaaatccaaagccatagcaagtgaccttgagtatggcaccttgcagggtcatttctcaatatcgtacagtacaagataaatagaatttaggttttagaatatgtaattggatcaataactggttgaataactgcatccaacagttgattgatgtctagctgaagatatatttctggcagtgtttgacatgactcagaccttcaccttggaataatttttatcggatgtctacataaaggtcttgattatccaaaattttcacggcaggaagagaaaatgcattatgtcaagaacctatagccagaataagaatataagatcatcttaacagtcttcaataggcagaaatgtgggaaactgttaccaggtttaaaaactgaaaaacacaagtactaattgagaggaatatgatttgagggtttaagtttattagattttattattagatattattactcttaaacataggaaacgtagtcacgtgaaccaaactaaatacatgggttagcttcgcttttccttatcagtaattttgtagaatattaaagcctttgccaatatttatgtaaaattcattcagagtgatagacctcaaagttaaattacacctatatatagtacttttaatcagattatatcaggtgcacattacaaattataaaatacagttaaacacaccagtcttattttgtgatgtttttgcctaactttgacttagtaattctgtctcctaacttgttttcataattgtccttttataggaatttttttgaatttttttaacttaagcaattacttgactttaattgttagattcttaaacctttttacagagagcatgtaaggataaaattaatacatacctccttttttttctggaaatattttatcccactaaaatgtagactcaagtgagcttgaggaccttatcagtccttattgccatttccctatcacctaggacagggtctggcacatagtagttgc

SEQ ID NO: 122663 - DNA, 1091 bp, Homo sapiens
cagctgagacctagccagctttaccagcgcatcttcatttttaagtgacagttgggattttgcctcagatacttgaggaaggtattgacctctctggagatctgcggaaggatctttctccttttggaatgaatcaggatgcttttctaatagttgaagatcaaaagtagtccaaatagaatttcagaagtgattttaatgatgccagaaaatggcaagtcttacacagctgaattcttaaagaagaaaaattaaccaaaaggaaatcatgagatttcctagaaatatttgttcttatgtgtgaagaggcaggctaatcttttgtatgtgagaggccttcagtgttgtaaataggataaatatgcattttgtcaaagatattttatttttaaagaaaagcatgatattttgtgtgtgaagtttgggcttttttttttccaccctaaatccttcaaatgtttttagtcatgttttttaagatagtgaagagctgcatatttcaaaatgtatttatattctgaccttggttcataaaagtctgccaagcgccagaactatttaaatttggctataacactgtgttaacgtgatgaataacgattgacataaatgtactatattatttttataaattgtggttagacatgatagtaattttagaatatttacagtgctatttttggagactttttttttttttttagtcaactagcagtgttgaatgttttatctagccaactacaggttttcagctcataattagaaatgcctgagaagtccatattgtgatttaaggagttattagcccaagtcagcaattttataaggcattcttattaggaagtataaaatgaactttatgtagtaaaaaacgtattttataattggcatatatctaatgcattgtatacattcactcatattaagcattttggttagtcttcattatttaatcctcctgtggttacttaacatagaatgtgtaatgaagaactcagtagctttaaaggtggggtggttgaggagaatagaaaatgaaggtgatttattaactactgttgaaagctgctttagcagttagggtgaataaa

SEQ ID NO: 122664 - DNA, 1053 bp, Homo sapiens
cgattctcttttgggatgcacttacctgtctctgatccatccatttgaagcaatgtagtggttagaagggtggatctggactcagataacgtgggtctgaatctggcctctaccattctcttgctttgtgaccgtctgcaaattacttaatctctcagaactttagtttcctcatttgtaaaatgaggttaatagtacccactttgttggatcctgaggcttaaatgtgatagtaaagcacttagaatggtatcagacatgaagtgggcacacaacaaatgctgcttgtgattattgctgttactggtcaccacctaaagccatcaagccaagattgcattgatccatatgctgtttaataactcaggaaagtggataatgaagtttcaaaagggtatcaaaaatagttaaaattgagttttagtgcttaaagggatacatttccagttcatcaaaaagatcttccatacctataattttattttgctacggtcaactctgattttctttgatttttaccaaattccaaaaaaacttaagtatctttagaatgatatacttactgcatatacatcttcagcttcttcagaatatatgttaaagaattaatttgtctctttctcatagtcaaatatgcctattcccgcagataccatctttcagagtagtcacagtcgagttatcttaatttctcttttttctaataaataatttttttatttacacaatgcagatcgggtctcactatatttcccgggctggtttcaaagtcctgagctgaagcagtcctcccacctcggcaccccaaagtgttgggattacaggtgtgagccaccatgccttggctgagttatctatcttaagtattgaagttattcttctaaatagagagagagatcgagtaaagtgaatttcaatctgtttcatcttggaggaatgtttttaagaagtgagaattattattttaggcttggcaaaaattatataattatgataaattctataatcagagctcagtccatcacttagtagtcaaagttagcataaatcagt

SEQ ID NO: 122665 - DNA, 1034 bp, Homo sapiens
gtcggtgattccagagttatgtatgcagatctaactcctgggattcaagtgaagtgatgcaataaataatcatgtgttgaagtggtaaaatgcatggcatttttgtatttttctaggaaaggcttgttagcctcaaagctgaaaggatatatagcatagaacatggtgacaacttacaatttaggttaatcatgtcaatttaagagttgctgcacttctgctgctcatcagggggtagtcagaagatttatctgaggaacagtctgaaaaatccattacaacaattccctaataatgaattccaaacaccagtgttatttgtagcaaatatttatttaactcccatggattctgtgggcactgtattattcctctagagaatggagacggagtaatagttccttatgcctggggagacattggtgtccagcttgctatattctggtgcaaaggctaaagtgaatgtgtttgtcttccgagggcaaagggcataaaacacttttaacagaatgctgccaggtcacttacatttgtaccatgggaatctggagtataaaggaagctgactgcagaaacctcaaggaccagggtgctctattattgtaggctcatctatcttggcatatgttgatgagtgtgcctccatccttttaatcaaaatgattgaaatacaaagtaccacatgcttacctggtatctgcttaagagtttcccaacagcagctaaaaaaaaatgaagagatttcatgtgtgtacacgtttagctgaactgttaaatttttttgtttttggtttctccgttaattttcacttgtggaaagggcttgaactttgtcttgttgtgggacagggaagaattatattattttgagatataaattgatgataccccgtgggtcccactttcctttttatggccagcaggcatgagggagtaaaagttagactatcaggtctagagctggctcctgggagaggagtaaagctttcaactcctattttacagtgaaaatggaagatgaccatttggtctgg

SEQ ID NO: 122666 - DNA, 1030 bp, Homo sapiens
taataggtattcaatacatatttgttgattgtgtaagtaaataatgtaaataaataaatgggaaagatgaataaactttgttttattcacatcaaataacaaacattactaaattcattaagtgcctaccacttatttttcttcctatcaaaagcatcatctttaaatttgattaatgttgatttacagtttcatctctcttttgactatttgagggaaaaattataatagagtttgcaaatattaacctctttaaatgttcccaaaccattctccattgtgttttcagcataatgctgtcagtttaaaactaaaggattaaatggggagaggagattatgacctaagcctctgttaaattactaaaatttgaatagcgttggtttaaatccaaactaagaacatgtaggcaaggaattaattttagcgtgtgtcctagaactaaccttactttttacccttgttgttttcatttatctgagagattaggacaaatgtttttttgatagataccataactttactttttttgttgttttattttcagtgggtaggtgtcaaaattcactgttctcttttaatgggcactcatttttcttgtgagataaactctggtatagtttatttaaatatgtatttacatatccctttaactactccatttggccctgaaatagtctcttgtctgtgaagtatatatgtacagcatttttcacttattcatataataaccaataatgaagtattgattaatgaactgattttattttgcctaccctagaaacatcccctgtcaaaaatactcacatgatttaagaattcctcattcaactgaagctatagagattgaaccttggaaattatgttttacactttcctattcaaaatctcagatttgtacagagggaaaaaagacttatcaataattctttatataggccaggtgcagtggctcacacgtgtaatccccatatcttgggaggtcaaggcgagaggatagcttgaactcaggggtttgagaccagcctgg

SEQ ID NO: 122667 - DNA, 1035 bp, Homo sapiens
aattcaataataccctctggtataggctgaattgtgtctgttcaaaactcacctgttgaaatcctaaccccactacttcagaatgtgactatatttgaatagggcctttaaagaagtaattaagttaaaatgaggtcattaagttggaccgtaatccaatatcacaagtgtctttattaaagcggaaattgggacacagacatgtactaagggaagtccatgtgaagacacagggaaagacaaccatctataagcctcagagaggcttcagaagaaaccagccctgccaatagcttgatcttggatttttccagaatagtgagaaaataattttttattgtttaagccccccctgcctgtggttctagcaaactaatacgtgttagtttgttcaagtcagttaaaagcaggatcagcatgccaaaaggttgaatcaaggatataaaaaacaacttttagaaccttttcaagaatatgtttttagaaaaacaaaatgatagaaaacaaaaggaaattttgtatatctgtatcctctatacctatgacaaattgagataagccattaaatcttttcccttttcctccccacatctccaaaaaaaaaaaaaaaaaaaaaaaaaaaaaacataaaactgaaggagaagagatattcaataaggggaatcttttgtcgaaggtaaagtaatttgtaaatcataaatgaaaatgaaaatattggaaagtagttgtgtttgtttcttatgactatagtaacaaagtaccatgaacttggtggctaaaaacaacagaaatttattttctcacagttctggagccaaaaggccataatcaaagtgttaacaaggctatgttcactccatagttgctaaggaaagaactgttacttacctctctcctggtttctagcagcctttagaatcttagcttgcagatacatattgcttcttcacatggtgttctccatttgtgtcttttcattgtcttccttttgtctgcctgtctttgtgactgtatttccccttcttataaagacac

SEQ ID NO: 122668 - DNA, 1072 bp, Homo sapiens
tattatatcaccaatgaagtagtttttcatcatgacctctggcttgctaggacaatcaaggctaccctagaccaaattttgataaaatggtaaagatacattgtccgtgcctggtgaaagtacctgtttctgacattcacatttggccaagtcagtagtatcttcccagtcatagagactgtgttgattcactcttgtgaagaaatttttatattgatgatgtcttttgttacatgtaatgaacagatacactattgtaaagcttaaggaaacctaagatcattgggcagattgagcaatacttccagcttctgtggtgtatatgggaagtttgttccctgaagcacatagtgtgtattgtctgtgtttagtatttcagagggttttgatagcagccataaaatcatatgggtagtttttttattgctgtgagaagactgttggagaaattctgcaactctccattgacgtcttgtactatgtttttttctttccaatgggtatacatacagttcataaattttgaccattttatttatgtaatatattttagagatttctgtatttcttcacagaaggtttaattcacttattacaaaaagggaagagaagatgtaatgatgataggtttctgtgaaaattatttgtgtaagatcatacttatgtgtagcacaagatgcctaatagaaataaggacttggccttcaacacctgaggtgaagtgagaaagttgataaacctgactcaagggaggtgagacacttgactgaatatcacctcaagtgtacaaatgctttcctagtcttaccagaagagtctagatacttcccacctctagccacctgccgtgcctctaaagctttgctgcaagcaaacaaactgttatgtctttatcatcttcaaacatcatcccgtatcctcaagggtactagacttttggagcctctgagagccttaaaattataatagtggaataatagttgaacactgcttagcattgtatgaaatagggaataaaggaacagctgggaattttactgtctttccttcggtgtacagaaacttctctaaa

SEQ ID NO: 122669 - DNA, 1593 bp, Homo sapiens
cttttctcatcttactataactgtcagtagcatttgatataggggaccatttttttttttttcctgtgtgaaaaattctcttcatttctgtgtatcacacactcttattgctgcggtttctttttctttctttcttttttttttttttcattctctagtcaacctctgaatgttggaatactcaggatttagtcctggacccaggaccaaggatcctaggtttctgtgcactctactcttaatttattacacttaaacatttgcctttaaatatcatttatatgctagtagatgcccccatttatatctctagcccagacctctcttttcagctaccaaacctatatatacacctgccttctgacatctcaatttatacatttctcacttaaacatgttgaaaattgaactcttgggtctcccaaacctccttctacaaaaacaaacaaaatacatctttcatttctgtctcattaagtgacccaaccgtctctttaattgcttaattttgaaagtcatcataacttttttctgtttttttaaacaatagttgatctttattataaataaattaaccaatgcagaaaattaaatataatgaaattccttgtaattctaaaacggtcattattaacactgtggaaaatcattctaggcatctttctgtacatatacagacagaaagatatgcagatatataaaaataaattcttttataaaaatagaattatagtacagttgccactttaaatttgaactgaattttataggaaaacaaaaaaaaagaagccccagtgtgagactgaaggaattgctgaatttcaaataactgttttttctctccaggggtcattattttcgaagagattcctctaaggtaaagagaaaacattgtgtaaaacatttcaagaggtttgagtgtgatttttcacttttggacagtactgatcaactctgctatgatagatgaagacattcatgctcttgtcagctgcccacttcccctgtcctcacctgtgttaaaaagtagttcctttgcccatttcctaacccaccgtcatgagtcagagaccctatcttcctccctctccaggagtgtgattaagcaataagctaatctgcatttttcagtgtagttacctaatatgtgaagtgccttttatgtatgactacacagtaaatttacaatttaaaaatgtactcttctatatttactcaaccagtatttattgaatacgtattctgagctacagactgtgctagtatggggaatgcaatgatgagtgaatcagatgtggtgctcattctctttaaccttgttatctagtgaggagtaagataattagttaatcgaagaatgtgaagtaattaaggcagaaaagaaacatgttcttataaagccctcacccatcttttatcattttaagttactggcaattctggacaccattgtgtgtcttaccctaatgtatctctacctttcctgtgtacaatagttcctacccttccttagcctgaactaatgctccgaggaggttagactccttatctccctcaaggacaaaacagcatttattcctgcttctgtacttg

SEQ ID NO: 122670 - DNA, 1017 bp, Homo sapiens
tttagatttgatgcttagtgatgggcaaccacagcatgcttttgagctggggagcccaagagtaaatgtgcctgagaaaaatattctagttgtgtttaataagatgcaatgagagtgaagagcttaaatatttcatggagagattggtaaaattgcaccagaaaatgggttagctttgataggaaaaggcatggcttttaaaaattagctatcatatttaggttagttggattttcagtgaatgtagttaaaagatagcctcatggtctgagggcaaaaatatatagaatttattatcttgccccagagtccctaattattattcccttgcattttcttacatattggatatgaaagtgcaaagaatgagaaagatggattattgaatttttgtcagaaccaaacttttaagagatatatgacattttaaagcatattccaaatttcatgtatgtatgtaatggttgttacatcatgcattgtcagcttatagattattgctgtgcatgttaactgttttgtacttatatatgtacatatttcaaacgtatgggaattaggtatatttaaaaatgagccctcaaagtcatacagataggaaactacattaatgactctccatggatgtggttgacaaaagtgaatcatttaaatgactgttttctttccctctagtcttttttagcactggtgaacttgttatcctatcctgctatttatgagcttgtaaggaatcaagatcttcctaataaaacagaatattctcttcgtgaagtcccaacatgtgttattgtaagtcattttctttaaatctttctctgttataaatgctactatttgagattggtagtaaaaaggtaatttgaccaaaaagagaaaaaagaaacattatgtaatggcatttaagggctgatttgattaatcatgcatgaattatatcaacttttgaattttctatgcgtggaatctttgatccaggtcacctaacattcccaagacctatcagaatacaaggct

SEQ ID NO: 122671 - DNA, 1050 bp, Homo sapiens
tcctttcccagtgggacaaagttctaagacttaaatgggtactacagattcttttcttctcgtagatgaggctttaggttaattttccttacatagactaacactctttgggagttattttaaagtaatttttagagacagctgggtttttgttgtggatactagagatcgtaatgtagcaatagccatatatgtgtatatcagtggacaactaagtcttttccccccatttgatatggtttatttgtaaaatatgttatatgatatttcattaacaaccaaataatttaaaatttgaagataattttgattttaataacattaaggataaaacaaaaatgcaacataagaaatcttatgggtagtgctatcagtaagaaatataaaatataattataaatataattataaaatataattataaatataattataaaatataaatatatggctagtgctatcagtaagcaatataaattattctactattttttagacaagtttgctatcagaaagaattcctactccagtagagggttctgattctgtttcttcagtaagccaggaatcccaaaacatgtaagtacaattgatgaaagtcatgcatttattatatttgctgaaataaatttaaaattattaaaatgtaatagaatactatggcaaaaatgttttacaggatggtaaatgtatatatacagcttcaaggaaaattagtttggaaaaactttagagatcatgtaatactcataacctttttaaaatctaacaatatttattatacttgtttcattctgtttttacatcttagattaggaaatgtgatattatcgtgtttccagaaaatttggagaattaccaaataccaaagttggaaagttaactggagagtttagtagaaataatatgttctcaaatgccaatgaagtctatttatatttaaaatattatttttctaaaagtggtgggagtacatttcagttaggttttggctttggaaaattatttaaatcaatatttatatcaaattttaatttatatgtctccatg

SEQ ID NO: 122672 - DNA, 1024 bp, Homo sapiens
atttttaaatatggttggcagaaaatgattagggtactgtcactttggagcatttcagtgttggcacatttctgcacatgtagaccgtacagtatcctcttcagtataagagttgtgctttttaattttttttccccactatgtatctttttttggattctgtcataggtatacttttttggtggtggttttaaaatagtttagcatggaaattggacacaatcgatggatagaatgttcttctactggtcagtcactaaatgatctgcaagttttttgatacgatttgcattcttgtgattgctttgctcctaatacaatgcacacataaacacctgtctgtcattgactataagggtttaaacctaagctattgtgtgatttatgatgttgtcattagaaatcatgcaggaaaaatagattttgagtggcacagcttgagtattaaatatcatttccttttaattttagcatgcacattatagcagaactacagtattaagacttcttgaaacgaaatataagtctctggtaagtctgtaattctgtttttatgttgagaaataatatcaccagaatatatatgatgtaataacttgactatgcaaagttgtgtggtgataattaatattggataatgaagcaattcgccttttatgtgatcttaaactaccatcctgtgacacataaagggataaaaatagagacttaaaatgaatgcagtcaggataacaattagaaaatatgttttatatatatagtaaattggcttctatatataacaagctagtttgagagaagccatatttttaagcagtagcatgtagttcgattcacatcaagtattcataaagccattacttttataatatagacccatgtttttcagtgaaaattacatggaaaaactcaaaatgataaatacttttgcattttcaataattggtttgagttataccaaatgtagacttaatactctaaaatatgttaccaaaatcatctacatttgttactattagtagaa

SEQ ID NO: 122673 - DNA, 1053 bp, Homo sapiens
ttgttttgtgagaattgttcatatatcctagaatggaaatgctttgccaggggcatatctgggcaatgttttgaaattaaagccctcaaactgtaggaacggcctagaatagggaaagcctgtaggacaaggctactggaaaatgttgcattggtgattctgattcaactaccattcttcctcccattcctcttagacatgatacctaaaatctgctaccacatttagtattttaatttttgctttacacaaacagcaactgttttttttctctgcttagcacttagtttaaaaaatgatttctcaagagctttttaatataaaggcatctgataaatcattctttataaattatccagactttaccttttagtagtttgttaaatattgttttggaaaagtggcattattttagtgactgagtgttaataaaagtcttttaaaaaaattgtaggtgagatatgaagccttgcaaacattatgttcagctcctccatctgatgtcctcaactgtgaaaattggactactctctgcgaaaaactgaccgtgtctctttcagatcctgatcctgtgtttagtgtaagaaaatggttatagaaatattaaaaataatttgttttcccaccattctggaaataaatagaatatgatagttacgatagttttcttttcttttcttttttgttttttttgagaccgagtttcactctttttgcccaggctggagtgcactggtactaccttggctcactttaacctctgcctcccaggttcaagtagattctcctgcctcagcctcctgagtagctgggattataggcatgccaccaccaagcctggctaatttttgtatttttagcagagatgcggtttgaccatgttggccgggctggtctcgaactcctgacctcaggtgatccgcccaccttggcctcccaaagtgctgggattacaggcatgggccacggtgtctggccgatagttttctttaatagtagctgacacatttatggaacttcagtttcagctttctaattgtcaaaatttttctt

SEQ ID NO: 122674 - DNA, 2297 bp, Homo sapiens
cttcacacaccttggtcaatgtgaaacaagcttgaactggttatatgcttccccaccatttttatttattgtaagctactttaaaaattttagacaatgttgtaataaaaatatacacctttttcccccattatccctggtcttctggtgaagcaagcagtgtaatcaatgattcttatgtgtgaggagcaactccaagtagaggcgttcatgtccctaatgcttttttatttttcctcatcagcaaatttaaactacaactttatcctgatcccactgctgctctttgcctcttctccccccagcccttccacatttaccagcctcctccctacctcctcccagcctttccctttgccctcccctttcttctagcccctcctcccagttgagtcagtggcttgaaacttttaaaagctctgtgctccaagttacaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtaagtttttaaaaaatgagaacacgttacctattagtttctttttctacaagtaaaacttttctaaagttttaaaatgtgttaaatgtaattttgaattatgatactgtaaatggattgatggatttgaaagtgtttctatagttttaaagttaaaatttattgtaccaaatatatattttgactgttaaaaaagtttctattaacattgcaacaggtgaaaaggttcaaacctttccgattagaataaaggattagtttactggatgtttggtttttcattttagagtatcattttattttgttttttttttgtaatcagtaatagtctaggtgctatcatttgttgggtggggggggggcggttaggcgcctgggttgggggatttgactgactacatcggaaaaatcaaagtgcaaatttgcttagcgtgcttcctatagtattctacacttcatagaataaagtgcttttttcatatggaaatcttgattgatgttctatagctttgcaaagccaacttcttttgtgacgaagtgctttgttaaaacatcgtggttacttgacttccacgtggttccttcctagaattttccccattaaacaaaaaggtataaaattcaagagtattaatattatgctttaaaaatcaacagtaaattgttactttgtgttagcaaccgctatggaaagatttgagaccctcaggagagacagcttttactcgaccacgttggcagtttaggagatgaaatctcttgaatgggtggtggctagttacagagcattagagatcagacgtttaaaaaagagtgtatgccagggtacttttccaaaaccgtctcctaaaacgggagctcctagaaagagcaggaaaaaaactttcttaaacagcgctttgggagctccccccgccaacacccgccgccccgcaccttccctctgctcgaacctgtaacagaattcagaactctggggcagttctttggagttggagctcctagggcaaagataacgctaatgcgttgtttaaaagggttcaatttttaaaatacttttattggtaacacccattctgttcatcagaaatgcagccatgcatttttgtgcccggtaaagattttctgttctgtgtaaatctacaaactaaaataattagtttagattcttgacgtgaccctgcagtggaagtatttgcaccagtgaatgctgaaaagcaaataaaaatgaaagctttgcggaggccgtgggccggacgggcgcggggcgcctcctgccatcttagcgtctgccgggatccttcccgcgccttcgctgcccgaaccagctcggtcttgggacgtttcccccaaatcctcacaagtcaaatcgaactcaggtccgagttcgtcactgcaaaggaacccggggtgcggggtgggagggataggaggagagatgggctgggtgccaaatggtagaacaaatggttgatttaattaaagttgtcaatctaatttcccatccctctcacaccagccctttttttttttctttttcttttttcctcttaaacttgctgaatcccactatctccgcgttggtaagaaaacctgaataccttgggaattgtgcttaaattgcacttgcaactcccctggaagttcctgaaacttcccgagaatgaggcggg

SEQ ID NO: 122675 - DNA, 2095 bp, Homo sapiens
tggtgaagaccaggaatgtatgtttttaacaaatgctgccaagtgactgtgatgcagttcaggaaaggggccagaggagcctcaggctggtcacacttagtgcctgtagctttgggcatccatccagtctagggggccatgaagagcaatggaaatgtaatctaacatggtgcatagacggcaaaaagcgtggtccagctgctaagactctgctcttaacaagaactttgcacaactcctcttagacagaccttggtctacatataaagcaccaactcagtatcctagaggtgaaggcatgaatatatgtgatatgtccagctgcgttggtcttctcatgtatcaaataagaaatatacctgtttccccctggtgaataaaagtgcagtttatagtctgtagatcaatgccagggattctgtaaacatataattatgcccttttattataagagggtattaacttaccatacaagacttggaaaaatgaagatattaaactagtttgggaaggtgcagcagggaggaacaaccagttgccaaaatttgattcatggcaaagtgagcaactaccaaaaaaaaagggaacaatttttgttacctgtttttgggcagctgtcacattaaacattatttgatggtatctatgatagtggagatcgacaggtagctacatgttacaggatactcggtgtccaattcgataattcgtatcttattaagatgaaagagtataactcattaatgcaaatgacaactgcatgggtgcttaaagaaaagacaactttgcaattaagttactagagtattaaaaaagaactaatgaagagctgtctgatgacttagttcacatactatggaactgtggagtgtttttgtagaatctcaaaattatatgaaagtcatgtatcatgaatttttttatagaatgtaaataaagactatactttcagggatcatttctatagtttgttactagaatgtaaataaacttagtgatgaattactataagcatctacacaatcatattttactttgagtaatgatgaaatcctagctaaaataacttctgttctgcctggtcatatttctagatatgataggtttgtcttcagctctatcgttgcatgaatgtgatgagatgtatgcaaagtttatctttttatacttgattgtttttgttatttttcccctagcaattgaaatatgtgagcaaaagcagatgacactggcaaaatactgtaattttttacaaacagaattagggccaattttacacatcatcacatagaaactgtctattgatatagctccaaagattctgtttgtctgaccctcatggactatacttcttcatttccagtctagtattttctgctaaattgtagggtttttttttctttcacattctctcaccatcaaactgtccatcacggctaaattactccctcacttcaagcctttccttggctattcaactgtctttgtcagcctttcaagcctttgttcttatttgactgctgttttaaattgatgctgttttcatacatcaatttcacttcctaacttgtcacttcagaatctaaaatgacccttcctaagtaaaagggaagctccctttcttatgaccactgggggagtgttatttctgtggccttcacacccacctcccactcttactcagcattctttggcactagtccctgggctgtcatcaaatgtacccatgataccgtggtaccatctagctggtgcatagtttagctttatggctcagccatctcttctttgttcggtccaggaaatcccaggtcaggtgcccatttcattttttcttgttctctatggccagaagatgcagtcattagacagaaatgtaatgttgcttactgaggaagaagactcccctggatttcatttacttcctacaaggagatacagctcaatagttcaacaccagaagagaaactcctttatattcagatagtgaacatatttctaagaagcctaaataatcctacctttagatactctatttagaattcattactaagctcctgcaaagtcttagctttgcttgtttttaattattaaa

SEQ ID NO: 122676 - DNA, 3816 bp, Homo sapiens
gtttataggtattcttacctggattcttgatacctatgctttgaataacacacatcaggattttgcttagcaaacacagatctaccaggcaaaaactgtcctcatttatcagacaaataaaaggagcagaggcttagcacaggtggcttctcaagtcacacagcaaggcagtggttgagcaagcaatacaccttcccaggttaaagactgcaactcatcatctgttgcttctaagacttactttgtctcaacaaacaaaacaaaacacttgttagatcttttcttcgttggcaaaaatgggacaggaagagtttgcacttggttttttgtgaaagaatgttagaaatacgtgaaaccgttggtagtattttgactatcacctgaaaggtactaaatgttaaactagtaatttgcaatctgtgatccttgaattgtctctttgtttctttcaggtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacatagcttctatattccgtgtgatttgtttcccctgccgagatggagtcttgctctgtcacccaggctggagtgcagtggcgcgatctcgtctcactgcaacccttgcctcccgggttcaagcaattctcctgcctcaccctcccgaatagctgggattacaggcaccgccaccgcacctggctaatttttgtatttttagtagagatggggtttcaccatgttggccaggctggtctggaactcctgacctcgtgatccgcccacctcagcctcccaaagtgttgggattacaggggtgagccaccgcacctggcctatatttaaaactcattgacggcatctatttgagattatttaaacacatttctattggttatcagaacttcagcaaataacagtcatgttttcagggacaatatttatcattagctctgttcagtgcaacataaattgtaaacatttttggatat

SEQ ID NO: 122677 - DNA, 1032 bp, Homo sapiens
atggtggcacacacctgtgatcccagctacttaggaggccgagacatgagaatcacttaaaccctggaggcagatgttgcagtgagctgagaacacaccactgcactccagcctgggtgacagagtgagactcagtctcaaaaaaaaaaaaaaaaaaaagaaagaaagaaaaaagaaacttccaggccaagagctggttttttactttattttatgaaaatggctgaacctctcaatttgcctagggtgctagttctctgcccacacgtggcctcttctaaaaattccaaacttcggattccaacatgccaaaacatctgtgctttgtacttggagggagagcaaaataatgaagtttggggacttattaaagtctgaaagtaagttctttttataaacagcacaccaacagtgtagaaaaatgtttctaatctttaccggctccaagattctgtttttaccttttcttggttgggcaaatatagcttagcccttggcatgtcagaattggcagctggcaattttcagaactgaagaggagacgtggaagaaataccacagaaacactgcttcaagaagaccagaaaaaagaagactattgtatagagaagaaagctaatttcttttaacattaaggagggaaattatgcattagtttcttggtcttcaaaagtgttgaaattttaattcggattatttcttctggtctccggatgtttccttgcaatgactaaatgcttatttgggttatgacgtgtagtgtaatttcaatgcccacacactttcctgttgaatataaaaacagtctcatgaggcaccgactttagaaggtaaaccctatgcccaagtcttattgaatgcaatgtgtcatctgtccctatgcatatggaacaaaatggagcctgatctggctttcatgctggagtcttttgtcagtcagttactctttacaaaaccgttcatcagaattagtaaagacagtaaaatagtttctagaggctacattagcagaaaccctaagtgttattttat

SEQ ID NO: 122678 - DNA, 1037 bp, Homo sapiens
gtgggcaagacctcaaatgaaatttctgtagtatatctaaattacctttaaattattcattttaaggtgatttaatgcttttttttcccctgattggtcatattcatcaggtttagatgagaagtaagctctctgggccagggtactattactacattgtaattcctaagttaaaaagaaaaaaaatcaacatttaattgaccctggaaacctaaccaacctaaagaatatttaagtttatcccatctttggcaagtatttctaaaacctcggaatcagagcagaacctaacctttggaaagtcctctcttcactggccaacctgaaacctataatattgtttttaatggcttgtagttaacaccccgatggttatgaatgggagatttcataaaggtatgtttggggagatgcagtgaagtgccaagtgtctactaagaattacttatttattcaaacattattttattgttagtttcattggacatttatacctaacagttgctacatgaatctggaaattaataaaacaaaaccccaacacaaaagagcaatcagtttacatgtctttcttctaaaaatgattgaatgtctctgggtatataggaactattttatgagcagacaacgtgaatggtctatttccaaggccacccagtgtattctgcactttaatgtacatctgatttaagttgtctccacctgactaacatcttttaaaaaacgagtagtttagaattgcttctcagttatgagctggaaagtaaatattttcacttaaaggaattatagcatgtgaaaataaataagttttagaagtacaatcaattttgatgctttctgcaagcctgccatacaataaaggtcagtctttcagaatttttagaaagcacaaagccctttcatttgtgatgaaataaagagagaaaaatgtcaaccttctatacatatatatgttcctgaaaactctgcaataaatcttcccttttgtaaataaaaatcacaatttaagtatttccaaagagctttctatttga

SEQ ID NO: 122679 - DNA, 1019 bp, Homo sapiens
aaagtcttgattgcagtcaggaggctggattaaatggttcctggaatctcattccaggctgattgcatggttctcagacatttttggtgatgtgttttattctccctcagtatgaatattaacccctaccgtcaatagagctttgaaaagcttctctattgaaggtgggggataatcatactgggggagaataatggctattataaaagcttctcttctgccttcagaaaaagagttactcttttttcttcccagagccttgaaaaatgaatacaaagaaactttgcaacttcttctaagtgaacagtaaaccttgagtgttttgtctatggatttttaaaatcattggattgactaacattctcaaatgatgcaagtctctaccactaaagttttaattcaaacctaaaatgctgccattattttgggtaatgatatataattaagtctgccgactgtgttctcatgcttttctatcagtgattcatggctgctgtcacaaagcagcagcatatcggagcttattttgtcaaagcctttgtttgaaatactcagcaaacagggttttcttgatttatcagatcgtcaaggtggttcacgtgcttttgtgaaaacctgagtctctgccaggtccatttatattcactgcaacctttttttttttctagaaatgtttatgatgttaccataaaattgaataaaaagctaagtctagttttcagctaagcatgttgactactgtatattccataaagcaaggttgaaaaagaaaacgggttatgggatctaatatcttaccttttccaaagattatctgttggtatcctgttactgtcactcattagaggataaatacctggagtgacttgcttctgaggagctgctcttcccaacacttttacaactgaagattctaatagcatatgccagtttctcctcacataaactgttggaataatgaatgtctattttttgggtagtaagctaatgcagcagactagcagaagtcaagaacaaaa

SEQ ID NO: 122680 - DNA, 1025 bp, Homo sapiens
aaagctaggtgaaaataagaaagccagccactagcatgtacttaaaataaacacatgtctcatgcttttcatcagttagaaggattaaaagttgacaagaaggatcagtacagactgttactcagacacgtattcgtgttagagattggactgagattctctccccacgaaagctgactttatcatacctttttgtcttttatgggccagaaataggggctatatatattggcagttgcttttaatcagagtatcatgtcagtggtaggcctattaaattctgattagcaacagtgttttaataacattcttattttctgagtactgtcaaatgtggagagtttcgtactgatccgtaaatgcatcattctatgagttctaagccaaataaacaagccacttaaccattttttaatcccattattaactttaagcttatgtgttaaccaattttctaatatgccagtgggacaatcaaaatgtaagctcagtgagatcactgtgccagagacacactaggtgtttaataattgtttgatgaataaatgagatccctcgaaaatgtaatggagtggtaggaatgatgaagataaaattatatttgaaatgactcttagagatcatctaggttagccttatcattgtatagatgaggatttgaggcttggacaggtgagattatttatccataattatacagctcgccaagattggagataagaccctaacataagcttgtccaacccgaggctcacatgtggccaaggatgggtttgaatgcggcccagcacaaattcataaagtttcttaaagaaacatgagatatttttgcaattttgcttttaagctcatcagctatcattagtgttagtgtattttatgtgtggcccaagacaattcttcttccagtgtggcccaggaaaaccaaaagattggacacccctaccctaatagatttctgagctcccagatcagtcttccaccaatagaactagacttaatgcaagttgacatcatatttagtt

SEQ ID NO: 122681 - DNA, 1020 bp, Homo sapiens
agtaatatattttttaatgcataatatcttttggtaaaataagatattttactaaatctgtaaaaggggtggaccatgaaagaaaatggcctagcatgaaccttttactgcataaatttaattaaatgtggaatgtggtaataaagaggcttgggggaaattgcaaggagcttggcataaggggagaataaaagactctaagatattcctgcttgcggaaactttttaacattaaaaaaaaattttttttaagtagattattccttgcgttctctcccattgagctctgaagtttattctttccctagcatttcatcccgggcttttggaaccagatctcacttcctgaacaggctacgaaaacctcttctaatagggaagctttgaattacaatcatgggtgtttactgtttctttgattttctaaatttactttttcaaaggtttcatcttcaaaaccagaagaaaataaaattcgtcaggaagatttaacaaaaattataagtagtgctcagaaggttcagataaaacaggaaactattgagtccaggctttctgaattaaaaaggtaaagtgttatttccaaatataattttaatctgggaattgggtatgtgtctatgtgtgttgagtttggaggttgtctgatgttttattgtaagtactcagatcactttgttgaagccaagatcaaaggtcatttttctgcaagtattggttccctttactttgatttgtggccactgactttactctaatattgttttaattatgatagtcagaagaagatataaacctaagcgtatcaaaacagtttgatgtataagtcttagcaataaacagtaggtctttaagatgatgtaggaaatatgattctatttaggttagctcatatggtgctcatagacaatgagggcatacgacataaaaaccctgtatgttacccatcctttgtttaatggctgtctcttaagatttctttgtgtggactcttaggaaaaagtaggacacaaaaaaatc

SEQ ID NO: 122682 - DNA, 1715 bp, Homo sapiens
tagtttggattaaagaagatgacttgtggagaataacaaaagatggaaaattaaagcatttaataggtattcagcattctccgtgctgcgaacatttaacaacataatgcagtttcaattaaaaaaggtgaacgaagaagaagctattcatatttggcaagttattagtttattattggatatgctttttcagaataacattttagtggtttacatatgctgttgtttgagatagatcttaagatagttttagaatctgacagactttagtttgatttcaacacttaccaaattatttgtatgatcttgagcagttcccctcaattctctgtacctcagtgtcctcatctataaaatagagatgatgacttatttcttggtggtttttagagaaattttaaataagtaatacacataaaatgtctagcatagtgcttagagtatagtaagtgctgggtatatatcactaccctttatttcctaaggtgattaggaaggcctgaattcacttggtaaccacagttgaaagattagcttatttttttttaagcaaaaaataatgagccagattgtcaaaagtagtaaattgccaactactatattgatgtaggcatatgtcttaagtttctgtgtatctattgtcatgagtagcagatactacacttaggaaggaatgattctggtgctgggtgcggtggctcatgcctgtaatcgcagcactttgggaggccgaggtgggtggatcacctgaggtcaggagtttgagatcagcctggccaacatggcaaaaccccgtttctactaaaaatacaaaaaaaattagctggttgtggtggcacatgcctgtaatcccagctacttaggaagctgaggcacgagaattgcttgaaccctggaggtgaaggttgcaatgagccgagatcgtaccactgcacttcagcctgggcgacagagcaaagctacaccttttttttaaaaaaagaatgattcaggagttgtgtcaaggtagttgtcattcctatgtaattgaaccaaagttttcttggtctcataaatacatatagtaaaaacaagtgtagttcagttgtctggtattcttaattaaagatactatggtctggttttttgattgattttttttttgttttgttgcttaataaattataacatagtgagaatgagtccctttggaaggaggtgtcagaattacgagcaaagcatgcacaacagcaacaagttattcgaaaggtaagaagctcttttccccaggaccataatttgcatttgtttaatgagtactgtttgtgacccaaaaaggtctttattgagtgtctgtgattgatcttagtttcttacatattggatgcacagatagaagtaaaaaatgaaatgaaattaagccaagtgttacacatttttaataaaaaatttctcactagctaaagatggttattccatactcgcagataatgtctcagtagcttttagtaaatgatcttttgcctaatataacaattttgaaatactttatttttatgagcataatgaatacactaccaatttcttttaaaattagaaaacatagccttactggttttttttgttggtttttattataaaaggcatagttaaggtctcagaagataaatgacaaatattttcaaatcagttgaccaaattatgagttcagaaaatgatttctcaatgtatgctgt

SEQ ID NO: 122683 - DNA, 1085 bp, Homo sapiens
aaggctatgaattttcagttaaccagattttcaagaattcctactctagaataagatctcttaagattaagaaccggtaaggatgcagcagctgctagaaatatcttgcctagccaagttgtaatggtgatttttaaacataaaaacaaggatatctaatatttgattaaaaaaatttttttttccttagggttgagctgttggattatcttgacagtattgactgcagtttagaggacttccaggccatgctatcaggaagacaatttagcatagacccagatctcctggttgatgtaggtactttgggtaatctttgctatactggtagtttgtgtgtttatgtatattatttaaaaaccagtacgtcattttgttttgtattctacaggttgtttttgcatttcttttttaaattaataattttgtttatcagaaagaatgaaaaaataggtttgggacattgaaggagtatgattaccacctgccttggagtagcaattgaactaatttccctgtgagaacatatcagatcttttcagcagtactgttaagttcatgtcttgtctggacttgttgctcttttctgttttgctctagaatgaattgtcagtaaatagaaatttgtggaaattagtaatagaggtacttagctaggaaatagcatggagacaccttttgatactttggggattaacattttttactcaaatatgttttaatatatttgccttattttttacatttttatattttgagttacaaggttcccctgctccagtccccaccaccatccctatgaagttgacttcaatattgactggactgagaattcttatctaccgtttctgccactaaccacctttcttactctattctctcttgttcctgctattcctcccttctttatctaaagcttcctacgtggtctggtcgcgcttagatgaatcttgttctgtctcctatttccattttctgttgtgaacagttttctctctttatcctggaaaattttgttgtctttttttctgtgtttctttccttacattgcagcttctcttacccttttacaagcctctcaggct

SEQ ID NO: 122684 - DNA, 3656 bp, Homo sapiens
atagaggagcttacagtgctggtcctcctcagatgccactctctgtagggacaaaatttgggttaggcttcttaggcagtgataagctaaactggcagagattgattattatgagtcactatctactctcaaggatctgagctttcttccttttctgaggttagtagttggtaagaaaggagaaggaaataaaaaggcaaagccagggaattttataggactaccatgaatatggaactttaaagagaggaatcagtgtctagagagaatggaggaagaatctgcctgtggcttttttgcacctcattctatcctgtgaaccatttggtgtgttcattctcataaaaggctaactcagtgagtgcatttcatcattcaggccattcccaaggctcttattgctgacaggatgtggcctctacttttcgaacctatgtatataacttattcaacttagaacttctgtgttatttctatttctggaacatatcctaccttctttgttgatgccgctagtattatacccgtgtgttcttcccctagtcttctcctttccaagttctaacctaatattctccaggtactgatatatatcacatagttttatcagcccttttatttcattatgtatgtttctgtgtgcgctttcctcccttcccattgtcttaactccttagtgcttttgagcgccaccatcttctgttaaaatactggattatatctgaacgtgtgttgctatttgatgttggtcttaccttgtcctttagattgtaagctcctagagagcaggaatgatgtctttatgatgtcagttatttgttaaagatactcagtaaatttctatggaatgaatgactttaaagcttatgacttatagttacatctgtgaactggctggactgaggagtgcagtaagcagtgatcttagcacttaaaattttccttgcgaggtgtggtgaaaagaaccaacaagtagatatgccatctgtcagagggcttcacttgaggcatagtttaggagccactgtcatagagcagattctgtaaattttttacctaaccaggtattcagtgaaggctcagtgtcagggcagaggtctcaaccctgcacaccacttaaggccaaagacatttagagaaaaaaaataaaggaaatgaaattgaatgataaataatgaagaagggaggaggtgaaaaccactatttgtctcaagtgatttaccccaatgttttttagagaaattcttaccacatgaaattttatctaatgcatgggctagcttgttctgcttttgtttgtttttctttctgcttttctctttcaaacttgtttaactgtatagaagcttcctagtgcaggggctacatctcttcacccaacatggctgtataaaattttgaacacacaattatttttaattattttttaaacttatcatctttcttgtttggtctttcagcttttcactagttctgtgcagatgaatcccacagattacatcaataatacaaaagtaagttttaattcatgttgctcaggacccatagctataaaaatctacaaaaacgtcctaataagtagagagcaatgtcactcccagccacaaaaagcattttatattcttacccagtatgtgtgatcaagataataaaattctagttgaaaaattagcttttggttatgtggtgaactattacccacttttggcacttgtgggattaactaccagtatgaaattaacttcttttggtgctgggagatcacctgactaaacttggtatattgaaaccaataactaaaatatgatttcttcatgttttatgggcagcattttacattcttatttttcctattctcaacttttttattaaaaagttatagtacccatattttttgtgagttctatcattagcataaagtaaaaattcaggaattcttatttattgcagaaaagggaagttgaaacgtatgaatatttgactttttttaagtaataaggattttttttttgacatataggaactgcacttgggcttagcaagtgttgacaagagattttgcggaacttgtttttaatgagtagtaaggacaatttgaagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattctttttctttatagtccaaaaatgagcacatctcaaataaatataagtgattagggtgaggggtggaatttatacgattattgtcatgtgtaagcctgaccagactgtctatatcttcaaagttacattgtggataacttagagcttaaaaaatttgtgaatttgtgaaataggaagttgattatacattcagtattcagataatttatattggaggttggcatactttctccataaaggggcagctagtaaatacttttggtttttcaggccatatgttctctgtcataactatgcagttctgcaattgtaatgtgaaagcagatacagacaatatgtaaaagaatgtgtggttgtgttgcaaaaaaacttcatttacagacaggcagcatgctgaatttggcatatggaccataagtttacctggatttatattacaagattttatataacatgctctgtgtttcagtaaatatattactgaatgttattctcatggaccatttaagttgaatggacccatatcatttgttcatgtagtgaatgtgctttgttgtttatttgcgactggacattgagtccttatttgtggatcatcatcttattcctgaaaccaagaccttgattatagttttcaaaaactataagcagttaagcaacaaattgcattttgctctacaatgctgtagaaaaattacatttgagagtgacttttcattatagttctgaatctagattttaatgttttcaaataattggcacatcagctgtccttcccttgctcatgacaggtattacataacatggattacaacactttcctaataaatcagatgccttatacttctcagtacagcaatcttaattggccactatgaatgaataagaatttgcatgggaaatgaaatctcattcagtatgatactggctatgggtttgtcataaatagctcttactgttgtgagatatgttccatcaatacctagtttattgggtgtttttagcatgaaagagtgttgaattttattaaaggcttttctgcatctgttgagataatcatgtggtttttgtcattggttctgtttatgtgatggattacgtttattgatatgtgtatgttgaaccagccttacatcccagggatgaagccgacttgatggtgatggataagctttatgatgtgctgctggattcagtttgccagtattttattgaggattttcgcattgatgtttatcagggatattggcctgaaattttctttttttgttgtgtctctgccaggttttggtatcaggatgacgctggcctcataaaatgagttagggaggagtccctctttttctgttgtttggaatagtttcagaaggaatggtaccgctcctctttg

SEQ ID NO: 122685 - DNA, 1030 bp, Homo sapiens
gtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattgcaacaagggaga

SEQ ID NO: 122686 - DNA, 1015 bp, Homo sapiens
aaatgaagacactgaaatacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaagtgtgtagtgtactgattatttagcagcttaactttaggtggccataataacatttagacctttcttcctatgtgaaaaaggacctggcactagaaagtaactgcctgttttctgtaatgataattaaattgcttaggagattgttaccctttggttgtctgtaagtgaccccagaagtaggatctcaaaggtaaagaggcattcttcccctaaagagtcttcagtatatggatcagtttagtttggagaatattaatatattttcagtggatattctacatctactatgtcttccagctattttttctggttgccagttttgatgcttgtcttcttccacagatacttcagatagtataaaaatttcccttactaaaaaagaatgtacttttactgataaaatactccaactcatgttagttaccaagctttagtatattttattccataattcttgtgaagtggtc

SEQ ID NO: 122687 - DNA, 1607 bp, Homo sapiens
tttttaaggagatatctctgagtcataccagtctcttaattctgagaagggaggggcgggggagggggttgggggagtggaaatcaggtgaggagttccatatacatcttgaacaatcttatgtaatagtgacatctcatttatccagaggtcacattcagttcctcttctgtctaataacatggcagacatgcataaagtgcttcagagattatgcaaaataactatttcagaggcctgtatactttactccattaaaggaaataacagatttttaccttcacactagcagtgtggaaagaaagggagcagattagatgcagcaatgatatatctgaaatcacaaactgtatacaaagcacgcttctgaattaatgaagcttcatagcttggtggctgataattcaacccccttgcccctttttaataattttccctgaaattttaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagac

SEQ ID NO: 122688 - DNA, 1052 bp, Homo sapiens
gcaagttttcttcaattatttttgttatactgatgccttttccagcaattgtttctcaatttgcaggggtatagagagttaaaaataacttttgtttgctctgaaaaacatctttttaatatattctaacattttaatttggctttatattacagaaacaaattgcaacccaagtctactaagcataattggctacaatacaacaagcactgtcccaaaggaagggcagtcagtccagtggtggcatgctcaaggaattataggactaattctctttttgttgtgtgtattttattccaggtaggaaaaactatggaatttttttctttaaacaagaagtctagctgtttatttatgaatcatttcttttaaaaatgttcttttttttctctcctcctaaactctctttcatacagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatttatatttcatgaaaactctggatgtgtgaattctgatggcattttatgattctcttgtgaaaccatgatgtgatatgaagtactttttatcctctgatatatttcaaaatgtacagctaaatgaatagtgagatcagcatgagaaatgcagtctttacttccttgctttaacagtaacacaaacattgaaatagttccaaatcttggagagattaaaataaaaattttcatgaaactaatactttttacaaaaatccatgttgatagtggatctaacattttttttttcaattctgtaaagatagtgaagtaaaggatacatccttttttctcttttgtttgaactgtcattaaaagctctgaaaatttttaaatttaagtatgaattcattaatgtaga

SEQ ID NO: 122689 - DNA, 1338 bp, Homo sapiens
aatgacttacccttgcataatatgtatcttttaagattttagttcatgaggaaaagcatcattgttgtgagggcttaacattaataatgaaaataattttcttaatgcccttgtttacaactgagtgataatggttctttaaaaaccttaagtaatattcctcttatagttatttttctttattttgaaaataatggctaacatgtaaacatagtttgtaaactctaatatagatattagtattaaatcctattagtttcttactaacttgccatccttgcaaatacataatagctatgtgtaaaaactagaattcttcagcaataaaggtcagaattaattttctttcctgcttttatagcctttataatgctgacaatgttagttgcttaaaatatattttttgacaaaatgacagattgtttataaaacaggtcccatttctaattgctaataatttctgataaaaagctaattatccaattatatttctttcacagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagtatgccctttaaagcattagtttttatgaagcttatacctttttaagttttcaaaaatctagaatgatgtcagactatttacctgtgttgctatatatatatatatatatttttttttttttttttttgtaggaatcacaaccaagatctggtttgttacagtcttcagtaattacagtctacacaatgtatttgacatggtcagctatgaccaatgaaccaggtgtgttttatttatattacatgttcctaaaggttctgcagttgttgtttttccagaaattgtctttttgtgagattaaattacttaaaaattaggcttctagaggaataaagtacaaagttttgatctttgatgtattatttatttcacttagtttcttccatcactaacaaaattataagaaggttacatgtatacctaagagaaactgtgagttcagtttcagagcaccacaatgaaacaagcatcacagtaaagcatgattttttggtttcccagtgcatataaaacttttgtttatcttacactagtctgttgtgtgccatagcattatgtctagaaaaacaatgtacattccttaatttgaaagtactttatttccaaaaaatgctaacagtcatctgagccttcatcaagttgtaatctttttgctggtaggaggtc

SEQ ID NO: 122690 - DNA, 1184 bp, Homo sapiens
gaagtagaacattcacataaagtgtagctatttgttaagatgcagttaaatgatttcatatatgaaattatttgatgaatgtctattaataaaaaattatatttctttttgttttagattttggttctttaaatttgctgcagcaattgcaattattattggggcattcttcattccagaaggaacttttacaactggtaagaaatcctttttaagttgtttgacattgatattttataaaggaatctgaaataattgtcacctggaactataattgtttgtctttttgtttgggggtgtgtgtgtgtgtgtttccccagttggcaaaatcaagatgttcatataaaattttattttcctttttgtgtactgtgattttgaaaggaaatgataaaaatcaaactaaccaatcacttatgtatgctttctttccctttcagtgtggttttatgtaggcatggcaggtgccttttgtttcatcctcatacaactagtcttacttattgattttgcacattcatggaatgaatcgtgggttgaaaaaatggaagaagggaactcgagatgttggtatgcaggtaagctttcgtcgcagaacaacttcagtatagttgaactttgaagtcgagaatagatatgtagactaggtaaatcacttaggatttttatggtctactttcctatgatgaggtttttaatttaaactttgtgagtgtcaaaatatcacattgtatcagcaacttggtgagcagatcttttagcagattaactgggaacataacccaagaaccaggaaagaatccaaaagaacctgaatagctaaaataaatgttccaaagcatattactgaaagcatgtgcactttatagcctaattttctagcctacaatgggttaaaagcaaaatattaaagggaagaggattgctaggaatagataaacacacagtgatacaattcataaacagcagcaaataaaaaatataaaaagcaactcggatgttttattcaagtgcaaaggatgcttttatgtgcatcaataacaactaaaggaattcctatagtaatgtaattaatgattatttataatgatgatgttgagtcctttggggttatacttgaaaacagatatcccaattcaaatgcttacagggccaaaccaggtaacaaaaatgagggaacagga

SEQ ID NO: 122691 - DNA, 1607 bp, Homo sapiens
ataagggcattaatcccatcctgagggctctaccctcatgatttaattaccacataaaggccctatctcccactatcctcccattgagggttagagtttcagcatttaattttgggtagacacaaacacgaagtccataataatatacagcagtaagtagaaaacatgaaggaatttaaaagagaaatcagagctagagactgccttgaggatagaaattgaatgttgaaaccatggcagcgtatgctgaagatcattcagagtgagcagagctagaactctgccaaaatctcttacttaagggagttagtggagaaaggaaaacctgattctgatcctagaaaactgggagggaagggataacagaaaagaacaaagaaaatgtataggttctaggaagaaagttttaagaatgacagggatagtgtctatataaaaatgagattaaggaatgtgattaagcagtagcctttgggtttggaaaccagtacatgactagtatcctggaaaagcagtttttttagagtgctgggactggaaagagtgggaggaaataatttattcttatatatatgaataatagatgtattaatagttctgaacagtagtctcagaaatagcacttacactactaaaacaagtctatcgtgctattcaagtagaatgcaagtttttaaaatgtaggataaatctataactcaaaataagcaaccagcatagagttggtattgtagtttatgatttgcgcagatggggatttaactcttttttccccactgtatgtgattaaaatgtatcagactcatcttgagtacatattcatcataaattgtaaagcaaatgccagttttctaaacctttacttaaactatttgattacatgtaatttttatttttacttaatgaaaaaaaatgatggatcataaactcttttgtttttctagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatgggtaagtttttaaataagcttcaatataaaagcttgggtagcctcttcttgataattgccagtttatccaaggaaactttaaggtaaaataaacttatacaatttgcagaattactttattcatgaatgacaggataagaaaatcttgtttttactggagaatgtcagactttggatattaaataatagctgtgataacctctgatccacagtgttttatattttcatactaaaaaagaggctctattatatttgtgactactaagggaatagctatttctccttctactgttaactttaggtggaccagtccacttacatagaactctcagttccctagacccagagagcagatttttctaggttggttgtattggacaacccagaaagaaacttcagggtttcttttatcaatcttccttcatatagagcactacttctggtacccttatttgactgttttaatatctgctgttgcttatctagttatatgt

SEQ ID NO: 122692 - DNA, 2529 bp, Homo sapiens
gctgatttttctccagtattaattgccttctgatatctttacccaatgcctcatggattacaaagtttttcacctctgggtggtaaaattctcagaccctccctgcagtgaacattctccctaggcagaaataagggccacttggctgggcgcggtgggccacacctgtaatcccagcactttgggaggccgaggtaggcggatcacctgaggtcaggagaccagcctggccaacatggtgaaaccctgtctactaaaactacaaaaaaatacaaaaattagccgggtgtggtggtgcacgcctgcaatcccagctactcaggaggctgaggcaggaaaatcccttgaacccggagtgggtgggggaaggttgcagtgagctgagatcgcaccactgcactccagcctgggtgacagaaggagactgtgtaaatcaatcaattaatcaataaaataagggccagtcatagggctcacattgtctcctcttagaaattgctggctttacattgcctgttgttcattgtctgaaaaacttattttttccattgtttaagtcaggaggataagtctggtcatggtttctccatcttgacctgaatttatagtaattatcccaagccttttttcatcagtaattttatgtttacctatgtctgttttgtttcttgatagttactagttaagtccgttttttcccttctcatttctttagccctttgatttccactttccattgtgttctgttcttacttcatttttgaggtctccttttttaacaaaaaatattttttatttttctgtagctcaaatgaaatactggtaggggatttccttttcttactggattatatttatttcagactgaattcttcatatgccttatattttcttcattcctttttctgaggggagatgtttatgtttaacttttgctaaagtatatttacatagttgccatgacatgtatttccgttttgtggacgtttaatataaagcagctttattcttaccttatattggttggtgtagtggtctggcttctacaacattcccttactgtgatatctaagactcttttcccctagagctgtaattctagggctggaagatctggttcatccaccttctagaagtctgacatctcagcccaggttatgatattatgagaatatttactctgtggctttcttagatactgttaaatactctgtaccagtgttcctctctcctagacaggaagatattctgttcccttgggggcatactgctagtttagtgtggtggttactggagaaaagctagccccagttgtattattatcctttttgcctcactctagttgtagttttcattattatcactatcgccaggtcaaaagaaggaaaatatatcaattcacttttttttccctccctggatgtatttgagaatcctcggaattttttgtattcatcagtctagtatctgggggctaaaggtcaggggctggaggtgggcttagcagctgtgctactcatgaatattccatttcttttcctctttaaactttggttactgctgatgattttttcccctttttgttttagctgatttgtccgttttacttggcatagagtccaaggattttttttgtctttactccttcttagaagttgctaagttttgtggtatatagataatttatatgaaccaaataccgtatgtcccttgatgtaattacttttagtcttttttcttttttaacagatagaatgtcaattttcattgtatcattttaagatatagtgatttactgattcttaataatattttcaataatattctttttcccagataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataaggttagtctcgtttcttatttattgattaactgaggctatagggtatatatgtatatgtataaaattgattcggggatattgtaaacagaataatatagaataagacagtatgtaatcctagttgtagttcataatcttttaggaaaaagataatatacattagtttgttaagttctatgatggtggtacaggaaatgtactgtggtaatacacagaaagaagtataattctaaccaggtgtcagaatctcaatgggtcatggaaaaaaggatgttctaagaatgattagaacttgcatatacagagattgaaaaatagaaagcataatgagtataaaagagcttttcaagcaaagtatctatactttaggaagattaatcttacaattaataaagtataaaagtcaagcagttaaatatggaggctgttgcagtggtataatcaagaagagaatagcggacctgaaataagattttctggatgtaaaattgactgagcctagcactgaaatattggcagtgatatggaatc

SEQ ID NO: 122693 - DNA, 2059 bp, Homo sapiens
ttccgggcagcgggctgcaggaatacgttgcaaacgcaagagcaaaacaggatgcaaacgtgggaaaaatgggaaataagtggagttaggacggacaaagactgagaaagaggaagcaatcccctaaaaagcagagaggttcctcagatgaaggagggcaaaacgtcaaccaccacctcagctctgttctctactaatgcccaaatgcaagtgcatggtaggtaaaggtgggttttgctcacaccgttttcttaatttggcaaactacggtcagatccacattagccgttaagtttccagccagcagtccttgagaaattctccaggaaagaagacagccgtgtcgtctagtgacgcgcatgcgcagtctcagcgctgcgcgctccgtgttttatcctacccaggcctggaaggaagtgacgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctgggtaaggtgctttttgcggcctctggggtgctagtgtgagagaccaaagagaaggcgatccgagccggggctgggtgagcccggcgggaatgtggtgccccacccaacagggagtgccctctctgtccccgttttcttcccgtctcctctcgtcactcagactcagcttcagagctttgggtcttgcgaagaactgatcactggccgtaaggtttagtggcgatgggaagatgactcaaattgaggaagagaactagaatagggcccctcccccacccctgcttcgtgaacgctgtctcccattctttgaggtcccttttcgtggttttgtttgtatctgcgcaggccatctctacaaaggtctttgcccctttccttcggtggggtacccactctgttgtcatctctttcctggcgacctcagactgccgcactgtcgttcctggattcatgtcgccctctttgttcagtggcgcagattatgattaaaaagtgcctgtcgtcatttggaaccgcctggcagtaatgctaatgtagtaatattgtttttgaaacaaatagtcatagctctgccgtaactgtttgaagtgtcaatttcagatttcaacttaaaattgaaatttcagatgacacacgcatgccttgtgcctaatgacaattttgtctttaggcacaaaacatgcgtgtgtcatctgaaatttcatgcttaattagctgtacattgcattttcattaaagagttgttagagtaaaactattttcagtatagtggcaagactttggtccgtgtggcacaaatttcagtttatttaagataatctctgccccctccaaaatagtaggcaaaacattggcagtgcagttaataaagatatttgtaattttaggcgaggtatttggactcaaatcacttttctttagtctggaatttgttaattctgtttctaacaattgcttttctgacttcccaaatgattccgttatatatactcttaaaggttttgatatgtcttgaactaaaaatgttgaattttaatcaaataataatgtggggattgttactccagccagtctgttcttttgattatatggtatttcttcttgcacggaagcctggaatattttatctcaagatattagagagtttaattattgacttttatacaaaagaggcatatttagtgtgataaacagttttgaaaactgataattgattatcatataagattgttttcatcggttttttattggaagatgttatgcaattcaatttgtaatgtcgtatcttgtccagttatgaagtgggcgtgctgtagttttttgtatataatagagatttaaaagatgagatacatgttttcccttttacaaaatagatcgccacctttattgattagaagaatgtccgtgataaaattgaccctgccttttagtttctgtgttaatagcgaagtacattaaaaaggtagaagc

SEQ ID NO: 122694 - DNA, 1048 bp, Homo sapiens
aagaagtcatactgataaagtttagagaaacgtgagttcacaaaaatatttgaaaagcacttggaaaaacaagctaccgctggcaaaatttagcagaacaacaaaatgaagaatcagattcacaaagtggcatatatttgaatgtttaaagacaatacaaaataagggtttaaaatatttatcagaatataagaggatagcttcagggccttgaccagtctcctttccatagataccaagataggaaatattgctttagagagtagtgggtttttttgtttttgtttttgtttctcaagtccttttattattcatttttaacaacagcccagggatagggaaccaggggaagtggaaaggggagaagggagcccctacaacccctcccaactcaccccttcccctattatgtatttataatctatatgtaagccccaggggtgagaggaaaagggaactccctcactggagtggggtaacccatagagtgaagttatatttaggctttgagtgacattcattctatgcttctgtgcctgaggtctttgcaagagtaaatggtacagtttgggtgtgattttttctctcttggtgtgcttatagcgataaactaacagtaaaactattttacttttacagctggtattagtgtagtttcttataaattcatattttttgggggaagaaagagtaacgcacttaagtggacattaactcataaaatattcaaccctattacacaatactaaataattttccattttctgaactataatttcatgataaaactctggatttgaaccgtttattccaggtataaataaacaataaaatacaaaaatgtgttttaaaattatctttcttctgtttctgacttcttcaagctcaataaatattaaacattaagagttgtcacttgcaaagaatgaaacattttaaatgaccagcttaattttaaaaaatactttataatttataaaacagaagctcattttcattagaaaaattttattagttcagattcacacaagtttaagtataaataaga

SEQ ID NO: 122695 - DNA, 1041 bp, Homo sapiens
ttttctactttggaaaatctgcttaattgtttttctttttgtattgtacaagcaacatgatgtatggtgcttaggcatccccttcttctattttctctgggatcctcccccttgctgctgacactgcttcttttgtggcatacacatttaggggaggcctccatgacaacatggcaagaggttttattttttgttttattttacataatttattataattggaaggttctcggaatgaccctggaaagatgctgatggtatctattcttccagtttacttctacaaattgaaataacactttagggacaaaatgttatatatatacatacatatacaagtgtgtgttatattttcattccataacaatggatatgcatatatccatttgaacatccctactccaaaaattcaaaatcccaaattctccaaaatccagaactttttggttactgacatgatgccacaagtggaaatttttttttttaattttgacaaatcttatttaattcagatagcagtctgatcacacatggtccaacaacattcaaataataaatcaaatataatcagatgttaaatactggtcttcaaacatcatagccaatgatgccacgcttgcctatgatctctccgacataaaaccacataacacctcagtggccaccaaaccattcagcacagcttccttaactgtgagttgtttgaagctaccagtctgagcactattgactatttttttcagactctgaatagctctagggatctcagcaggggtgggaggaaccagctcaaacttggcgtagtaccaaaatgtggccaatcaaggctttgagtaagtcacagcagcgttcaccagcaccagggtcttttccacaaggttacggaaaaattgggccaatggttctgggatggaaagtctgtcgccctgaatgccacaagtggaaaattctacacttgacctcatgtgatggctcacagtcaaaaggcagtcaaaactttgtttcatgtaattaaaacataaggaaattttgtgtttagag

SEQ ID NO: 122696 - DNA, 1049 bp, Homo sapiens
tcccttcagtgaaaggaagagttgcatcctctgtcgctgagcatgcctgctgacactgaaaatgtacactgactggtgtatgtgtcctacacctgccactaatctaaagaatctgtctcctgtctcatgtgatttttcatcttttggaaggaagtggaaaatattcagatgtgtcagttggtggactttttgagctcatgtgctacttaatagagaagaaataatattctttttatctacattattatagaaaaatgcaggcaatgacacttctctgtcctccttcagaactgttttctcagactgaaagatataagaaattataaaaggctcttgtgcaaggtagtttcaattaagttcaaagttaaatatatttcatgggacttaaaatgctaccagagctatgaatcataagaagctgcttgttaaaacattggtgtatttttagttctgtgaatggtgactttcaatgcatctggttagtttaaatcatctctggagccatcgtacaagacatttacagttaccaagagggcttatggatcatagagatttccagataggcttccgagtcttggtatcttagaatgtaaattaatatttttaattattttttctctcattttattgtgatttttttccctgtaattctaggttgacaatcactccaatttttttaggcaaatagaaagacaaactactacctgaagattcataatgctaagaaactcatacagagttagccattcagagggaatggagttttgttacttactttggccagttatagagatgttattccactttttatcaggtagctgaaaattttaaagaattacaactttttattcattgaccacaatttttgtttaaaaatgttttcttttcatcctaaaagtacattgtaggatcatgcaaatcaatgactgtgtataacagaactgaaaaattttattcaaggaaaaaactaatattctgtatgtcagattggaactttgttaattgagctatagtgaaatggaacctggaaattttatatttatataaat

SEQ ID NO: 122697 - DNA, 1067 bp, Homo sapiens
cctggcactgaattttcagaaacgtttcgtcagtcctagggagccaaaaagggattaactttgttaaatttatggagcacagatattttattgctataatgagaatgtctggttttaatcgacccatttgtaaaggggcttttcttctgaaaagtgtctttcaatgtttaataaaattcccaagagcccaatatgtgctcttaggcactgcaaagcctggaaggtaatagttccacaacctttggtaaaactgaagccagttatctagtggaaaatgtttctcttagttgctcttctgtctttatacacgttagctgtcctgtacctgctagggctatgggtattttgcattgccaaacagaaagctgtaagttaattgactgttgaagaagctgctgccatactgtcaaaagcattctattacctcctcaaattaatcataggaacaacacatttatatggatccctccgtaatcctgcagaggtttccctgcaaccagcaatagcctgagtaatctttaggttgtataggaaagcagaatgctatctgtagctgactccagcagtgccccaccatagttcttggactgtgccctttcagtccatgcttgcgtttttgtaatcacttgggacagtctgttttctagccattggaggtgcttggctgaacaataaggttccagccctaagagctaccctcacgcaataatggatgggaattggaggataaataccccagcttcttcaatcctcatatgggaaaccgtcagacatgttctagtctacaccattaaggtccccaccgagattgagccctaggtgtccacagtagtaactggctcattcatgcgctctgaattggcttccttcccttccatgcctcatctccctgctttcataccactgcttcctgggatcacctctgaaataaaccactcaaatccttgtgtcagagcctgcctcttgagaatcccaacctaaggcagtctccaggggcttttatacctcatctgacgtcattggcacagtgttctcagaagtgtgaactacaaacaatgttgagactt

SEQ ID NO: 122698 - DNA, 1044 bp, Homo sapiens
cttagaacttagcactctataaatgatattttttgacattatgaagagttttgaaatctagcaaaagagtttaaattttatgtgataagtaacgtacagccaggataaattccttattatatgttcaaagcagcatttaaggaaaagtaagtagaaaacagaggaccaattcaaatggaggaggctggggtgaggaagaccacctactaagctgtagtattcggaaatatcaggttttaagttaatgagaggctaggataatagctacaacaaatataatgattaataaaaccgaaacctgtattttctttacaaaacacttttgacataacagtacgtcctggatacaacagtatctctaatttggagacaaagaattggaaacttagtgctggcttctatcattgtggtaagagtgaaaataatggatacaaatcagatacctgaggatctttagagaagtaattgttgagatgtgttgacagatgggatagtttgacagagtggttgagagggtgctaggtcagttctcagagagggaggagtaaggaagtgacattactgttgggaggtaattgagttgggagagggaaaccagttaagtgagagtgataggaacttgttttgaattcttttgtacttgatgtgaccgtagcaaaggtgatggaaatgtacctagacagttgtagaatgtgtgtagaggtcaagcttatcaactcagtcttgggccttatcaacaagtgggaagcaagaagagggctgggactgtgtattcagaaatgccactcaggggatttgaagagaagaagaattattgaagagaaaagaagtaatttgagtagttggagaaggatcaggtagtgcatcatcaagagactcaagaagaggaaggagcaaaccagaagggtgaaacactgaagagaaattcaaggaagaggaggaagactgggaaagcatttggatttgaaattcagggagtttttgatagggtagtttcattagcattggaaaaatcaatgtgaaggacttaagaagaaataagta

SEQ ID NO: 122699 - DNA, 1017 bp, Homo sapiens
gggatcaaaaagcagaaaatagtacaataagactacatttcattatcctgggatttgtatgtattagaaagaacactttcattaattacacttgatatttttatagtttatatactatttatatatgtttcctgtagggatgttagaaaacttttcaaagtgtagtctagataggattttacagctttctgtaaaaggaaaacaaattgtttctttgaggccatcaaaattattacttttctttctatttcacaattgcttaaggttgcaaaccagtaggacttctttcctctgtgttttttaaatgcaatgtagatctgatacaaatgtccaaactcaggtacttttgaactatagcacaactgttattctatacctgcactaagcaaattgcctagtctagaaagtgtgaatagggcggtatatgtacacaaatagaagaagaaaaagaagcttaaacatcttcttttttcttttgcaccgtatctttgggaactttaacatagctctctcattggaaccaatttgtaggtatgattaactgctaacaagtacttgagatattcttaattcaattatcttggatgaggtccaaagtaaactggcctaacatctataatcagtgttacaatcgtgagatgtcagagtatagtatatgtgttttcaaggcatagtaattaaatatggagacataaggctgaaaggagtgacttgctttataacactatatattacagtccctttgaaaagtaagcagaccactgcccttatcactgcagggacaaattcagttgtgatggtaatttacacctcataactttcttttatgacatccatccatcatcaacaggaagtctgtacacagtctaaggaagtttcccagatatgacattctgggtagggctcccagtctcctgaagagagtaatgcaaccaatggtcacgggaaccacttcaccttaacagctgctgagtcggccctacataaccctcaacgtccaggatgctatggattttt

SEQ ID NO: 122700 - DNA, 1009 bp, Homo sapiens
agataaaagaaatagcaagcagtatatgcacgtggtcttcttgtcatttcaatattcttcaaacccaggcttcctgatgagggcgctaatgaagaatactgttggaattatcttttctaaaggcattttcattctattaccaccccccacgccaccgccacacacacgcacgcgcgcacacacacacacacacataacacatgtctcttatttcctctttcattcacaaatatccactctattccaggcactgtactggagatggagataaacggatgaacatgtccttatcgcacattcagtccagtactatgtaagatggctaagagcagaggaaaattgttgactaggaatacattctttatttcagaattttatgtcttggttgaaaggctaataaattctaagtgtgcttttatctcttcctaaatcagcctgtgtcatctgtcaatacatacatatccacagtagtgaacacgtgtatatttttaatgaacatgtaccaaaggaaacatattctgccatctctgaagacatttttatcacaagctgactttggggaattctgaatatatgcagtgccaatatcctgaaaggtggtggaaagggattagatcttatagcagtaatggcttcattttccttagctcatattaaatctttcagccaaacagaaaaaaaagtaacatatacaaataattgtattgctcagcaaagggatctgaaggatgctgtattttgattcatcaaaccaagtggcatgtatcccggcggatggaactttctgcttggaattagaagactagtgttctgaggcctttgggaagaaaagaagaagaaatggaagatggatgtcttattctactgcttattattatgaacttgagtatattacataacatttgaaggatttgtttccttttctttaagacgattaaaataaataccagttttgtctcatgaggatcccatttgtgagaataactcataaacagatgagaatgataca

SEQ ID NO: 122701 - DNA, 1030 bp, Homo sapiens
ctataatgtgatgatgtttgactagtttacagtcctggtgatacaccattggaagacatttggaagtgataaaataagggcagatttttgtcgtttctttatagaaacagtaacctgaaagtcatactaaattttattgagagtccatccctaggtaacattaaaataagtgttcgtctctctaattctgtcattttcgggagaaaatctagaaaatatgccaattaatcatgtagttagataattcattttattatcttcatccgtgtagaaaacaccagagtgtgaaatgtaacctgcaagttttattttttattttttcctagattgtcctctaaactggactttaagcatagttatattttacattcttggttaaatttcccctctggtttaattttcctttaatttattttgatacctgttgtatcaaaatgttatttgtactgtaatattgccagttagctggagatgaggaaaattaaataaggttaatagattaaacatacatgcatatgataatttgatgtcaattaatttgtatatctgggaacaaacaggatgaaaaatatattttcgttatcattattattactaccactgacattcttctaaaggctataatataatcaagaagttttcaatctagattccagctttgtcacttactacagttcaaattgaccattttctcaaatcctctgtttcttcatgtataaaatgggagaattgtttattaatttgttatagtggggaatgaatgccagaaaatatatgaagcatttatggggttgcctcatgctccctcatgtcactgaagttcactatctcagaggtgtcattaaaatgtccttctccagtgaccctgcagccaatcctttgcaaactcagttttttagtttttgactctatcttagttttattgctcttgcccatgttatcattttcattccagatctttatcacagcttacatggactatagtagctgcatcctgatgagccactctgtctcctcacttcatcatcca

SEQ ID NO: 122702 - DNA, 1014 bp, Homo sapiens
tttcaatgtcaaataaatcatctttccatctttggactgtaaatgtaagatttattcattgagtagatgtttattgactttattcctcctaccaagtactgttgtctgagctgaagatacagaagtgaacaaaactgagtccctattcttatgaagctaacatccttgtgtagcagacagaccataaacaaatatataacatggcaagaggatagttagagatgtggatgtgggaaggtacattttcatttagagcggtcaaggaaagtatttgtggtaaggtgacatttgagcaaatctgaattaaatgagcgagggaaccatgtagataactggagggaagaacattttgggcagagggaacaataaatgcaaagccctgaggtagaagtgagcttggctaagttaaaattttaaaatatattaagaataaaaattcaataaattgagtgtaatcactattcaagtgttctatatttgcctctaaagctaaaaagtgtgctaactgaatctcagttaacctcctagaaattaattggttatttagaacaattagcaaaaacattatatcaagctttaatcattaaaattttacacagaaatatcttggttaattatctgtgcttttgttgaggttttattgcatttttatagtcatctgtgctccaagaatatgttcacattttttctctaatccttctaattaagttaaaaccactgtccttagaaaagaccattcttttagtctaggacccttttagtaaaaaaagaagaaagtattctttagaatctcttaaaattgtcaataggtctaacacagcttctttcaatgtgagcaatacattgctactgacaaattaatatataaaaagcctattgtattatttatgaaacaagtctcttggatattttggtaattttatcctggtgcttgaatttttttcaaagagataaatattattaatagtttttggacagttgttcaatattaacaaaaagctatatctgatacta

SEQ ID NO: 122703 - DNA, 1024 bp, Homo sapiens
agttatttgtaagccacaatgatggcagaagatgacataatttgtatgtaaggattgccactcatctgcatgtgttcagtgagaagaacctaccactcatctttggttcacctcattttcttattcatatttgaagtcccctgcaatggtcacagaggaattaggatgcttttgttatctcatactggcttaaaaaatagagcagtttattacctcatgtaaaaagacatccactggtggagtagactccttggttggatgattttgcattcattatatcatcaaagattctgattttcccccctttcttccctgtcatctttggagtttcagtcttgtcctcaggctccttcctcttttagttataagactactcaagcagaaaactaggacagcacattctctatttatagtagtggaggatgaggtggaaggaaaaaaggacatctttcaagtccttaaacatctttccttttgtctgattgactccatcctggaccaaaatcagtaatggggaatactatgagccaatttgctaagtagcatcaccaccgagagctggtaatgcaattgataacaaaatgaaatgggttctttagaaaagaggaaagaagaaatgcatgttgggtaagtagccatcagtgtttatttcaatccgaggccttatgtgaaaaatagtacaaaccattttatatccattaggatggctattattaacaaaacaaaacaaaaaatacagcaaacccagaaagtatcaagtgtgggctagcatggggagaaattggaacactcatgcattgctgatgagaatatgaaagggatagttactatggaaagcagtttggcagtttctcaaacagttaaacatagaattaccatgtgatccagcaattccccttctagatatatacttataagaattgaaaacagggactcaaacaaatacctatataccaatgttcatagtaggtaaaatagctactcacaatagctaaattttgggaacagccccagttgccatcaa

SEQ ID NO: 122704 - DNA, 1048 bp, Homo sapiens
cacacacatacacacagcaacagcagcagcagcagcagcagcagctctgcttgtggttctctttgcccatagatttcattgtttttttactgccagctgactacatcctccttctttccatgtctttttgggtccctccaaattttgtattacacatggcattatttcaccattaggttactactgactggcatagtttcttgttttttcccttgatatattttgaaaacaaagaatccagctagcttagcttactctttcagatctacctataaagtacatcctatgctatgaatcagctgtccatccatctagtgctgattcttggtctacttacctagggacaggttagggtcacaggaacatgaaatgtggatgcttagacaaagaagactgtaactagggtggggagttagccagaagagatcctttgacagctctaatgcaaacgtaagtttaaaagtattatgagatagtagatgcaaatgcagtgaacagagctgtgttgtagaatatggtgtggtacaacacagattccagacttcatttataaaagacaaggccagacgcataagaaagttatgttagctataagagaacaaacagacattggactcgagaggttgatgaatcgctataacattcgttcgtctcccttatatgatatcaaatcttagaaaggcagctgttcacaatttttttgtgtgtctggtaaatcatctcaagctgctgcagattcagtatcatgcatatgacaaaattaggcaagtcaactgtgtgttacatgagtggttcatttcgcctgatgttctattacatttgcagctgcatctgcatctcagacacgtaacattaactgatgttcataatgataaccctgagtcattaaggaaatgttgtattatgtctggtacagtacacttgagaagtaaagagatgaaatggagaaagaactgagacttactgaatgcttgctgtattgcagatactgagagagatgagctacttatgttactgcccttaacaacagaatcctgtgacataggta

SEQ ID NO: 122705 - DNA, 1038 bp, Homo sapiens
gcacccccatttacccagtcataggcgtagcccttaccttgtactcactttgagtcttgctgaactcccacttattttgagctccctggaattcagtgctcacgggtcattttgtactctacatgtgaatggagtaagaaggaatggcagcagacaaaattactgataaaattattaagaatttcatgacagctacaggagagtattaagccaaacatggggctttgggagatggcacagtctgaatgcccatgaagccactactgtttgtatggatcctttaaaaaatagtctccagcctcagcctctgttaatcacagtctccagggaggggtctagacatatgtatctgaaatcaacaacaactactgcaacaacttcacaagtgattttatgagctgatataaaagtctgtaatctcttaggctagcattagaagatctttataatcaattccttaactacttgcttaattttatcacattactgtctactttgagcccttgcctatgactccatagaattatttgatgtctctggttatattttgtgttttggtccaccctgtgatgctcatgccattatcctcaatctcagtgctcattctctccttactacttatgggaattatgctatcatttctcttaaacacatatcaaagcctaagtcctctctaaaaccttcccccactactccagcccacagtgaatcctccttttcctcagtttttataggacttaggttctagccatttattttatgcacattattctgtagtgtgccattacttattcttttatgtgcatgttctttcttcctcactagactcagggtttctttagtacttggtattctgttgaggcttaaaatggccatgctaggatctaagagttatgatagttcctagaaaatcttaaggaataaataactctaaaaaataagctggcttctatttcctaatttgattggaccacagtacttttcaggaaggaatttacattcaaaatgtatttttggccagtcaccgtgacagtgctt

SEQ ID NO: 122706 - DNA, 1801 bp, Homo sapiens
tttaaaaaaatgtatcccttggcctttgcctacttttcagtttcctttttccacagtaaagttgaagtacttttctttcactgaggttttaagccagcactctttaagagggaagcaaaacagaaagagcaaaacaaagcaaagagaggctaagaggtttctcagaacaagcactggtgaaactttcctcctctgcttttatttgaaaacttggttttttttcttggaaagcttgagagtgcaccagaccagctttccttcactgacggtgaatgcgttcttccagcagttttcaatctgtgatgtttctgccagtgttttgcacaatcctggatgccctttgatcctgtgtccaattgtcctaggcctattcatctttcaaaaccctgtgtgttcaggtgccaactcttctgtgaagcgttgcctcaccctccaagtcactgcttatatactttcacagtatcttatattatcttacatgcactgaagttgtttctttcgtgtctgcttgtcttgttagactgtctggacaatgtcttagagtcccatatgtggtagcttcatgttgagtcccttgcccatcatagtgtttttaataacattggctgggacaaactgaacagggctccgtaccatgtgattcctctatgttttttggctaactcatgcttgggtctagactgaaagtgtgtacagtccctaactaaaaatgcaaacaaagacttaaaacggtatgttacataaacagtaagttggctaaaatagttgggattatttaaaagcctctgagagactgttgtttctttcatgctttatctacagagattcttaaaacaggaggaatgtctgctgctggttgtggtagtttctgtatcatcatcctcaaaacagatttcgctgccctgcgatgggattcagacatttccaaaatataagcccgcctccagggaagtcactgtgagagcagatgtgtacaaaagaacaatacaaggtagcatgggatgagatgtcaatagagtaacaattccagatagcacttcctgttaaatgctggatacacattccagaaattcaagggaggtagtcattgtggcttggggtactttacctagcagtttgatttccttatggtgggccctttccccaaagcagttttctttttctttattaaacctcataagttagttttaggaagttttagtaatggtagtagggagacagagggacatagtcaagtggtcattgcagtgtacagtacaaccactaaaaactcctctgcagtgacacagtatctgaagcttgtctgcagcatttctgattgtatgtatgtgcctgaccttcttccaaagtatttgctgggactttcaataaataataatacacattattggccgggtgcggtggctcacgcctgtaatcccagcactttgggaggctgaggcaggtggatcacctgagatcgggagttcaagaccagcctgaccaacatggtgaaaccccgtctctactaaaaatacaaaattagctgggcatggtggcgcatgcctgtaatcccagctacttggaaggctgaggcagaagaatcacttgaacccaggaggcagaggttgcagtgagccaagatcacatgattgcactccagcctgggcaacagagtgagactcctctcaaaaaaaaagaagaatatacattatttaaaataataaacagcaacaaaaagatgagtcatagataccgggcatgctttcacctcagggcttttgtacttggttttccctgttccaggaaggttccctccatg

SEQ ID NO: 122707 - DNA, 1710 bp, Homo sapiens
catctttaaaatatatctgtattcttctctactgattctatttctgctgtcatttccctctctcaggcctctaccatttctctcctggattcttacaagagcttcctacttggtcccagtgatgctctcttggctctctccaacttactctccacacatatgccagagggttctttataaaatgctggaccagtcttggcactctccttcttagcctttcaacacctgcttcttgctaatagattagaatttaaactttataacggtatctcatgtccctgtgcattctgactcctgtgtgtccgtctgagctttctttctcaactgtcccactacacctatagagatattaaatttttttcttctttgaatgctccgtgactctgaattatgagcctttacctttagtgatatgaagttctgtcttaggggaatcctctttctttccttgctgccctaactctctttgccccattcacacccattcttctagttcagcttagacattcttctgggagaatcttcttgaccccctatatctagattaagcatccttcctatattctttgataaccctctttacttaaggttatcaaactatataggaatcttctatacaattattcttgtttcactgtatttaaattgtctgtttcctgctctgtgcttccattagactacaaagcttgatgcatgtaaagacattattaatctgttttttactaatttcctaacactttgtgtgttatatatactctataagtagagtggatgtttaagtttattccacaaataattaatacagtaggagctaatatcgtcaatatgtaaactatttgaatagataggcaaagtgatatttttaaatgaaaatttcagtatttcattttcttgtttaaaaacctgtaagacctcctcattgcttcacatagagatcccagctcataacactgtggataagatttggcctctgcatcctcttcagtcccttcttctatcactccagctctcctccttcaagccatagagtgttcttctcatggttaatttcgcttcactgactcagtcttccttatatcaccacctgagttagtcctgctgttaaggttcttagagtccttttcactctgccaccactgtatttacctctttttattaattatatggtatgtgataatttgatgtttattaccttggttctcccccattattctttgagctactttcataactagcacctggcacaaagcccagaagagaataggtgctcaataaatatttgttaaagcctgaatgaatgattgaaaataaattataatatgtttgctataaaaagtaaggtaactatttgaatcggaacttttgacatcttattccacaattcatttatttagattggtgcaaaagtaatggcagaaaccccaatgacttgcatcaatccagtgaactactgtggcctgagtctttatgctagcatcccatctatcactgaggtgtgtcttctttaattacaatacctgttctggttactgtctcctgtttaacagattcttccagaacctaggaacataaaaaaaaagaacgattttattttgatgatgacattgtgggtcaggaatttgggaaggcctcagccagtcagttcactttcggggtttctcatttggttgtagtcagatgtcaggtcactcacttggctggcagctgatg

SEQ ID NO: 122708 - DNA, 1761 bp, Homo sapiens
tgtgagccaatgtatctggcctcaggtgtagcttaaatcaaccagaatagataacccttgggtttacctttcttttgttcttagtttttattatatcaccttttgactcatggaggcttttccttcgagatgaagggaaagcttagaaggaatgctaagcaggaaaaccctgaaaggatagtaattttttcctgatactttgctcgtttttttgtttgttctcaagatttgttaaaacaaactgttcatacatgcttttctctttaaaatcactagtatatctacaaactaaaaacttggaatcagaattttccatcctacttaaaaatcatccaaatgaagagcttcagagggagttattaactctttttaaaaataatataaaacattaacactttctgactagttgccagattaacatcagggaaagtacaaatgtactagctgaatttcagccacaacctttgcatacttgacagatgagacaccaaagtaagtataatgatttagaaagcacaagcaacagtgcatacttgtgcatctctttgcctgtatgaggtgtcttttcagttacaataattgttaaaacaaagtattaaaataaattgaacatggacctttgaagcttaggatcactaaatgctgaacaaagattataaaataatgaagccagttctaaaacaatgctttcacaattactggtgtcagcaaaatgttttatatcattaattcatgtattaaaattaagatgctgaaaaaatcatgggagcatttagattgctctgttctaatatgcttttggcttattacaatctaaatggatttgacagagctctgttggtttgcttagggtggtaaggaggtcaaggtcaagcaggcagtctcctcacagcctcattaacaacatgctgacctgtggccataaattacccttaaccgtgcacagtcatatcataaagtgtctgcttctggtcataagactgtgactgagacaagatggaggaattactgttaatctcatcacctcttctgaaaaaacaaattgaagcacatgttcaggttattagggagttgcagagattttacatagagaaatcttttcttccactggctaagactttccttctttttactgtggtcaaaccttggtagatctgttctctagtatacagttggtttaagaaaatcaaaagggaggagagctggcgtattcttattctgttaaagataaaatgatacaaacattaaaaaaatactgagcacaaaatatttgcttagcaccatgctaatcattatgataaagataaacaatgtgtccctatagaatagtccatggtccagcttcttagaaactttagagctttagtaggttaaaataaagctctccaggcaaatatggggccatgtatatgaataaattgtgttacaggattccttctgtgctgcttcaccagtcagaaatctctttggccactgctgcctctgcctggacctcgctcagggacttctgggcttgctccacctgcttagcccggcaggctgcattccgcttgtgccccagaccagatcctgtgcccaccgtggctctgcgctcagcccatggatcaaccaggcatgctgtgagcggcttccaccttgggtgccagcaactagatgaggggaatgcggtggtgcctgataactcagagatgccagcagtcgtggagccccaaggggggttacagttctcgcttgtggagtcccaaggtctgagtccccaag

SEQ ID NO: 122709 - DNA, 1933 bp, Homo sapiens
tttaaggacacataaagccacaatatattgttcagagaaatgtgtatagtatagtaaaaaaaacataaatcagatttatgaatgtctagctctgggaaggaagagagaggtagcaaggaattatattctttatctctaaggttgtactttttatataaaaaaccaggaagcagaatgataaaatattaacatttattaataaaggggtgttgtgaacatggttatgttacattaatcaactttttggtatttctttgatttttggcaaataagtgctgcaaagatctgaatgtttgtttcctcccaaaattcatgtgttgaaactcagccatcaatgcaatagtgttaagagatgaggcgggcctttgggaggtgatataggtcatgaaagctaatttctttcattgccttttaaaatgaattctagatatgtcacaaaggtagaaatgatcttctccattagaggagtataattcagattgcattcctcaattacccttccaagtataaataatgcatttgttttctctgccaggctggcattagtcttgatttgtaacttttcctatttacaaagccaaagattgctatttctataaatgccttaccttcttttgtgaccttgttttttggtgattgtcaggttgacccttttcctcccacatcaagaaagttttgtggttagaagaaagggagggcaaccatcaggcaacagacttcctttgatgtcatattcaagtactgatcttaagctgtcctttgggtttttacaaagatactctaatgcatggcttccatctgatcccttcctccagctgtcttcagcctttgctttaatgtattttgattattgtatgccctatctttatgttagtaatcatgcttaatcatttcaaatagactttttaaaagttgaattaaaccaataattggtgcaatagctttctttttgtgtttattcaaaagaattttataaggttatctcttccctgtcttatgtgaaaggctggcagacattttctgtaaaaggccagacagtacatattttaggttttgtaggccaagaggcaaaatgaagaatattatgtaggtacttgtaatacaagagaaaagacaaatttccacatattttattgagaaaattgaaaatataatagtattagtaataataaagtatcttgaaatttgtaatatagatttactaatgtaaataatagaattatttcttttgagataatgttttgcttgcctggggttgaacattaatgtttcctgtcatcagtgttaattgtaaatattcatctgtcgtactgatctgtgttgaaatgttacatatttcatatttaaaacatcttttcacacatacaggttttgccgaatatagatattagtctactagcatgtatgcacattcataatttggacgttttttatacgattctttagattcatctcttgatatttgccttttagaatttcattacagtgcagaatacttccaattgaaaattaggtggaagctcctcagttgcacagtcaaatggattttttaaaaattccttattgaaatatgtttcacatatcgtatagttcacatatttaaagtgtataattattattttgtatattcacaggatatgagaccagtatcactacctaattttgaaactttttttattccccctaagagaaatcccatacccattattcatcattccctgccctcaccccaggcctcctatccccatcctaagaaaccatgaatctagtttctgtttctatagaattgcttttcctggacattttatataaacagaatcatgcaatatgtggtcttttgtaactgacaaatggattttgaaataaggaaatttcaaggtccaaaaaatgctgttggaatgttgaaatcataaattgagctcagaaaatgtgt

SEQ ID NO: 122710 - DNA, 1007 bp, Homo sapiens
caccccagaacaattgtcttccaaatttttgagcctcaccaggtgactaatccacagtagagaatctttgcagtaaatgaagcagaaaaccagtgaggctgtggcagtagttttcatccttgtcattacagcaaaatggcaggatgaagtggtttcaaaggctgtttggagtcatctccatttaaggtaagtttctggtcatgttccctttcttgagagcagcagttacattattcattttgtagctttgaggggaccatggtttagcaggtagtttcctctgctgttgcagttataagctacagtattgtaggttagtcaaagcttcttcatgagtcgttgttctttgaaactgcttggctctcatagttaatttatttactgtttttatgcaggccattctctatcaggtataactgttagaaaaaaatcctatttttctcttctataaaaagcattatttttgaggttacaaaaattgtataactaaagtactgccctacagtggtgttgaaggctaactgaacattaatagaatacttttatttcatgctatatatccttagattatttttaagttattttcattgcaattgtatgttattgtataagatcaggaaattactagttttagaaggactcgtaattccataaattaggatattcaatttttttctaatatatgtttggacttagatacatagaaactgagactatactaatttttaaaattgcagtaattaaaacatgtacaaaattgaattagagtgggaataactgagtaacttttaaatgtgttgtttttatgaaatgggtaaaggagttataatttaagtcacaattatggcaatagtgaaatgttttacgtctcatttcatctgaaatcaccaaaatcatgttgtgatgagcataatgtatcacaatacacatgtattgagagtgaaatatgtaaaaattgacaaatagaagattctatatttgtgtaattttgagcgagcccatggtat

SEQ ID NO: 122711 - DNA, 1039 bp, Homo sapiens
ttctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaa

SEQ ID NO: 122712 - DNA, 1045 bp, Homo sapiens
gctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagataaaaaatactttttttcagttctgtgctatattctgtcactctattccattattaatactaaatgactttccttgtgaaatgatacccacatactacaacatcaagctcctttttctcttaaatttcctaattatcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagcc

SEQ ID NO: 122713 - DNA, 1330 bp, Homo sapiens
ttttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatt

SEQ ID NO: 122714 - DNA, 1001 bp, Homo sapiens
tgcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtgagtggtcgccgatcgccccgagagtcaggtcctggggcgcgcataaaggctcttttcctgcaccacctaacttcgctctcggacagaacagattggtgccgtgttgcacatccagaactccactcccacccgcgcctttggtataatgcctgctgcccaaactcaggatttgctgtgggtctggggatcaataaagtgacaggggatccgtaagtggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctcccgtggcgcgcggggcccccggccgcccagctccctgctcccggggctgcctgctggaggagcctgcggtggctt

SEQ ID NO: 122715 - DNA, 1035 bp, Homo sapiens
ggagcaacgcccagaagggatggcttgcggagttcagcctttaaggcaatcaaagccaccattcttttacacagtaggaaactctgtgttggctcttagtatagataaaatctcattaaaaagaaaaaaaaaaaggttcatgacctgatgcgctcgccctctaggggcagaacgccctgaatgagagtgggttggcgattgcgtgggcctggagtcgcccaacaggtttgctgccaggattacaattgtctgaacagcacgaaccttactcgtttgttccatcctcctaagtcctgcccgtaaagctgccgcttcccatattttttcctctattatgtagataggaaatgataattcaaccaagggtgagggcagttggtcaaattcaaaagcagaggtcaggttggaggccttcacgccagaactgaagctggtgggagcagcaccggagctttccaacctgacttgcatattagaattatttagagagtcttcattactggccttggccaaccccatcccagtcaaactggaatctttggaacctgaacatgggtatatttgaaagcttatattagtgaggatggagaagaactatagcagataggaaacattcatacaacttctgaagacatccgaaactacagactggtaaccactggtgtcactggtttgctttattgctttgctttacttccaagatttacttaacaaatatttcagtgctttcctttgccaagcactgtgctaagaagagcaaagacagacttggtatctgcttcataaaatttacagtagaggaagagacaaatattaatttgatagctatttgaaaaataacatgtaaaatcactgccatgctgatgctaagaaagggcctcatagtgcagcgagagcctgaaaaactataaccctagtatgcaataatcagaagagcagattgtttattgtgtccctgtctctgttcttcgtgctttgcatgtattgatggactcatttcctgtgcgcagcagtcccatgaggtagttcatattc

SEQ ID NO: 122716 - DNA, 1241 bp, Homo sapiens
aattttatcaccagctcaaacaaaagtctgttcagatatgttattccacttggtgttcatccatattcagtcatctcaggactttaaaataaataaaagtcacaggctctgcatgcttctttccagaaagtagaatctgtattctttagatgctggctgaaagggctaatttcaatgagtaccccaaaaaagaaagcattttattgcctcatgaacattataattacttgtttacacgaatatgttttattcatttaaccatctcccaaccatactagcagaataactactttaagaaaatacctagtaaaactgttgaaaaaaatgagccatcaatggatttgtccttaagcgactctagccatctctgtgttgaattttcacggtttgaagcagcaactgcagaaaagagggcatctgcctcagtcattgatcagctggcatgctctccatgcaggcagaggttcaccattacttctgttgcgaaatgtccccaacaacaccgtaaagccagtcacttcttcaatttactgagttaagctgatcatggtggtgagtgcttatagtcccagctaatcaaggtgctgaggcagtgggaccacttgagctccagagttcaaacccaggctaagcaaaacccctgtctcttaaaaaaaagatatatatatatattttaactgtatatatatagttttgtatacatatataaaactaaaagaaaaaagtaaaacaagaaaaaatttactgagttactacacagttaagaacacataaaaggtgacctcaaaatgtggatattcacatctgtcatcctacttttcattgaatatttaagcaataaagtgtaatgatttgaaatatatgcattaaattgagaagcattgttaatgtaccagggaaggcaggagaatattttaatgaatttgaaatggctaaaaggaagctttgggtcctcaaggaaagatgaattttaagcaatttctcacagtgtgaatcgtttataagtgatgcattttgatgcagaggaagtgaagttcccagaataaaaccacaaatctccaagaatacccttagtcaccaacatattgcttctttctcaaaaggcaaaaatctagcactttgctgtagccagatcatgtaccacacatgaaaaatgcatgtatatgttacacctcatctccaaacttacctatggttatttgtatcttatacaaattacagtttccctgacatatatctaa

SEQ ID NO: 122717 - DNA, 1050 bp, Homo sapiens
gaagcctgtttaaactccttcaataggtgatgctttttaaatatatatatatgcgtacatacatatatacaaatacatgtattaagctattccttaaactatgtttgcttttttatttcctatgaggaaagtctgcagtcaagttagatattttcatttttttaagtaagtcctaaaatgctattctagatgctgatacttctcgtttaaagaatgactctgcatactcacataagtaatttctccaatctgagatgactgtggtcatacagaaggaagtcaggatgaagaacacagaagaaagcaaactaaagggcctgtcacataaagggatcctagtctagtgacaaagagcctacatgttgtcacaaagatttggattcatttcccagtgcagtcccttattagcgatgtgacctttaacttcctcaagtctcagtttgctcatctacaaaatggtggaaatggggggccctcgatggatcttgtgatgattgagtggcatgatgcagatgaattgcttatgactgtgcttgggtactattatggcaatgaaagagaaaagcgagattcatttatcaatttctcatgaaatatgcatttaatatcccctgtgctgggccctaaagtaggcactagtgaaacagacacgaaagaaccaaagtcctttcctttgtgagtttaccaccctattttcgttatagcagttaggtgtcaagtaactatttttaatgcattcttttacccaaaaatttgttgtacttttgtatgctacctaccacaaagttaaaaatagctttctggagctaaggaaagatgagtaggttgaagatagaaataaatatgtaagttgacggaatttggctatctggcctgcatgcaaatctgaagcatcaattgtacctactaaaaaagaccgaaattttgctaatgagacaataaatgttttaaatggttgctgcttttggtccttctttatttactaggatgaaagcttaaagatttgcatagcagatatacaaagcaatgttcattgtttggttacatttt

SEQ ID NO: 122718 - DNA, 1791 bp, Homo sapiens
tggatgctaaattgtatcagcacagataactctgaatatctaggacttgccagtttacattggcgtggtgcaagccatagatctttggacatattgtcttctcccagatcatcaaaggccaagattttccaggataactgggagcaagtcagtattagattctgcactgactccacgaaccaaggtgtttcagggatattaggataattttagggcaatggagtttgatttggaaagttggctttgcacagccactccccagatggccctggtctagatcaccccttcatgtcagtttttatggacaaggcttcccctcggatacctctggcattagggaggcacagatgtacttctctgcagctgtactttctagaaaccaggtaaggataatgaccaagagccacttgaaaggcaggtaggtatagatgatgagtaactgcctggggccttttaaaagctaatatttataaacatatattacttggctgggcatcatacaaaccaatttaaaccaattctgtgctttctctagggcagatgtgcaaacatcagaagcatgtagagcccagggaaagcatgcaaacactgatcaagtgcacagcgctgtgtgacttttgtcacttttcatgatgtataagcacagctgccttttttaggaatcgtgagctggagtcgtgagcaaagtgttgcaggagtagcatttttcaggagagtgaggtgctgatgagtgttaccctctctggtagtcaggagaggatcattgagggggtggtttttgagagttggtttaaggtagaaagggagggaacctgccatctggaagtgtgatgatgttccaggcattgggtacagcttcttaaagtggcctttgcttctggagtaaatgaaaaaaggggacatttagttaacttgactgagagaagctgagagagccaggctgttgagagcacttgattagctgtcagataccattctccctacagtttcttggcctcccagccctgaagaactgtcagtaaatattgccatacaggatcgattccatttaatcttttccaaaccacaactgtgcagtaggtgatggcatcatcatttcacagacgagtaaacagaggcccagggaacttaagcagcttgtgtgccaagtatttaaaaattactgtgtgtttacatatcacatatgaattcacacacacatagatggtggggattacgaatgcaaggaatgttattttttgagtcctttattccagtcacagtattataaactgtgaggacagccaaaagacaaattccccttttttgaggaatttccaatatgaccagtctttatacaataagtaggaatgaaaagaataaaagcaacattaaaaatgcatgaagaacactgaagcacccagaagatttcagtgtggccagcctgggacagggctatgcaggagaacttttgagcggtgagattggagccagtttttgtagttagaaatggagaccaggtgtggtggctcacacctataatcccagcattttgggaagccgaggtgggtggatcacttgaggtcaggagttcaagaccagcctagccaacatggcaaaaccctgtctctattaaaaatacaaaagatcagctggacatagtggtgtgtgcctgtaaacccagctacatgggaggctgaggcagaagaatggcctgaacccaggaggcggaggttgcagtgagctgagattgtgccacttcactccagcctgggtgacagagcgggactccatctcaaaaaagaaaaaaga

SEQ ID NO: 122719 - DNA, 1027 bp, Homo sapiens
taaccccagttgggcatattgactacttaattcttcataatcagtagagatcagttgtacactattctaaatacaggatttgtgtgggtcataagaacagaggtgacttatgtacaggcatttaaagtggaagtgtttgaaaatctggctcatactttgactacaaagtaaaatgatgtgtgttatatctaactggatttgggagcaaagaatttcaaaaagccagtggaaactggactctgcctgtggcctcttttacaatatacctaatttaagatgtgtataagacacatttttagatattcactaggaaaacaaaggcttttctatcctgtcatttacttaatttttttaacctaacttatttttctgaatgattaacattgatgcctttgattgtgtgggtgttgtcaaaagagagttcatcacatggggaaaggttggcaacctctctctgcttggtacttttccatgagcctcctttcactattctcattgttatttccttttcactctgaagtagttccaaatctgatactgaaggaactcgattttattttacatgaatatttgaagtaaattgagccacttgtgttttaaggtttgtttagtatgcactacacagagaagaatataaagtaaaagcaatagcaataataacttaggtttgacaaaacacataacaaaaaagggtactttgagacacagaaagtcaaattataggtaaccctaaaactcacctttccactttcctttctttactagaattctctaccaacattggggtgtcggtggtggttaggacagaaggaagtatagatatagctatctgcttctaagacatttgccatgtctttctatggctgaagacaacttcaaagtaactaaaagtgccactggaaatagtttctgtgaactatattgatcataatttgaagaatttctaccagctgtgactttgtgaatggcaggaattcttagtttgtaggactgtcaaaatatgaccccaattttgtgaccagaccca

SEQ ID NO: 122720 - DNA, 1028 bp, Homo sapiens
gagcttctatctttgcacagtcaccaacatttagtaatgtcagacttgtaaatttttgctaatctactgagcgtgaactaatttaatttgtatttccctgagcatcagtgaagtcaagcatgtttgcttcagtgaagtcaagcatgctttcctgggtttattaacatttgtgatttctgtctataaatcatctgttcaggtcttttgacccatatttctattggattatttctggttttaaagtgggtctgtaggaattctgtatatatcgggaacaaatctttttagttatatatgtgagagatatcttcttccaattagtggcttgtcttttcattttccatatagcgtctttgataaagagccattattaatcttgttcgtccgtttttcatggtttgcctttttgtgtcttaagaagtcccttcctaaccagaggttcataaacacaaacttctagattgtcttctaaaatgtttatagttttgtccctgtgaatggtttaaaggtgtccaatgtgttttttctatagagataactgttctaggacaatctattaaaaactcttctgttgtaggactttctccttagttcagctaaaaacgggtccttgtcacacgaccatgaaagattaggcttgcagacactttgaagggtgagaaaaatggaatttattgggtgaaaaggaaaaaaactcagcaaagcaagagagcttcctgttaacagatccccatctcacagatagaattcccagttaccaccccggaaaaagaaaggacagactcctaccccctaaaaccggcagaaacttccatggctcaacctgttctcccagtgctcaggccggtgggagtttctccagggacccctttgtatttgaatgtttcattttctttccctacagaggtgtaaatgccagctgactggaatcatgtcatagatgaagtttctctctgagtgtggacctgtttcctgggttccctggagaacacaggcatttgagtcagccagatgttgaggggccctac

SEQ ID NO: 122721 - DNA, 1075 bp, Homo sapiens
ctgatatgattgatgactaagataaattttcacactgggacattttctgcctgaaggtcaggcttaggtggcctggtcccagagttgctgtttctactaggacccgacctggtaaaaatagaagatacagggtagtgaggcagatttgaaaagaatgcagcatgtgcaaattcttactagctgtaatataaatgataaattaaaacatgcatttagtggaatgcactcccataaactattctagattgcatatttgtatacatccatctagtatattttttctgtgttaaataggtacatatttatccttttattccataaaggtaccacacatatacacttctggtagttttctttcttcattttctaactattttgtgagtatgttaaatatttattgcaccttcatttttaatgaatttatctcccagtgcgtagctatagcaatgcttttagataagtaaccttgcacattttcattattttcaatatttcactgttacataaaataagggtgaccatcaaggttgattttgacttgagaaccaaaagttctcactggaggcaccaggaaaaaaaaaatgtagtattgcccatagtttttcatattatatacaatattatatacaatatattatataccatattatatagaggtattactcttagtttttgcttatttaaataccagtcatagttttattttgcatttggctgatatgccttggaggatttttctttagaaatcagtttcatttttccctctattctttaaaaacttttcgagcacattttacatttcttctttaaaaaaaaaaaatctctgcgtatttattttactggattcttaaactgttacttttttattaaaaagaaaaagctttgggctgggcacagtggctcatgcctgtaatcccgtcattttgggagactgaggcaggtggatcccttgaggtcaggagttagagaccagcctgaccaacatggtgagaccctgtctccattaaaaaatatatatatatacacaaaaattagccaggcatggttgtgtgtgcctgtagtcccagctgctgag

SEQ ID NO: 122722 - DNA, 1172 bp, Homo sapiens
gaggcagaggttgcagtgagcccagatcacgccactgcactccagcctaggcaatagagtgagactctgtctcaaaaaaaaaaaaaaaaaaagaaggaaaagctttgacactgagaggcaaatatcttcctaactttacacttatagatacatctttataaattatattattaaattttatttacttcaaaaattgctggactgtccacaatattcattcactattttaacaactaggcattcacaaggacatgtgcatgaatctgagtacattgttttatcttcatttttactaatgccacaataataaaaagtaattgaaattcttcagaagcaggtgtgataaacaggtaaaccttctggattattaattacccctaattttattacaaataaaatttgtaataattttaacggcgttataacatttatctaaactaattaaataatcctttaaaataggaaaccctctataacctgttatacccaagaaaacatattttcccatgtttataaaattgattctcttcatactgtgttgaaatctttcacttgaaccctgggaactccagcatgacactgctaactagaatagtgcttctgcatctttaggagatcttacaaacacctctgaagcttgtttagaatacatattcttaggttgcacctctcagaggttgtgctcagtaagtctgaggtggagtctaggaatctgcatttataacaagcttccagataatttggcttcagagggtcagtttatgaggaagacagacatagcttagctcacctgtatctggggttttcactaataaaatggagataagaataacaatgtcactggactgttataaaagtagcagaagaaagtctgacatgtattatgcactcaaaaaattgcagttttttatctttaagtgaccagctcagttacaagatggccccacatggtagaaattagggagagtacattaacaggagcccactgtatttcataaaggccctgctcattgtttttcccaatagtgaagaatgaagactgtgtttcacatatgcaatatgttggcattcatattcaaacactaattgggtacaatgtcaaggttgtattgactgcctttcctcccgtttcaatgtggctttgtctagtatagtggatggcctattttcca

SEQ ID NO: 122723 - DNA, 1910 bp, Homo sapiens
aaatctcttaaaattctcaggaatgtttgtgtttgtaccagatgttcttgacagtcatctagtacaaatcaatcatcttgacaatcaaaccagaatggatgcagaagtccctatggcctatgagaactgtgtttgcctggcatgtgcttccttgaaagtcttatgttaacttcttgctttcctctggccagtttctctaccatggaatgattagcttctacctgcctggctctatttcctggatactgccttttgctccttactgttttcctgagcagaagggagtagagacctaagttgggcctggagaagatgcccatgggctactgggctcacctgggagaaaccagacattctcagatttcctggcaaaaggaggctgcagaaagtaaaataatatgcaaccacggatccaccatctacttttcatttatacccttgaaagctgactatacccattatacccaacaaaaacaaatgtcatcttggttagatgggcagggaatatttcagatatttggaattgctgttttagaactacgaatagggagtttttcatgtacttatgtgtgctctcttcttttttcttttttcccctttaatctgcttttgctctgaagttactccattcgccattccataagtatgcctgctatgaggtaatgtgtgtaaaatattttatgtaatattaatatgaaatgtgtttaaggtgttattttatttatatttacttatggggttcctctgctttatgtgaaaggaaattgctgatggtcttcaaaagaaaaggctgacaattctgtggaagaattgcgtagcttgggcttttgaccagacatcctggcttaaatctagtctttcctgtgtgatccaagacaagtgacttaacctcaattcttttatccatatattgcaagaaataagacctacttcatatggtgtttgtgaggcataaacaaaggaacctacataaagcatttagcacagtgtctgaacatgccaagcaatcttgcaaaggtaaacttgggtttcttatttccgcagaattaaatgctagcctgggggcaagtttaaatgcaaggctaaagttctagagaggatatcattaggatttttaaggtggatattaaggtgagatgtttgttaaataataaaatgtcagtataattactgaccagataaaaactggtgagaaagacattcttaacttcaagtttgcatggcatagtgatgcaatcagataaaattaaactaatagcaagacaggaatgagtgttaaattgaaaatcagaaaatgcaggctctagcccagctctgccaaggattaactttgcactcttgggaaaatcacctcaatggtatcagcttcatcatatttaaaataagaggctagaaccagattagctgcttgtcaaagatgcccctccacccaccgagccctaaggctgcctagagatgaagcctttgggatcttcccccacttcagtcagagctatgcctcttctacctgctttatattgatgttgttgtttgaaggcattatagaaggagtttagttactttcaatagtttgagaccgccgaagccaaattcttcatatatataatcttttcctctgttttttaactgtcatgaagagaaattcttcctagggtcatttgcagtgctaaaaaagtttgtacatctgattaaatcttattaaagttgtacatctgattaaatctgattaaagagcttctccctgttctccagcatgtattctagtataatttaattagataaatgtctgttctattatattttatgaaggaaggctcttctacactggggttatgtggttaattggttgatttggaaattcaccctcagtatttagttctctgtatttggtggtaaacagagagtacaga

SEQ ID NO: 122724 - DNA, 1008 bp, Homo sapiens
tcgcttgaacctgggaggcagaggttgcagtgagtcaagatcagttcactgtattccagcctgggtgacagaacgagactatcaaaaaaaagaaaaaaaaagccattaggctgcaaaggttctatttggtaagagaacaagtaggtatatctatttgagaggaaaaataacgcatgctaataacctccattttgattgggcattaggtaggtaatgggtatgtttcatcttaaaataatgaaagcattaactttccaaaacaccacttcatgtaagttgtcaaaatgattatttttttaaggcatggaaaagaaaaaatatatgaacatttttttccttgcactatttctgaattgtctcacatttgctgaaataaataactttaaaaaatgccaagtggcaaaactcaaacatgacattcatcatatggattttccattgcttactaaaaaacctgagtcaggaagaggagtgttgtgatagaaacaataaatgctaaatgaaaacttaagctacccattgctccactggctcattggaaatgatttacagtgtaccatggaattattacagttgtgtcattgccaaataccatattatttactgtattgtgtactgatcattttacctagaaaaattccatgtcaggttatggtttctgaacctaacctaacagaagtgacatacattttaaaacgtggttggtgcaggtggcaagctgacaggtagctctgtggcagaggccgtgtttacagatatgagcagaaaaccaaacagcatggttgctaagacagctaggcctttggagctgacctctctctttttgttattttaggaattctcctactttcaaatcatttgaggagagggttgagacaactgtcacaagcctcaaggtacagatgaagtgaattctgtgtgagtgggtccattgactcaggacagcttagccattgctgcggttagtttaaagtcgaggcagggccaagaaggcaggcttgcatcaag

SEQ ID NO: 122725 - DNA, 1032 bp, Homo sapiens
tctcctgcctgagcctcctgagtagctgggattacaggtgtgtgccaccacacccagctaatttttgtatttttagtagagatggggtttcaccatgttgctaggctggtctcgaactcctgacctcaggtgatccgccacctcggcctcccaaagtgctggtatgacaggcgtgagccaccgcacctggcctattagccttttaaagtgagatttcagagataaaccatttaagaaaaaaaattaatgctaacaatttcccctatactcacatgtattttattgaatatgaactaacagttttgatcagaactgttgtaggctggcagaatataactactttagaaaatactacattaaaatactctgtgagggtggagaaaaaatatatatattatataactttggaagagtatagagaaggaacttgtagtaaatataattctgtgtaattattcgacatttcttgcctgatcagatgtgtacgcctagccctggttcatgatatggcagaatgcatcgttggggacatagcaccagcagataacatccccaaagaagaaaaacataggcgagaagaggtcagtgttgactattgactgtgcaaaaaaccaccagaaaaacctcttgctgaagcaaagctaagtttatgagacctgttacagttagggagaataccgccttgatagtcttagtagtgtcttaggaaggggaaggtcaggggaagatatttttagagattcagggcctgggctggagaatattaagatggatctgacaagttaggcaactagctgggattgcacagtttaggatataatagatttagattggtaaacatgtgaaggaaggtcgtaatgagttttgaagaataaactgttagtgttgacccagttttagggggtttacagccttatcttccagaagcagggatttcctggaataagcagcagattggattttgcttgttgtgttagtctgttcttttgtagcttttataaagaaatacccgaggctaggtaatttttattt

SEQ ID NO: 122726 - DNA, 1032 bp, Homo sapiens
tatttttcataaagagtactgagtgtcaagtatgtgccaagcaaggtgtctgccactgacggagcaatgcccaagcagcggacaccaaggccaagaaggcgaaggctggacagaaggtcctgagaaaaccgtgagaatatggaggagggggaggaggaataagaacaggaggaggagggggaggaggaataagaacaggaggaggaggaagaggagggggagagaggaagaggggcaggaggaagaggaagaggagaaagcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaaggtgagcgggcaccaggccgggaggccgcggccgagcgggcgggactgtggggcggcggagcttccggcctccccgctcggccggcggtctttgcccttcctgcgccgcgtccgccacgccgaattccggaaaggccccagtcctgcggatgcggccgcgcgttgccgacggtggacggaggaagcagccggcgggacaggctggccagctggggcggcccggagtctgagcctagagcctggcgccgcgaggtccgcactgcagccgcgccagttcccggagagcagccggcctggccctgcctgcactgagcttttccggggctcacgaccccagaactcgtgtgtgtgtgtgtgtgtgtgtgtgctcacgaccccagaactcgtgtgtgtgtgtgtgtgtgtgtaaagcgcggctgcttctgagcacgggtgggaagaacagaatctgtcggctcctcagattttaagtggagcttttta

SEQ ID NO: 122727 - DNA, 1041 bp, Homo sapiens
cttatttggacatagtattttctgtaacatccacatacaatatgtgtatgtgtatataaagagtatatccagtctaacacttatcactgagattaacatttctcaagccacagttacatgtaaaccatggaaatgtaggttttaaaagaagactctgctagatttcagtttcaaatctaataaagagagctatgatagtgcagaatttctcaaattgcattctttgggatataaatacatatgacatgaatagtattccatggtaataaattttggaactgtagtctaagcacatttctttactataggacttctcataccctttaaaatgcaatgcaaaacttcaattgaatttttcaagtggaagatcatcctgaaagactaggtgttcataaaccaaattcggggcatactgctatagtggaaagtgcactctagttggggtaagaagattcagattcatgccttgattctgccatttacttgaagtgtgacgttgttattttctttattccctggaggcctggcatagtgccttttcctttgtaggcatttgataaatattggttaagttgatcatagccttttaatttttaggaataattaattcaggcaaatttttactagctgtgttatgttaaacaagttatttactctctctgaagctcagttccctcatttataaaatttaggtatttaatcattggatttcaagtccttttgattattagttaatattattattagttaatattattaatattcatggtaccacatggatctttcttcaaataaaaccttatgtaaaagtccaacatgcaacacagatcaaaagtggaactgctcaactcaaccagaggtgagttcctcacgactgcaagagccatctccatcctcccccatcccagtctactctgatatttttccttgcccctgtcctcaggtgtctctgaggaattcctcaggctcctcacagcataatcagaacaatactgatagaaataacttcaaaagctgctttgaggtaagcatcttagattt

SEQ ID NO: 122728 - DNA, 1047 bp, Homo sapiens
cacttaaagttaagtgtcagcctggccaacatggtgcaaccccatctctaccaaaaatacaaaaattagctgggtgtagtggcacatgcctatagtcccaactacttgggaggctaaagcaggagaattgcttgaaccctggaggtcaaggctgcagtgagctgaaatcatgccactgcactccagcctgggtgacagagtgcacccctgagactctgcctcaaaaaaccaaaaaaatgttaagtgtgatgtttgtgctggatagaggcaaaaagacttccccaccctccaccactttcttccacagcaaagcttttagagtaaatttcaacccatatctgaggctacaaattgagagggtttctccaaattgtctaattacctgactttttcatctttggaaagatacatggttagagtaaaatcaatgatttccacttgacataaggacttctacttatgcattgagttcttattttcatatcattgtgcaaagggatatgcaactggtggtctatgtcaaggctggaattctttgaaaatacatgcaaataactggaaaaattacaacaaagtcttggacgttgtaggttaaaatcccagtgaaagactgattagtgataatttcaagcatttattgaaataatgatagctccacacataaaactaagaatatgtggcataaaatgtgctataggagaaatgaaaaggaagaataatattaatacatagttcttaagatcaagttgccgtgattctaatggggatataagatgaacatcctcaaggcaatagaagaccaagtatggtgcattgatgagaacaccagtcctggagttggtgatctcagcttggtctctgattaactgacctcaacacagctctctacccccacttgtttgcagttctcttacctgtgcaatgaggggttgagctccagattctcttctaatgctaaattgtattttctataattacaacataaaattcaacttctcaagtggtagtaacattgttagaaatgcgttatatatgtgaaataattgt

SEQ ID NO: 122729 - DNA, 1522 bp, Homo sapiens
tctgtgattcttaaatgattcaaaatgtgtgatatagatacacaatttaaactgttttctcctcggtatagaaacacatcagtttccaaatttgacagccaggggattgtgaaatgagggtttgcaagatacagtgtcttcctgctttaaaatgttatatcattttgaaaaaaaaaaagaaaaacaaggttaactgcatcaaactttatttgctttatttttacactatgacattttctgttttgatttcatcttttttccatcacatgaatttcatgagtcagtgtgaacttctttcagtctctgcttaacaatattatctgggcatgctcccaggttttctttctgacattttaatgcatctttaccatcttcacttcatattactcaaatgacttatttttacacaatatggtaggccatactttattactattgcttctccaacctacttattttcttcctagatggataaggaaataaaactttcctataaaagttaataagactgcaggaaccaacagtgggagggaacttatgaaaaaaattaatttgttatgatttattaaaacaaagccaaaattccctcctgtaataaagataattacattttacacttcttaaatttgtaacccagggtattgagcaattaatttacctggctcttccttgcacactttaagcttttcaaaaaagccctcccctttggttacagtaagctctctttaccttgttacttataagcacttatttgttcattttacaagtaggagttgagcctttaactgctcagtttaactgctattactttggctttggaatcacagtcaaataaaagctctaatctcagatttgaagaggtatttttctcttctgtgtgtcctacaaccaaatgcgcagtgcctctgggattggttgactcacttttgggtcctacctcctgatcccccagcactccgcccccacaagcaccaccagaatgcaatccaagacctggatttcctctctttatcttcctaaaggctgtattttagaaacctctattcctttcttgctaaatgccatttactattgtttttaaaatcccagcccataattttttgtttgtttaaattcaacaggatccactcaattcacttgtgctaaaatcagaattgttgattgcagaaaaaaatatacagaagtaaatttgtatgaccttgaatttcagatatagtgaatacataaagagtgattgttgtctactggtctcccctcaacagtgatacaaaatgcatttgtttctgtacatgccagagaatatgaattttctgttgctaaatttgatcagaagcttaattgagagaaatgatgtttacggggggttggctgaacaaaggccatgacgtcaacctattcccttccaatactagctgttagaccagaagtctagccagatcttcagaagctgtactttggtaccttgttttgcatccttaacacccccccatatgcccacactgagggattttattaatacagt

SEQ ID NO: 122730 - DNA, 1009 bp, Homo sapiens
gcaaaccaaagagaaaagaacccccttcagcctataatcagaaaagagccatccaaagttatacatcttttcaaatgccttctgacttaactgtggaattaccatgtggaactagcaacagaacttacttgaaagctggtttctgacaatgtagagcagagttctctggagcagcgtacttaagggcagtccaagcaagatctctggagagaaggataaaatgtcaggccaagggtgaggccaaactgatgcaatctcagttttctctaaactaaattataccaccttacataaatctcaactggtgttctgaggaagtcaaaaggaagatttaccctgatgctgtgcctgctgccacaattacatatctgaaaccctaaaaactgctttttagcctgcttcccccttccacctaggaaaaactaggaacacctagtttttcctcctgagtagttaaatagccaatgttttctttgtgtgctatcttatcatgtggtttcataatcgttgtgtgactgtgtttgataaatagtcctttgccaaacctgttttgttgacgtttcgctctttaacatcaaaatagagtttaaaataccctattttaataattttggattgaaattagtgatttgagggtcacccagtctttcctttcttataatttatcttgaaatatgcctgtgtaactctaaatagaggggtggattaatactgctactagatagagtaattctggataagacctgatgaattttttggattttctgaccctggtccaactggttttcaggtgcttcaggatagttttataacagttgttaaatctagattgaatgatttgtgaaactttttcacaaatggttttgcaaataatttatatatgcaaaattagtatatgtctatattaatttcttgatccctgacaggtcttgaaaaccaaatgaaaaactgaattactaaagcaaattatactttctgtactatttgtactgtgtacaatttatgctat

SEQ ID NO: 122731 - DNA, 1062 bp, Homo sapiens
tgtgtttgttgagaatagttgggtgtgctgcagcatcctctccagcaaaggaagccactagcaaagatgttcctgtgttttctcaagtaaacaacctgcggtgaagtggttatgtctgtgtagatctgataacaactagtaaatttcttttcctgcattcaaaattctaatttagtgcactgtttcacagtggctttagctgtatagtcatatcatatgaggaactaacgtccccctctaagagtatagaagcaccaggtaatatagtaatcagacaatgccctggaatcctagaagaagtaattgagagattagaaagaaaacacagcattttcttttctaagtgtcaggttcatgttaacttgatatttttcttcttccacttaacctccttaatacaggcatcatgcctaatttcagaattataaaatcttttagtcgaaatatggaggtcgtgtgggctaccatgctaggtttggaatatctactgcctttgacaaatagaatgttttcagcctggacttgaacttttcgagctataacaatgtctcaaggaccctcaaggctgcttatttcttgcttgaaaaactcttgttagagggaagttgtttttaaatttttggttaaattttatttcctttcagcttattctatttattccttgttacttcgaatccatacagaataaatcaaatccatctttcatatattatcattgcatgtgtttaaagacaacatcatgaaccttttccaggatgagtatcgtacctttccatccctgaaccttttccaggatgagtatcataagtttctaaatctctccacctaagatggagttttcagattctttgccatcttgatatgacctgattaatgcaaatataagaatattaggccaggcaaggtggcttacacctgtaatcccagcactttggaaggctgaggtggaaggattgtttgaggccagaagctcaagaccagcctgggcaacatagtgagaccttgtgtctacaaaaaatttttttaaattaccaggcatggtggtgagtgcctgtagtccca

SEQ ID NO: 122732 - DNA, 1050 bp, Homo sapiens
ttttggttgcttttatccccctgctagggagcccccaaatactttactctcttttaactacttaagggatgaacaaaacaagcagtaaattattttattatttgccaggcaagaggacacacacatgttcattggtaatgctacttagagattgaagtttgtaccctggataggggaaatgaagtttgcagcctggatagaggaaatgagtccataaggccacaaatgattggttttaactagtcccatttgtcatggggcagtgaagagccttcacttagggcccttaagggcctagcataccaaggatgctcaaagatcacagttttatatcagctttggctggtgggctgttcagaattcacagccagttacagtgaaactcagcaccaagcttagctcctggggaagtgctgctacaaagtggatgttctttggcaggacacaggaggaaccgctggatctctcagccaccttgttattttctgcagcctcggctgctccagatttcaggtctgtgggacatcgccacactgttgtgtcacagcatggcatggtctccagacctcctttctcccctgccatgtgttctgcccaccaaatcgtttcagtttctctctggaacttcagaatagttttctttcttgcatattatgtaagttatttttcaacttccagaaatcatgcttaatgaaacatatcttcaaaataaaacttctgctccagtttgtgttgccgcagagtgaaactattggcactagaaatttgtgaatttgaagtcataaattgtaagtgatttgcatagtttaacctcattaaagagaaaatgagaaattaagaaaaaagtggaaaccaggacagataaatttgcttattatgaagatcaaacataaaacagttgagtaggcagacagctaaaactcttggaaataatggggctggccgggcttggtggctcacacctgtaatcccaggactatgggaggctgaggtaggtgcattacttgaagtcaggagtttgagaccagcctggcctcatggtgaaaccct

SEQ ID NO: 122733 - DNA, 1054 bp, Homo sapiens
ggcaaagtgttcaagcagtggggaattgttaggtcttggggtagttatctcctcacaaaataccttacattattctttaaattagataaatgttgagtgaagtttgatttctctcattgtatgtgtgtaaagcgactttgcttgagaaattagcctaaaagtctatgtaacatggtctgattcaaggtttatatcaatttatgaaatttgacatagataacttataattagcctgcttcatctttcccggattgaagtttgtttctcattcattcattcattcattcatacatgctccacctttaaggcatcttcagaaaagtacacgtgtgtcacctgtgtataaccagccatgccttggtccagtcccaggattaagtcacattcaaagaaataagtatatcagagaaaataattgaaaataaatatttacttcacctttcagaaaacatccaagggggtaataaatgccatatatttgataaaactttaaaatcctctttctccatctctctgaccttttacatgtctctcagctacttccccaaactctttctcctttttgaaacccttcccatatccagtcagtgtatctcctcatgtccttaccttttccccttctttccttttaggtttattttcttctatttcttctctcactatatttctttttccacttctccccctaattcatttcccacacctgtgttcataagctcagaaccaggaaaaggaaacaaacccagagttcccttaggaggcagcatgaggaaggaggctgagatcatccatatgctattatattttctcatcattgcacttattaaagaaattacgatatactatttaaaaatggaaagtccagaccagggaacatataaattggcatgaaaaatgggacagtaaattgcatgctgctcttagttgtatgactgatgcagaactacttcatggtcggtgttaaaaagggactccttcccatatttcttcctcttaatgagtagagcacacgccagtccctttgataacaaagcccttcctagtccttaactct

SEQ ID NO: 122734 - DNA, 1054 bp, Homo sapiens
gaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaaggtaagctgtttttctttaatgcctttatattctgttgcataattgcctttctacaatttgcacatgtaatacccacattagtacatttatttgaaaacagtattttctcaatagagt

SEQ ID NO: 122735 - DNA, 1050 bp, Homo sapiens
gacccgttgtagtattgtttatctttgttcctagctaaagcttcagatctacatttttttcctcaatgaatacaagtatccaataaatgaagactcaatgaggaaaaaatatttggtataaatatttcattgtgtttttcagttttacattccatctcttgatctttccctcaaattgaaagacagttttaacagtttcgcagtgcctgtggacttttactttatttgttggctcttaattttgagtatggaagtagagataaccttgataatgggaaattttcaaattagtaaaatggatttgccaagcagggaaaagatggtttatgtactgaagtccacactagcacctgccaagaaagtggacatggtgttaacatctgtcacaaacgtgtttttcagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggaggtgagcacttgggcagggttagaccgtcgtagttcctaaggtacagtaagcagtctcgcattcagattccatgtaacaggctggtaagaaactagagtccctgtgcacctatgaaattacagaggaaaataactttattcctccgtttgaaaaaaaacaccaccaccagcaccaccgctatgtacacaggcacacagttcattctgaccacactagatgaatctacttatattcttactcatagctccatgccttagttcagagctcagcaaatttttttttgtaaagggcaagataataaatatatttggctttgtaggccatacagttcctgttgcaggtactcatagctgccattatagaacagaagcaaccatagtatgtaaatgaatgagcatgactgtgtttcatttcacatagttattatgtgtcacaaaatattgttattaatttttattgaatcccttaaaaaatatgaaatctttcttagcttaagtgcc

SEQ ID NO: 122736 - DNA, 1013 bp, Homo sapiens
aagggcatgtgtctagtttatgcctctttatccagcttgatctgtgtcttcaaatatatagcaggatagggactccatagtcatgtccctgaatgggaagacacctcctggccagtatccttgccaaggtaaacactgtcaaatgatcattttcttggtttagaatagcaaatatttgccagaataaggaggggcactatgtgagtgtatgatactgagtttgaataacaggcatttgttttgtgccacatgttcgtgagcaatttgtgggtgaaccttctgtttacatctcttcctttggctttgtagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcaggtgaggcctgtccctctcataaagaatattttttaataatttttcaaaattcccaacagtagagagactagtaccatatacttccatcacccagattccacagttaacaggattttgccttctgtgtcttttatctttgttttttctctgctgaaatattttgaagtaaatcccaatcattatggcatttcacccctacatatttcaggatcatctccaaaatgcaaatggatcatacttccaaatacagtcacattctaaggagcttttttctatcaccatgaagtggaaaagtataatgatatcccacagcctaaaaactggaaagttggggtggagtgagatctggatttggaaacagttgcagaaataagttccagtgccataccagtgcctttcccaggtagccaaagtagtgcccacaaaccttgcctgcattttggatgtgatggagagtcagtcaaggccatagtgtgttgtgcctgaggggcccaattgttaagaaaccacagagaatacactgtaccgttcttgattgtacttttgcctgt

SEQ ID NO: 122737 - DNA, 1034 bp, Homo sapiens
tatatatacacatatatatatatatatatatacacatatatatatatacacacatatatatatatatacatacatatatatatacacatatatatatatatatatcacacatatatatatatatatatcacacacacataaccgtataatacaaaacgtaagatacagatgcgtgtataatagtgctcccaaaggttgtgtatctttttcaaattgaatctaagatgacttgatgtacaagagctcactcattaaagggtaaagattaatctttttaaaaagaataactacataacataattcgatggtttacatcatacattcatatactcattcaaatatattcattgcaaacatttagaaactgttgggtttatataaagtgtaattcaggtacaaaagagaaaaatttccatttggaaaaattggagttaccagcatcatgaggggttagtctggcaaacctttccagcaaaagctgtagaagattcttcactccataaacctccatatggtgttgtctaattgtatactgcagatttaaaactaagcaaaggctgaaccatgcattcttaatggggcagatgacactcccaaaggggtgaaaattggttcttggtggtggtggggcaatatcttactttttcatgtatgaggcacagatatacataaacagagagtgtagctgtggtattaaaatctcatggagatgggattagaagaaaaaaaagtcttaaaaggctcattagataaaaaataatgaaaaagtaattgagtaacactggactagaatttaccttgcttggaactatactgaggaaataactcagtgccaatttaacttgaacgttgtcccctgttggaagatggttagcatccccgatctcggcgcaccaaattttagcagtatgcgtgatcaaaagggcgtctatgtatttccacctctggttgagaaacactgcttcagagccacactccatctgctgggtccacgctggcagctttttcccaacaaaaaatagatgtcttgccat

SEQ ID NO: 122738 - DNA, 1353 bp, Homo sapiens
cccctcggcctgcttaaacttttcattcttttgcccgtgtatcaagtaccggagttaggcaggtgaatatgaccggtcatctcactcccggagctcttcgtctagcggagaatagagacagctaacaaatgctcaggctggtgtttgaagtattggaatctgcggatcaagctcagtggaggggatggtggtggggattagatgatggagaagttgagaagagtgttttatttattcaagaaacgttttcagaatgcatgtagtcgaagatcggtacgctgggcatgtaacgatgatgtaagcaatctctgccctctaggagcttactgtttagagtaagggctgagcagacacataggcgtagaatgacaaaagagcgtcggtaagtgcagtgatagatgcacatggaaatatgagagcacgtggaagggaaatctaatctacctgaggggttggggatgttggcctttaagagggcttccagaggagatgacacttgaaataaaggatgaataggagttagagggccaaggagataaatcagtaaattagaattacaaggtgttcattattactggatcactagttatgtggcagagtggtaagaagagagcaagggaagtagatcgaggccagaaaatgaaaaccttgagtaccctggagcttggaagggggatttattgaaaagccttaagtaaaaaagtgaccacaaaattaaatcagtttgacaacactatggaggatggatttgaaaagaataagacttgagccagagactaggagtctgtgggaatagtcttgttaatagattaagaaggtctgacctagggcaaggagtaagaggatgggatagactgggaaaatatttaggccatacagtcattaaggctggattgattgaatatgtgggaaaggggcaccagtcaggtatgactcctggggtgtatataggtaggagtgtctccatttaaaatagagaacataggcagatgtaagatttaaattttgtttacactgaatttgatgtggttgtgtaacatcaacctgagatgaccaagaggcggtggatatatgaatatgcatagagtatggcagagtgatctggactagtgataaatatttgggagtcttcttcatatgaaaactaggagcggggaagaaattactcaaaggataaggtcaaaagagtagcgggccaagtatagatgcttggaagcattgatattaagggaaagtcggaggaggccatgaagaagatgggcaagtgccagaaggatgtgagaccgcagaaatcagaagggtaaagttttaggaagcagggacaaatggataaatgtcgaatgcagttgcttt

SEQ ID NO: 122739 - DNA, 1055 bp, Homo sapiens
ttgtaggagagtccctgtttttccacagtctcaccagcagagtatatttcaggcttttgaagttttgcttgttctgttgggtgaaaaatgatatctcaatgtagtgttaatttgtatgtctatggttacgaatgaagtatcacaattttttatattttaagggccattatgactttctttgatttgtctttttttgtcttttgcccattttttgatagcatttttggtctctttccctgatttttcaaggtcctttgtaagcttgagatacaacctcctcacactccccttatttttctgtgatgtatgctgcagtattttcccttagcttgtcatttatcttttgactttgctactaattgatttttgccatgcaaaagttttccccacactcaagttatagaggaattcatttgtgttttcttctagtgcttttgtagttttacattttttctttttagatctctggttcatttggagattattctccagtatgatgtgaagaatggatttaatttacctttttccaaatgctaaagcttttattcttaatcttgttcttggactttaaaaactttttttgtcaattgagaataattcttttagatatatacatgtagaaaatgattaatatatatacatacacatagactagaccacagagttaaaaaatatggttgccagtatgggtaatatttttttgttgagtagatgaggctagattttgaaattatcttcacagctgtcaatatatggaccatttatagtgtgttgaggggcaaggagacctgcttctgtttgctttagggcagctcctcacagtgggtagtatatttggaacgtctgactgttcatatagtacaattaatagaaaatgagaggaggatctttgcaaaggtgctgctgaaatatattttcgtaatttgtgtttgtagtttaagtatagctttaggacatcagtcaatttttggtgcttttgttttgaaacataataaccaataattgtgaatagacacaggtcttaagcacagtttgtcctctcttgggccttttgc

SEQ ID NO: 122740 - DNA, 1086 bp, Homo sapiens
aatttgtatttacagtttaaaacaggagataattacttgattggttacaggagtaactatattaaaatagttaattcttacaaaaattaaaatatgtcctaaccttttaatttctgtaagaactaatgtctcacatagtaattatgccctatttgtttgaaactctgacttcagtgggaattgagcctagtcatcagaatttattctgtttattgccagctctttgtataaacagccttatatgctcatttttaagaaaggagcaaaatgtttttgtgtagagctctaaaaataagatgaaaatgtctaaatatacattattttgaccaaaaaaaagataaaatagtgctgtttaaaataatgatgccagggtatacattaatttctctactttgttaccagtttagtgactatagcttaggggtttgttttttcagtcctgaggcttactaaatatgttacgaccaatgtcattccaggatactctgcctgcagctagtttctaagactggatgaagttaaataggaacaaacaggagtttgggacttactggttaacaggtcaaaattgtgtgatttttcaggtggcctgctgatagcatgtgctcattttggtgcatatgtgtatgggacagacatagactacaacacagttcatggcttgggtgagtagagattatagacagtattatagtcattgctgtggtgccaaatgtacctttaaacatacagttgaccctggaagaacacaagtttgaattgcacaggtccacttatactcagatttatttccatctctgccctcttgaaacatcaaggccaatccctccacttcctcttcctcctcagcctgctcaacatgaaggtgatgaggatgaagacctttatgatgatccacttccacttcatgaatagtaaatctatttttactgaataaagtaagtataacagtaggctgttagtagttaagttctgggggagtcaaaagttatatgcatatttttgactgtgtgaggagtgggcaccccaaccccatgttgctcaagggtcaactgtagttttatatggcattattttaatcttcaa

SEQ ID NO: 122741 - DNA, 1176 bp, Homo sapiens
gttatatccttttatattaacttgtcacccgtttttcccttcagcttatttttttgaggcatatatttagtatttgtttttgtattgactataattggttattataccaactggagctcacatgtcatttgcaattatggtgtcaaattttgaacagagtttcagatatcacacatttctctatgtgtaagcatttgtgtttttgtagtgcctgttttcactggcatctcctttctagcattacaagaaatttggggttctgtggaaccactgggcctgtgaacctactgagcttcaggaatgtgcatgaaaatttattttcccatgcctcatgaggtcgtgagttttttaggcagcctatctaagaatagatctgccttttctatagtatttgacagtaaatctgtaaaaagtggcaaagttcagcccttctatctcagctctctttagttctttactaacttagattttgtcaaatgtaatgtaacaaaagaaaaattatcaaggccttatggtttcagtgtgaatatactttatgaaaatttagttttttttaaattaacagtttgctttattatttgctctcccactctgtgtttacttatataaaatacattttttttttccgatcaacttgagagtaagtggtatacattgtggccttttactcctatacttcagtgtgtatttactaagaataaagatagtctcttagcaaaaatacagttatcaagttcagtaaattgataaaatactttcatctacagtttgccattcagttttgtcaactgactcagtaatagcttttatggcatatattctccctctaggacaggatctactctagagtcaggtattgcatttcgtaatgatatcttttaggcctcctttaatttgtaacacttccacagcttttctcaatgacttttatgacattgacatattttaagaagacagttgctcctctcccaagtctttatgttgtacattttcagttggatttgtgcattggtgatgttgtgttcttctcagggtgtcacatttgaaggcagcatggctgtttgcccttgatccatgatttggtgacttttgactatctgtgttacctttgttttctgtctagctccatatggtatcagagaatctacaagaagaacaggttcacagaaggagata

SEQ ID NO: 122742 - DNA, 1033 bp, Homo sapiens
tttatagtggtatggagtcatggattcctatattattcattgggttgtaatttattagtagcagtattttgttgctcaaattgtcccagatttgaccagtgggagtttgtttgagctggctcttctgtccttttgaaatatcctcagtagttttttatgtaagtccttcctttttagcatatctgactgttcactgttttgcagtttattatttaattataatcaaaatcatatgtggttgagaatttattttggagttcttttattcctttataaaaagtaatattggaggttctttaaactgaatgtatttctaaagactttaaaaagtggccactggatatttcttcaatgacttctctattttagtaattttagatgagggaagatttccaaatacatataaccaaagtgatgttttagaaagggaaaagggagacatgttttagggatttttttttttttgtcttagatgttttatcaatggatagatttcttctagttacgtgtctaacacatgtgggaagacaatggtggcatttatttccctgagtttttggcccctggagagggttattttcagatcccctgatgttcattattagacctcaattgtgtcttctctctttaagcctaaagcgatcttattaattattaatagtgaactaaatttgtcttgagtttatgctagaaacatgaactgttttcatattcaaggtctttactcttttgaaaattctttactgttttgaaaataacacagtatcaagatgaatttgagtctaaagtcatctgtaaaagtttgaaataatattcatttgaattaaacagtttagaatagtttaactatgttatattgaaaatgtagctttatattggaccgggaataaaaaggaattcaatttacaattgtaccttagtgtagcttaattttaagtcttttgtatttttggtgtggtgaatgtaggctattagttctattaatgaattaatttactctcagccaaaccctgttatatgattcaagttacac

SEQ ID NO: 122743 - DNA, 1015 bp, Homo sapiens
agtgagtcccctcccttgctgttctttcacattctgttccatagctgtttctcccacctctgttacctatttctttggccaagattgatgctaacaacctgtcagatgccagattctgaactcctgctattgactcctgctttctagacattgtcatcatcttcatccatgtaggacatgtgctgtacagtagcagtctccaccactcattggcatattttcattttgtttcctggttcatatgaccagaagactgatgtaatctgtagtgtttattttagttgtagtttatttgaataattttacaaataactttagttctgtatttacaaacgtaatagagatgtttttaaattagacgtttaaattttaacaagacgttattaaaattttacgggcacttcattttagaggggaaagtatatgctgtagtggattatacacttcgggaatttataaaaatctacagatgaatcagtccttcatgaatgtcaagggatgttgttgagtgtatttttgtctactcttgtggaattctgtagggtggaatcatcttgtacttttgtggtttaaatgtttggcattcttcaacaaaatgtacttacaatatttctctctctcttattctacaggtaaaaaatttaactgcatttttgggatatgataaaattaagctactttgcttatagatagtttatggatcatgtggacagttagcatatgtggggaaaaagagcatgtagtggaagaacatcccacactacactggacgatccccatgattctttgtggcccacacatgtgagtgttcctaacagtcagctgttctttcttcagatacactgaagagatggtgccttggcacccttgcctggaactcgttagcaactgcgagcagaagctttccagtcacacatcaaggcgcttgatcacaatggaaaaggtgaagaaatttgaggtaaattgcttcagtatttttgggataaattctgaaagaatcaaaagtagttgtttc

SEQ ID NO: 122744 - DNA, 2009 bp, Homo sapiens
tggtgacagcatcactggttttcacttatcatagaataaatttcataagccatttgtattcaagcgtttgcaatgaagctgctgttttgtataaactactgtcactttgagactataaatgacttaaggttaatactagggaggtagaagaaatcattatatcattatcaggaactgtcagtgagtaaaaggacagcttaaacctgacctacaattaaaatagaagccatttggttttctgctgaatgactatagagctctgcaacttcatcctctagaaagtggaaatatcttatttttaaagaatagtgattttataaattgatgaccattgttagatattttcactgaagtttcaggaattctattaaattaactcttggcaatgaagggacaccaggagagaattttgacttgatcattatattgatagggagcggtgcaggagatgagactttacagtgaagcgagtaggagccagtttgtagtagaggatgggcatggtggttggggcaaggaggttgaggaaattcatatctgataactgctgtttgctctgtaaagaaggatgcaagtttttttgtttttgtttttgctgagtaaataagcagatactaaatgtaagaattgaggacaggtgaacttttagaaaaggtactatgagaaataggaaaaaaagccatttgcttaacaatttttacattcatatacttttcctatttttgtatactttatttctcttacttaattacctgttccttgagaggaaggccatagttttcatcacgcaacatgtgtttatgggaccattcgtgtcaggtgttggggctgaacagactaaggcttcttatccttagaaaacttgcacatcaggagaaatggccactcaaaccatattccaacatagcatcttgtgttctgtagtgatctgtgagaggtgttgtgtgaacataggaaagcacctacctaaggagatggtgcttgaggcaaaagagatggggaatttggttggaaagccaaaaatttaagcaagatacagaagcatgagaggcattgtggtatatgtggggaaccctggacttcagtgtagctggaaatactgagcagtgggggaggatcagctggagatgacctggaagactaaagagagggaagcccagtgttgagggaccttacctactgaacagtttcaagtttatcctgttggtaaaagggcaagcccatagggatgtttggagagtggcagaagctctgtgttctgtgaaggtcctcctagcttcactgtgttagtgaatttgagctgtggaaagttagctgtgatactactgagggggctcctggaatagtcaggcaaagatggtgaggctataaaccaaggaagctagaatagagattgtaggggacttgttggaattgagaattttgcggggaggtagatatggcaggactcggtgactaattggataattggggtgagggagatgagctaagggtgatgtttcagaaatctggcttgggacaactgagcggatgattgttttcttgtatatgtttttattccccatccctactcccaggaccatggggcagtactgctttcttaggctgctgtaataatcttctactgatttctctgcttctgcagtttctccctccattccatgccctacatggtggccagagtatctttcagaatataaatagataaggaaactcctctgcttaaatctcatcaatggctttctgcggaatttagaataaaattcagaatcctttacataacctttatgtcagcctgatctacttctggcctgtccagtctcatcttgtgccaccttcccttttgcttaccagttgttatccaccctggccgtagtctttcaggtcccagaatggatttacctccttttagtctcagagtcttctcacacgcactgtgtttcctcttcctagaatgttttcttcccctcttttcatatgagtaaatttaattcatcctttaggtctca

SEQ ID NO: 122745 - DNA, 1130 bp, Homo sapiens
caccttccctttatttaagaaggaggtgataaaagagaatagcaaatactgggagaaggcagtaattaggaggatcgttttatctaagtggaattctcaatgaagaatctttcgtatgttggaagtctgagcagtttatgatggtcagtttgagaaactttttttatatatgtattctcacagtataatccagagggtcatgagttgtgtttaaagcagcagtttcaaatgtgactacagaacatacagcttgatttattttcttgagaatgaattccccattagattaaaatttattataagtggctgaaatcgctttagcatctttttgggttctttttaatgctgtatttttgatatatagttgtaaacatagattgacttgaataaggtcacgtttatatacctttctttcttgttctagagagtagtttggaattttaggtcggacactgagacagtgttacacgttagaatcgctgaggtgaatatgtagttgtctatttctccatcattatttaaaaatgaaatggtgtgaataaatgctaacattccctgaggaaaaggccagcctggtcatgttgggactgtgggactctcgatgtttacagcaatccgggactcacaaacagctatcaaaacggtgctcctggcagatgcatggtctgctgtgctgtaagctatttcagttcacatcaggaagtactctaaagaaggattgctatgctccagccagcagagggtagtgtacacatgaaagttaactaccaatttgtaagccttcctttggtttctttggcaagtgtgttaaaattcctcgagtggtttatgtttagaattagcagtactgataggacaggaaattggctgggtgggacagtggttaaaggagtcctgcctaaaactttagatctgaaatatgtgctaccataatgttgctgttcagtgaggaatgtcctctaaatgtcaaactctattttgaatgacccactaatccaccatgtgggaaattaactctttagccattgttttgatgtaatttctactaaaaaaaaaagagaatcacaatgggaaaaacatgagttttgaagtctgatttaggctacaattctggcaatgctacttaccag

SEQ ID NO: 122746 - DNA, 1061 bp, Homo sapiens
actttggcagaactcgggttttatgatacgtaggtgatatcacaatgaatagtggtagacagatttagaaatgttagcgaaaccaaaagtcaaacactgggatgagcttgagttaatggggagatcaaagattgtgtttgctgaggatactcttctccttttaagtaagcactttggcctttgagatactgtgctgaaaaaaaaacaacttgcagatattcctggttgagacgcgcagggaatgtgaatagagaagagtcatgaaaaggtgatgaaaaatatgtagagttgaatatcatcgtctcagatgtaagccctggcaaactaaaccaaagataggatgaaagagaggtagagagaaaagagaaaacaaaaaatgagtttgccatttttttttagcattaaggtaataaaagttctgaatgctgcatagagtatagtatatttcgtatggtctgggtatattttaaatgtgtattgttcatagatatgtggtatttatatgtatgattatatgtgatatgtgttggaccatagacatactgagtgtttcgtgagaaatattttatgaactatggtctttccacttaagtgaaaatagtagccaaagtccttggaatgtcttactcgaagcaggacttgtgctgctagataatagactggcgcctgccagatctctggctgtgtaagggatttggagcttttgggttttccagagtttctgttataaatgatagatgttgtgttttgcaatcaggagtcatttggtcttctagaaaggggacattttagcacagaacccaaacatacacttcacactgattctgctctactacctgggaaataagaaaatagcattttctccccaggagttgcatttctaaggttaatgatctttcccaccttctccagtagcatgtatgtctttgccaccgtgtccccatagcactgaatagaacacatggtcggttaagggcttattttgcctttattctgagaggtctaaactattacagaaaagaatgtcttaagtagtgagtgttttctcaataatcgttagc

SEQ ID NO: 122747 - DNA, 1177 bp, Homo sapiens
gcaggaatttggaactgtaatatacttgggtgccataaaatttcagtagctacctatttctctttgatgaatcaggaaatctgggcatgtttaatttttgataatctgggtttttggtgtgattttaaaaatatatgtggcaaaaacagtttctgaataaacaaatgtgccaacattattttggctaaacctggattttttttattaatgctaggtatgatggaaaaatgaaggtactcattttatacaggcaaaaatatttttgcaaaaatgaaaaaatattttgaggattgttatattccagatatatttttatatttttagctaccattttgatactgaaatctggataaaaaattaggcttcatgttttccatttaagtctccatacctgtcctcaaaaatcacattaatccaggtgtaattgaatatgaatttatagaagcacatgggaaatgaaattttatgtctaattagatatttttcacagttggatgagaagccagtgtttcagtgtttcctgccaggaacctcaattttctaagccaaaatatgtttgacattaacccaggttgctattaccattagacgtcagtctgagcagtagtccttacttgtctgtgaagtctacaagtatggaaatctcttgtttagcctgtatcttcatctactatgttcacttaaagtttccacgaattgtttatttcattaactgaatatagaaatacccccagacaattttgtgtgtctgtatgacctcacacaaatgcattattttgttggttcacatgtttttcttgagtagaagcttccttgtttagtactttttatccataggcacagatgacttcagtgtgtgctgaactgggaatcagaagaaagttatagccttgactctgttacttggaaccactctctttgccctgaggcaaaaaaaaaaaaaaaagaaaaaaagaaatttgtcctctgtacagaggtcttttgtgaggctttaatgaggtaaatgaaaacactttggatatccaagcatgataaggatgtaaagtgatggtatatttctaattcaagtagtgaaggaagataaatatgcactagagagtgagattttgcttaagattttgcttaaggtaaacaactgctttggtataagctaactaaagaaataatttttacattt

SEQ ID NO: 122748 - DNA, 1062 bp, Homo sapiens
tactttactaaaacattgagatcttctctaaaacagagtggtttgagaacatagtgtctagagtgtaaagaattataatggaatggtaaacatactgtgattctatctggtcatagaatcatagagaccagcacattcctgtctatcctttggggtgaaaaactagggaacctgacccctttcccttaaaagagatctgccttacgatgttcatatgtttcactgtgtgggataagcaagttgacatttagacataactgaggccaacctggaatttggctcttatcccttcctttataagcccttgtagacagggctctttgggggatggaggtttaattgtaatggcagtcttttaagcctgggtcatggaacaaaatagggcttaatagatgaatgttaagataagtcagcttcccttatgtaactgctagccctatttcttgtgatattaagatgtgcttagtatatttttgttttaaaatttggaagttcttactaagataatcatgttgcagtcatgccaaactgaattgcctaaaaaggaacctgttttgacctctatgactttaaaaatctctcctttaatcaagcttccctggctctctcctgaggatttatcggaagaactctattttggctaacatgcagcagtgaagattagctgggcttatgtgtgaagttagtcaaattaaaagaaaaggaaaaaggctgaggagaaaattaaaattgaaaatgtaaatggtacttatgatattggagttgtgctttgatggactgccaaagtaatgtgttgtaagttggtgaagtgggtcaatatgggctgagttgttattgatgagttttaaaaatctttaagagtcccttaaaatttgtgtataaatcttggagtatctcaccacaagttggagtgacttctgcacaaagagccaaattgcctttgcatttttccatttttcttttttctttttttattttattttattattattatactttaagttttagggtacatgtgcataatgtgcaggttagttacatatgtatacatgtgccatgctg

SEQ ID NO: 122749 - DNA, 1167 bp, Homo sapiens
gaagctctttcatgatcctaagtgggttcctaaggaaacaagaagggcaggactggtgctgtgtgatgaatcagctttctggggaagacctgacccatttctgctaggggtaaatggcccagaagacttgctcctatggcgggggatgtcacctgatgcattggaacctaaggctagaccttgaagtgtaccaagttcatctctgtgtccttttttttttgcctctcaacaaggaattagacatagtcctatcctcaatgagctcatggtctggaggatggcggtggtatgaaacaaagaggtaagtagtcagttaaaatagtgtgatccgtctttccacagggcaagcccagtgtgagtctaagaggagcacctagccacttctaacagtggtagtgtattaaccatgtgtttctgatgttttgacatctggggctttgctgaccctggagagaccagaaccagccaattcctagagataaaggtttcaccttccttcaagtgtgtcttttatagaaactaaacagtccagagtccactcactctatttcctcttttatacagcttttatgctttgggtcactatttctcagacctaatcacttttgggccaggtaccaggtaacttagggacaacccctataccccagagcctgctgagattattcaaactagctaatcctatgcctgcttatcctgccttacctgttccttcctctggaaaccacaataaaggctcttgtccacattttcccctcccctctgcctcctgaacgaccctggtccttccccacatggccctgcatggcgtggtgtgtcctctcgagagcttcgaggaacaaactgtcttttcaattaaaattgtcttgtgatctgttggtctcaccatacctgaataataataaaacctacatttaaaaacacgtgagagaggactggatcaaggaagaagcctgagagatgacatctaagttaacccctaaagaagtggaagttgcgtgatcatgtcagggggtgagggcgggaagggggattccaggcagagagaatagcactggaaaagcatatttgggtaacagttcaactagttggtgtgccaggagctaaatgcattagccaaagaggagaaatgaagctggacaggtcatgagagccagatcctaaagg

SEQ ID NO: 122750 - DNA, 1028 bp, Homo sapiens
cctggattgaggctgtgtaagggtaagtgaggcaggagctattagatcacatttcctgactgacttgcattctgaactggaaagacagtctcacaggaaaaaattaatttgcctccaagataaaaaaaaaagtcaccacgaaagattagagacaattttgaaactgtatttaataaccatgacaatttatggcaagataaaaacgcccaaaccataaagtgcaaataccaggtcagacacagggtttctgtaggccaaaaaaaatcatgtaagttaggcccagattcattgaaaaggaaggagacagctcttaggctgcagatttatcctaaggtcaatgtttactttaaaaatctgtgataatttgttccacccagaggtggtttttgttttatgttccacatcttaatcatttgtttagcagccttgttttatgtttgtttagttagaaccttctggtgtggagcaaggatcattaaaaagtataattagctgtaattacttaatactagaacagaaactgcttttactttagatgtgtgagctgatcccccaggcagcgttggtgatcctgctttgagtctaggagcatttccattcacagctgagtccttatcagcagaagtgtatagagccaccggataatatctcactcacaaaacgtgaaccatttgcctatgaaaatgagagctaaaaaaccagagaactgaatatgaaactttttcttttattgttaggtatatagttcaacaagtctacctactaaaaagggaatatgttagctagagtagtgtaaaggagagaagataattggtcaaataatcttgttcttctatcacgtgtccactgctggagaactcctgccacgatgacgaggcagggctggagtgggagctgagtcctgcaggctgagaggcaaccacagagagccacgccttcaggcagcatgtaggataccctcttcgtgtttcactcactggtagtgacctgcttttggtacatctggagatttcaaacttcaaaacctt

SEQ ID NO: 122751 - DNA, 1031 bp, Homo sapiens
aacgacatttgtctccagatttcttttcatattgcatatttcttttcatatttcttttcatatctgtctccagatatcttttcatattgatttcttttcatattctggtctttatagaccagattacagaacctattccatcaatattaactattagaatttgctgtgaaatcaacaaggagaaatatagcatttaataatatgatcctttagggtgaataaacttccagccagaagaccctcagttgccgatctttaaaatatcatttttctatctttctcactaatgtattcagcaccacttcctacaaatatgttgtgtagttttatgtaactattggtagttatctggtgagtctataaatgatcttctcaattaattccaaaggagtttgattgcctctgtagttgacctttcttatttctccatagttgacctttattaggttatttcattcatttactagcttatttcattcatttattcattcaacatagttttattatattcttactttatggctatgcactgtactagggcctaaggattcacaactgaatggggtactgtctctctattgtgaaggtacaccagagtccagtgaaaggttgagatgtttaaacagataatcacaacatcgtagaataagggagattatagatgtgtgaactagtttaaagggaacacagaagaggacactgcaaacttgaacattgcttatacaaaagagaatttgggtcacctgtactttgcaaagaaacatccattatgccaaaagaattggccatcactaaaagctataaaacctgtttctgccattctaatcaagtagttaatgtgaaaaaattcttgaagacatgggttatttaaagagaacttcaaacttttgtaaatttgtaggaggttttgattaaaacttagtttaaggaatgaaagctggctagtgaaaaaggccttttggcatttgttaccaattaatttaaaacatcttagattttaaaagttggatttggaagtcaaatatttcatc

SEQ ID NO: 122752 - DNA, 1636 bp, Homo sapiens
ttgacggctgttgaagcatcggaacaattaagagatctcagaatatcccttgagcctccaaaccctctgcatcttaaaagctgaggctgttgctttgttctgattgttgggtggggagttctcttcctaccctccatcccgtctgaaggagtgtgggtcttccattgttgtcgctatttattttgctaaggcttctaaagaatgtaaaattgttttaagagtggagacggaaccgtcctctccacaggtaaaacctacaggactgtaagtttacacacacatcctggcaactagaatcttttctcgttaatcatattggtatatgttttaatttattttctctaagtgccattttagtgagcacttatttctcaagttttgaacattttgtttaatatttttgtaatatcgaaacagtgtagaactgaggagagaagaaagcccaaagatgatagggtacgctttgttctttgtatgattggcatttcaggtagtgggcacatcccccccacctcgtgtgtgtacttttcaaatgggatgtgaacgtataatattggcattcaatccagtatataattatagaatttggaagacttaggacattttagtcagtgaatctatatttagacttttcaaagacatggcacgtaaggacacgtggagaaaatgtcccacacagataacaggatttgtgattttggctttgctgttttatgattagcaaatattgtttgtatagagtgtctgggtgccctaaaaacacatgaaaataggtcaactaaatctcgttttaaagagaaaaccggaagagtgaacaccactctaaaaatagattttggatgtgtttgttttggtgccttgtatatcttaaagtggaggatgttgttcagcccaatctttcatttagaatttatgtctcaaatgagccagtgtatcatgtgggcagactggaaatacatttaaatattttttttcttcgctggttgttcagaacttggtagaattataattatcaggaaaactctctccaaatagctggtcttttagacaagagaagaaaaaagaaataacttcttttaaaaggagatgtcaacttacaaagtgttttgtttcagtctccaccaacctaacttgtcagaggaaaggaacagacttttttttttaaaggatccaaaacgatattttgagtcaaaagaagaaaaggatattaaatcttttgttttcacaatatcgatctttttaaagaatattattttatatgttaaccatatactaccaggaaacatctaacagcactgacagttgggaattcgaatgcgtatttttctcccgtgttagtaatagaaggtactgagccttttccattctcttggttgccttgtgcctgaggaatctgaatttgtgaaacaacatctttgtggatatagaaactaatttatgtaacacttggctacaaccacctgtgcttacttacggactatctttagttttcatggcgtgttaccttttgggttaattcaaatccaaaatgttgttaacggactgctaattaaagcatttagaacttagaattacagaattatagagtaggatgagataacaaaagactgggggttatgacttgaccaaggtcaca

SEQ ID NO: 122753 - DNA, 1248 bp, Homo sapiens
ttgaagataaaaaagactagagactaattatttacagtttagatctttaaaaccttttaatgttgtcctaaggagctttgtctttattgtgtaggctgaggacccaatattgtgcttcacatatggaagaaacctggtccattttgccttttaaatatatcagtcagtcctagctacttgggaggctgagatgggaggatcgcttgagccaagcagtttgaggttttagtgagctatgatcatgccacagcattctagcctgggaaacagactgtagagtgagtgtatgtgtgtgtgtgtgagagagtgagagagagagaatctcactcaaaggcttaataaatgagggtgatactgacacaagataatcaggctgaacaatagtccaggtgagagttatgtaggtttaaactagggcactagcaatgggtagagagtacaggatagattccaaagggattaggaataaaagttgacagaatttatggtgtggttggttggggtgggggagcagggggctgtgtggtgagagaaaggactttctctttttctccatgaacacaaagtagttaagacatgaaacctgagatgtcatattgtaagaattatgcagaaatgggggtttgtaaaatgtgtgtatatgagataaagatatgagggggccaagggttctgttaagaagtaaaaaagattgggttccagaatgggcaggaaaggaaatgagatcaggaactggataaaggaaaggagatggtcaagagatggtaggtccccatgaaattgaagagcaggtgtgggaatgagtaggctggaagaaccagagcttgtgatctgagagtcggattaagatttcagagaggcagcagtttaggtgacaactagctttaaatgtgattataatatttggttgctggagagtagattaatttcttcaaatttaggatttaaggaactgaaaattgaggatggtgtttctcagattgtatttgaaggactaaagcatgagtaccacctggggtgagattcctaggtttaaacctatgtctactggcctagaatttctaaggaaaggggctgagaatatgtatttctaacaagcaatttcagtgattctgatgaatagaagttgggacaagtttaagaacctgtgcaataggtgttggatggttcattttcaaggctatttaaataggctgatagtcatgtcaggagttaggatgaagaggatgatcagtagtgaaaagatga

SEQ ID NO: 122754 - DNA, 1040 bp, Homo sapiens
attaggcaataactctccactttccttccttcactctctggtaacttctgataccttctgcttctatgaatttgcctattcttgatatttcatgtaagtggaatcatacttttctgtatgtggcttattagtatgttttcaaggttcatctatattgtagcacatatttctttttattactgaataatgtactgttgtatttatagaccacattttgtttatccattcatctgttggtagatacttgaattgtgtccaccttttgcctaatatttccgcagtgaatattggcatacaagtgtctgagaacctcttcaattctattgctatatccctgggagtggcattgctgtgttagctttttgaggaagcaacaaattattattcacagcagctacacccttttaccttcctaccagcagttttcaaaggtcctatttttctacatcctcaccaacacttattatttttccctttaaaaaagttgtagcctccttatagatgtatcattgtgattttgatttacatttccctaattactaataatgttaaggatctttttgtgtgtttattggccatttgtgtatcttctttaagttctttactcattttttgctcactttttaattggtttgtctttgttgttgagctgcagttctttacatattctggatattaaacctttatcagatacatgatttgccaagatactctcccattctgcagtttgtctttttattttcttaacagtgtcttttgatgcacaaaaattttaaacttatataaagcccaatttatttcctatgtttctcatgcttttgatgtcatatctaggaatccattgcaaatctaaggccatgaagatttgctcctgtgttttctattaagagttttatggttttatttcttatatttaggttattgattcattctgagttaacttttatatatagtatacggtagaggtccagcttaattattttgcatgtggaaatccagttgtcccaacaacattagttagaggtgcctgttttccccca

SEQ ID NO: 122755 - DNA, 1050 bp, Homo sapiens
tacaagtccttcacctcctgggttaagttgattcctggctattttattcccttagttactttatgaatgaactgttttcttgatttcttttttggattgttgtctcctggtgtatcagaacacaactgatttttttgtgtgtcaaacttgtaacctgcaactttgctgaatttgtttattagctttcttggggattctatgagatcttctatctagagagaatagacatagttttacttcctccttacccgtctgtatgcctttatctcttttccctaatttgctctgctagaacttacagtcatgttgaatagcagtggtaaaagcatgcatcttgtctttaatttttcccacttttaagataaagttttccactgaattttttgaaaggattatacataattaactgattctcttgatcttaattactctttttttcttttgcagcacaaagaatgaaccagcagtggaagagaaaatactgtaagctggctgactgctggtgaagaaaatgctttatttttgtggcaggcatctgtgggatctgtaatagaaatgtaagtgtagcatcatggtttttttcagtgctgcagtaaattaaatggattggtttaacgtgtggtaaattgagtatctgtcatatgtagttttaattatattaaatgagcattttcttttgacttataggtgctttattaacaatttatttacattaagttatcgttaatgtagatttccaagtctcctcaaaaggaaaagtctctataagaaaaactgaagacacaggagtttgctcaaagaatgctgaaatagatctccaggtcctctgggttctaccttctttttacataataattttcttaaataactaagctaggcaagtagtactagcttttgtaaataagacagactactaggttataaaaactctagttactaaaaacttgtttcactaaattaaaggaatttctacataattgatttttttaatgtaataatacatcactgcattttattcatatcacttcactctgatccccagttttacta

SEQ ID NO: 122756 - DNA, 1553 bp, Homo sapiens
ataggtttggaattatgtatttaaaagcatggcattggtccacgtgacatgttgggtgtcttgttttcattttaccagactctgtttttatttatgttttcagtttatgatcctgtcctttgttcataaggtacttagatggtttaagatgtagacttcttatatgaagatgttgctgttgtttttccaaagtaatggtggtcatcagcccatttttctatttagtctcatgaatagaatcatgagtagaatctttcttaaattattacttgtaaatggatcactttcttgttttctttttcttaattggagctttaaataaatatggaacttggaacaaaaagattttcaggaattttatggaaactaacttttttgacctaaatcgaaagggatgaaagtttctgaaaacctaacaaaatgtgtgcacagccaattcttttaggggaggaaataggcagggaatgtgtaattggctattttaaaaacatatgccttcttttgtaacttattgttgtttcaagttacaagatctttgaaggcaagtgtttatctcaaaatatttgaaagcttttatagtgcttaacatactaagacgtcctattagggtttacttagaacaagcttatccaacttgtgggccacatgtggcccaggatggctttgaaagcggcctaacacaaattcataagctttcttaaaacattatgtgatttttttttttagcttatcagctatcattagtgttaatgcattttatgtgtggcccaagacaattctttttcttccagtgtggcccagggaaaccaaaagattagacacccctgacttagaactttccataggttaggagaaagttgtactttcttgatgtctataacctagaatttctggtaaaggaattgattggaaatgttattaaaagttgaaaataatttggaaattaaacattttagtgatcagttcttccattgagactgtgttggttcctttactagatatgtgccatctttttaaaaacttactgtgttgcttcctttactagaaaattgccatctttttgagccttgtctattgaggaaccaagaacacagaaaaggcagtaaaaagaaaaaaaaggattgtttgaagattgaatgtgctgtgatgatagcctaggattattgtttttcaatttttgatgagcgtaagcattcttgttgactatatcttttgtaactactgacccatttagaatggcagaattagctggcagagagattgtcattcattttaagctttcaatctctgacatcttcatctttatttctcagtcttttttacttatcagtggtttactccattattttctccccttttaaaatgtctttttttttttttttttaccatggggaaaaaaattagatgtttccttggcagggcacaataacacaataaggctttcatgacttaacttttgattacctttacaccttcatctcctgctcttccattgcttgtatgactatttgactcagtgtcttgcatgtgcttctgcctggaatctgctccac

SEQ ID NO: 122757 - DNA, 1103 bp, Homo sapiens
tgaatattgaagatcccctgaagaggaagaagaaaaaagatttgtcaaattggatgtatctagcttaaacactgacataaaatttataatttctgccttattgattcagataaacatttactaaacacctgccatgttccagatacaatactaagtactgatgggtctaaagataaataagacacacaactactctgttaaataaggaaacatacatgcagataattacaatatggcctgattcctgcgtaatcaaaatgtgttaacatacttactaaaataacagtaagagagagatgagaggatggacataggttagaaagtttagtgttcattcagaggggctgggcagtggagcagattccaggcagaagcacatgcaagacactgagtcaaatagtcatacaagcaatggaagagcaggagatgaaggtgtaaaggtaatcaaaagttaagtcatgaaagccttattgtgttattgtgccctgccaaggaaacatctaatttttttccccatggtaaaaaaaaaaaaaaaaagacattttaaaaggggagaaaataatggagtaaaccactgataagtaaaaaagactgagaaataaagatgaagatgtcagagattgaaagcttaaaatgaatgacaatctctctgccagctaattctgccattctaaatgggtcagtagttacaaaagatatagtcaacaagaatgcttacgctcatcaaaaattgaaaaacaataatcctaggctatcatcacagcacattcaatcttcaaacaatccttttttttctttttactgccttttctgtgttcttggttcctcaatagacaaggctcaaaaagatggcaattttctagtaaaggaagcaacacagtaagtttttaaaaagatggcacatatctagtaaaggaaccaacacagtctcaatggaagaactgatcactaaaatgtttaatttccaaattattttcaacttttaataacatttccaatcaattcctttaccagaaattctaggttatagacatcaagaaagtacaactttctcctaacctatggaaagttctaagtcaggggtgtctaatcttttggtttcc

SEQ ID NO: 122758 - DNA, 2393 bp, Homo sapiens
tgattgttacctttatgaagctttagtgattacaaagcactttttttgtccatttttacctgagctttgtaaactctgatttgcaggtaaggaaatttagactaatggtttaactgagtgcctaagagcacataattaataaaggactctaaaactcagatttttagatttcttgtctagcattcatttcactgtataatagctgccatgattcaaggtatccttttcccctcactggatgcagcttttcattatatagttcttcagtgtgtttctccagggctgatctgttaagtgcactgatggaatttttatacattcccaaggtatgtacaagtagatgcttacaaaaaattttcatcggttggagagtttttcctctactttcatcttcatatccccattgtctagtatgtggcttgcatataatgcacatcataggtggttagtgttttcataattgttaaattaagatattgcaagaattaaaacatgactttaatattatatgtattttttcttaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaa

SEQ ID NO: 122759 - DNA, 1064 bp, Homo sapiens
ataaattttgtaatcaaaaagaaaaatgcagaccaaaaaaacctcaaactataagactagacagcaaagcctatgggaacaccatgaagtgtgttacaaacattctgaaacataagttactggctgttttcatttccatttcaataactttactataaaatagttgttattcatctattttgaaatcccaaattcacatctattcatacattaaattatgtttcctgttcataatatcaaacatctcacaggtgccaaattttagtaatggtcttatgccaatccatgcagaaaaataagacacaatgcaggagtcagatgaggaccattaatgcacagataatacaaacacactggccaaaagaactacagaagtttttaaaaagtataaagtaaacagacctcaagaaaactgggttattactaaacagctctcaactattaacacccaagttccttacattaaataaatttctcaacagagacatgttagacattttaattatgagtctatccttcccataccccttcccaccccaactcccaaaatgcactactagggatgagtataatgttatgtgggcagaaatttacaggtaaccctttcaaccttgagcatggagctgaagacatttttatttaaacttcagttactgtgcactgtccatcaggccttctagatctgacactgacactcactgttccaccccctgctactgatcgatcagttcccgatcgatctgatcgatcgggtactgtctggtttgcattagaaaccaaaagtctctgttgggtcaaggagtgctgtgcaacaactgcagatacatcctcactatcactactggcatctgattcagtttcttcaatggaggtgtctggtgctggtaccctgcctgaagatggtgattcatgatcttcttctccttctcccctatgactcctttcagctgtgttgtctccactgagttgtaaatgagcaaaagagtcttccagagaagtgcttgcatcaggggatggtgttgcagggcttgttaactgaccatctactgatgttaggggcctta

SEQ ID NO: 122760 - DNA, 1064 bp, Homo sapiens
gaaggactgttcagtgagttactacttcttgatgagttaactcttaagtttcaggtcttgaacaaatgtattcaagaacattctaaaaagaaattaccaaattttactaaaataggaagtttttagtggaaaagttgcaaaaaaacagcctttttgtaatgttgattattaaagcaaggtacttctagtaaattctgtgatgaaggatggaaatataaataattgaattggaagagtgtacagctttgatgtgaagtgcatacactcagaagccagactgctgggcttgaaatcctaggatggccactagactggctacatatccacacattgtaaaatacagcaaaggcaaaagaaacatggtacaaagaggagaggaagattcatctctagatcttaggaagttacttaacatctctgtgtctcttgatagatactttgaacatatgtactccacaattcttttatagatagagtgtgtctgtatgttttaaaaaattgtgtgaaattgcctcaaacacatctacaagagaatacagtattacctacttttatttggaaatataaaagttgtatatattttgtagtctgatacataataaactctgtatactagcttttaatactattaagttggtggtattgataggtccgtaaaaataacagtagtgtttctgctagtgaagtagtataaagttgtcccctggactaaaatcccataatctctaaaatattcagagtaaaagagctatactcaacactgtataaccagcaaatactcttcttcttcgatgttggttttataaatggagagcacaagaaatattcaatttttatattgccaaataaagttagaaataatactgtattctaatacagatatggttgaagcagaagattgcaagctgatcttttttaaaaaacaggtaagacagttatccctctaagatttcttagaactgtccaatacaagtaacaagataaatatcttgaaattttaaagaaaaccattgatgttacaaaattaacatgatgttatacatttaaagtttggaatcactgat

SEQ ID NO: 122761 - DNA, 1032 bp, Homo sapiens
ctacctcttctttttaacttctttcttggacttctttttgtagactggattttctcatatagcagcatgagttttcttatatatttccatcatgtctggagttatgctgttctttacgtactgaaagaactgtttcttgttaggatcttcatctccttccattaagtagtgcatgtaatctgcaactttctggcccatgatgtacttctggtgtacttctgcattaaattctttgctttcagaatcataaccagggaatcgtttggtactgtgagggatagacaagccttcatccacagttcccttcagggcaccaaaaacttgattgccagtggtagttctggcaaggcttgcatccaaatagtaggtaaaggcacctggctgaccatcaatgctttccacattgtattcatcaccagtcttctccacttggctttcatagatcttgtccacttcaaacctattgagaagcctgcgggctagcagcaggccagtacaatatgctgcagcataatttgtcaggccaacattcacaccatattttggcagtttgtgcgcatatgctgcgcagactatcatatccccctctatacggacataagcaatctgacaaatgatacgtctttttgttacatgaactatcatcctgtatttgggtgtgttgtatttatttttatcctgtatcaccaagcattgctgagaataataatcatttttaccctctcatcgtcttctaaatttcacttggtatctcttaaagtaggccttattgttaacaactttaataaaccccatcctgcagaacagagacctctgcttcccttttaaacataagttccaactttttttttttcttttttttttgagacagagtctggctctgtcgcccaggctggagtgcagtggcgcaatctcggctcacggcaagctccgcctcccaggttcgcaccgttctcctgcctcagcttcctgagtagctgggactacaggcgcccaccaccacacctggctaattttagtagagacaggttt

SEQ ID NO: 122762 - DNA, 1077 bp, Homo sapiens
tcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtg

SEQ ID NO: 122763 - DNA, 1021 bp, Homo sapiens
taagaatatataatcaggttgcatcagaacagaaagaataattttattgcagcagaatctgtcacagtgtgtagatgtgagcatacatttgaattgtatacttacactcttattcatgaaaaaatctatttttagagtaagtggttaaagggatgattacatctcacatgcgcatttaatcatcttgtccactataattttgctgtctggtctcagaaagggaaaaaaactttggacaatacttattactttattgactgtgttagtttcttcttcttaagtagactgttgtcatctcttttcttttgagtccaattttcctatagtttgtttatgtcaatggctcgacaaaatgataaaatatatttccagaaagcacatggatttggaactctctcttgttatgtttatattaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagaggtacactttaatttgttttggatatactgtaatgtttaagtgcaggatgaaaattctgtgggctgttttgtattggaaactgtttttgatttccttattcgacctaagaggtacatttctcagtgacatttactagaacaaaaatagcataatcttatccaatggtattgtaaggattattttatatcattgcatgaaaattaagcatttgaaatgtcactctataatgtttcaacttattattttctggctagagagcttttttatcaaaagtgaggtatgtattttgcatgaattttcaaataccaggtccaggagtaaaatgcaagaaagatatacttggtgggaca

SEQ ID NO: 122764 - DNA, 1022 bp, Homo sapiens
gctggctgggcacagtggctcatgtctgtaatcccagcactttgggacgccgaggcgggtggatcacgagatcaggagttcaagaccagactggccaatatggtgacaccctgtctctactaaaaatacaaaaattagccgggcatggtggcatgcccctgtagttccagctactcaggaggctgaggcagaaggatcacttgaacctgggaggcggaggttgcagtgagctgagattgcgccactgcactccagcctgggtgacagagcaagactcccatctcaaaaataaataaataaatactcagctatatgattcttatgtcatacttgaaagatagagtatcttctctctcatttggacatagaagaaaactgaatttaaaatttgccaaagccagaaatcaacttctcagtctcctctcatatccagcattcttatttcgattttcttcccttgcacttcttggaattttgaacttcaaggcactccaccaggaatgaggagacctggattctattcttggaatggccactaagtggctttgtgaccttgagcagatgagttactctcagggcctcttccctcaactgtaaaatgagaaggttagctagatgatttcagaagttctttctggctctaaaattctgtaagtctggaaacacctgctagtgacatttatgcacgcattagttctcttttaccctttttaaaatgtttttgattgtgccttaatattattattaatatagatcttttccatttctttttagaattttcttttttgtttcttgacagcaggcagtgtttctacatttattttccattaagtgttattatgtacatttctttacatatctgttatacattgaaataagattagtatgtcataaggtatgaatgatgtaattctttctaaaacatagggcaatcatttgtgaatttcatatttgaagatttaaatgttcaaatggtttaaagaaaaactgcattacaaaacaaattgcatttttttcataag

SEQ ID NO: 122765 - DNA, 1077 bp, Homo sapiens
acaaagtgacctttttccttgccatcttttccctataacttcaagctgttcaatgggcgcccagtatccagggtgcacctatctcttaaagcgtagaacatagacttgggaagataagttgacaaagatggtgcccaaaacctcagaaagagagtccccagcatcttcccctttgatcctgttgcttgcattatttttgttatattaagctgtttctgaaagaggaacaaccaggcttcttgattcaccaagagagcaaagactcttaattattaagacaaggcgtcatcttttgtttggacctttgaagctgtgctatttaaacatcacaccaaagtaaactcaacagagcaagccttattctagaaaattcccttgtatgcacattcttggccataggaagaagtgtcttcttgttaatttggcctagatctaagaaaaaaggaattcagttggctatttttaggcataagtaactaaactcataaaacaaaggaaaattcagtcctgagcctggaatgtgttttggcctgcattctccaatcttcactttagtttgtgtgatagaatgggatatggttatttaatcagctgccaacgaagtttggagtgtcaatttggtagctcagccctaattccaaatattcgtgcagagtttgtaactgcattctgatagaactacagtccagttcatctagtagagtcatgctttgggtcagacaccataactgaatgtagaaattgaagagaaggtagtggagaatattaccagaaagtaagaaaagtcgaccatttattaaactactgggatatggtacagttaaaacacagtatgcatgaagacataactgcttaaatcctagttgtaaaccaattaggtctaatgaaagatttcattctacgtttttaattttgatctggtttttgataagtaaagtaatttcattcatattttgatgaaactcacatttcatgggtaggtcctgatattctcagcagtctacttctagaatttcagatagaaactcatacaaaatagaatgtttcatggcctggacatggcagaacacctttgta

SEQ ID NO: 122766 - DNA, 1012 bp, Homo sapiens
ttcatatttgtaaaacacttttcagcacttggctcagtgtaagtgacaaaaaagtggccgcaaatgcatatgaaccacatgctcgttgaacagattttatatttattactgcaataatgaaacaaaagaaacactgctgaaatgatcaccaaacagttgtatgcagttacaacatataataatctctgaatagtgatgccacagttattctcttttcatattccttttcctttttgcttccaggatgtaacattgttctaatctttaatttgccagagaatttaagtgatctgaagaaaatacacagtatctgcttctgtttctctctgtcattaaatctggattgcaagaaaaattatttatccaggtgtcctcttttggttgtttccttgatttacataaaaatgatctcctatccttttccctcttttcccccaaatgaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcg

SEQ ID NO: 122767 - DNA, 1015 bp, Homo sapiens
taaaaaattatagatatttaaaaaattgatagaaaatatgcggcaaagataaaatgtctttttaagataaatttcctttttcttaaatggatcattagactcaagtataaaatatgtatgcctagatattaatctcatatatagaaaaaataaattgtaatccttgagtaatctaaattggttgtcaagtttcatttggtaactgttattcaacattagtctctttcttaagttttctcactctttgtgttttgacatctttcaggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctt

SEQ ID NO: 122768 - DNA, 1013 bp, Homo sapiens
caatggactgtgatgtgatcaaccggatttttaggatatgcaatctaacaagagtaagtcactatcggatcctttgagctgatctagaataggtcagtcataaccaagatgtggtataattttattcagacaacagggagactacaattaataagcactatatcatccacctcaaagctagtaaccatcttatgccttagtactcgaataaaaatacaggaaaacagaaatgctggaagctaggtttttcggtcagtcactagactagcatattctctcaggaaatacagatgcactggctcagtcaagttggacagcctaggcctggcctctgagtgtatgtagacttatcttaaggatgactgcatgttttattagtattgacatccagcccagaaatggcatgtgataaaaaaaataagaacattgcaataacaataatgacagagaaactgtactgcaggaggaaagagacatgttggatcaaccattatagaagggttccatgtcactgttccaagttcattattgattatcctacctgcaatttcatcttcctaaacgtctcaacctatggctctaagcagatctaaaggtagaaccagtgctgctaccaccatgccttttcccagcagcaaagtagtaactgtatcgtctttctctgactcctcatttgctttccactacatgacaaattcaatgtgggtggggaagatcttaaaaaaaaaagtgctaataaagcccgggcacagtgcctcatgcctgtaattccagcactttgggaggccaaggcgggcagatcataaggtcaggagttcaagaccagcctggcaacgtggtgaaaccccatctctactaaaaatacaaaaattagctggacatggtggtggcatgcctgtagtcccagctagtggggaggctgaggcagcagaatcatttgaacccgggaggcagaagttgtagtgagctgagatcacgccactgcaccccaggctgtatagagcgagacttcg

SEQ ID NO: 122769 - DNA, 1141 bp, Homo sapiens
cggattttctgacaaatgctgattctcaaaaattaggtcacaaagatttagaagcatgaatagatggtagaagaaaataggatgattgttattatcattaaaattgcactatggttttaaagttaaagttcctttatactttaaggaatagctaatatctatgttttaaaagttagcataatgtacttggaaggctgaggcaagagaatcatccgagttgggaaagcagaggttgcagtgagccaagatggcgccactgcactccagcctgggcgacagagggagacactgtctcaaaaaaaaaaaaaaaaaaaaaggttagcataatgatgataacagaatcagataaagatagcattctctggagctctcattccctctttcatgatgtctttcttctctctcttcctctcttccccctcttcctctcttccccatgcacacacatattgcagaccaatttcattcaagaacatgaaaaaattcaaaataagatattgaaaatttggatctagtagtgaattaagaaaatatcactacatgacctattattttttccctaagaatgcaagaatatttcaactgtagtgggaaatcttaacaggatatttcattatgtcagtacattaaagtaccaaaactgtatgactttaatagattaatgcatttaattttattttcaaaatatttatagtaatactctaattagggaaattaagaggcatcctaaacatgataaaggtgattcaacaatacctagtagcagccatgttaaggaatgaagaactaacgactattcatttatcataaaaaactagtataaagattatattactgcttctacaatcatgaatgttatgtggataatcagtgtcactaatattaaacatttttggaagttttagcaaatgaaataaggcagcaagaggaataaactgtgtaactactagaaaagacaaattattttaagatgaaaggatttataccaagaaaagtatggataatatttttaaatgggatgtataaacatttatttaaatgaccaaatctgcataaatattcatgagttatagcttgtctttatattagtgataaacagaagtaagaaaatattactaaataatctttaaaaatacaaagt

SEQ ID NO: 122770 - DNA, 1022 bp, Homo sapiens
aaaggccatccaaaatacatccaatttcatgaagaatcttttaaactccatattttatctatggattacctgtataccttaaattaggagtgttaattatctctgaattttgaaagttgattttagatatatgccagaaacactgccgtggtaacaaaataagtacaaggaattagactattctgccagagctggttctttttgttcatttcatgtgtactcctgtgtaccttgcttcaaagaccactgggctctttgaagaccccgtttcctgtgttgagcaaagtttaagttcttttgcaaaatgaaatttacacccgttttaaattgctgcatatagtaattaaactagtcaacaaattcttctgttcccagattcttgaagaaggggactctattttaatttttatatggtcccttgttgtgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaattttaaaatactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgagaaagtggtttttactatttggggcttcagaacagataaacctgatttttaaaaaggaattaaattcagtctgcttattcgttttgttttcccagagcttttttgaaggacagtcagcatcttgggatgtagctaaaaaagatcaaaatagagcaaaaaaccgatatggaaacattatagcatgtaagttcccattca

SEQ ID NO: 122771 - DNA, 2209 bp, Homo sapiens
ttagatgtagaaatgatttgttgtatttttcatcattcttaggattgtggtctttagagttttgcatccaatcatttttgtatttataatgcagtttctgaaatcacttcaaatattgcttaatgctaatacttactgatttaaaagggcttagaaacttttcatactgattcgtatttttggtttttgtgttttactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtgaattctgtgtttctcactgagcctttttcaattgtaaatattctgctactccagcaggtaaaagtgagctctggggctgctccactgagccctggctaccttcttccagcttgagtgattgcattttgcctctctgacgttatctgttctctttacttctcatccttaactgtatattctgtggcagtgcccaaatcaattgcttctgaatttaatttttctggggagatgtatttattctttatgtcggtctgttgattgtaatattttaatagaagtagatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggcaaaaatgttcttgttcttttcttccttcttatgacagaaaaagaatttaaagtttcttttctttttaagctaataacacaattgggaagggacttacgcttaattgtgagtggtcagggattcagttgactttttaattcattcattggaatatttattgagttactgttatgcatcaggcactaggaatagaaagaaaaatattctgtctctgtactgggtgttcagaatttagtgaggaaaatagccaagtagataaatcattaaaatatagagcaagtgaaatgacatgtaaaaatgaataagaggtcatgggaacataaagaaggagctttgtaactcaacctggaggggccagaaaagacttccaggggaggaacccacattttgctccagaagcgcgccctgatttctctcgcagcgtggccaagagactcaaaatacatttgcaataaaaacaataacagtaataagtcaaggcggcagaggttgaatataaatgcacgtgtagtctggctagcagacagagtggcatcagggggtgatcatgtggaatgcccatgtttcccagtgcagagtgtgttgtggtaaaaagccccagagaatagggccacgagaacaagaagagcagccctttggggatgggtcacctagatcgggtatctctgagggaggttgggatatggttgggaaggagtttggtcgacttaatagaccatgaaaacacctccacttgacagctgggtcctctggtcccactctatactgctatg

SEQ ID NO: 122772 - DNA, 2594 bp, Homo sapiens
cagtaattctttttgggaattattgacataggtaaaatcattgcattaaagtagtatattgtagactcctggaaaattgcaatactaaaaagttaactcagggaaacattagtctacatgctcttaagtatctggtgtgaagtccaaaagtatacttgaattgggggttttgcaaggcatagtgaaattcatccatccatctgtcttgaaaattcctaatgttggtctatgaaggcaaggcttttaaaatatttccgctgaagtaccatttaaaagcagatgattttaataattaccccagaatcaatattactgtttattttcaaatttcatatgaatgttatattctgttctatagtgcatctgtttaagttaattaaatttaagtgaaattgcctaactttgtttcttcaaatcctcaagtaaaactgatgcttgaggcaggcaaatcaggtatatctcttgagtatactggccttgtataacttgggccttatggcatttggctcagatcgcagagatatgctcaccccggtttggaaaacatgggtataagcaaagaaacaatataagtattatctcctgtacaaactatgaacatatgtaatagtaagattgaaaacaaagtatttgtaggttgtatgcttgtatgtaaagagggaagtttttttctgaattgttcagcttggagaaatttttcagtaactattggatctaaaatgaagcccatcattttctatgtatatatgtataccaaattagtagttaaggatgctatacatgagtcattttggaatttagttataatcatgacagggcctttcagatctattttatttttatttcactatagataaatgatagagaaaaatgtaaaatactattactgttgaaagtaagttttgcggaaaataaagatgtatcatctctttaactacttaatttaatatttaatcaattaaggttttgaaagcattcatgcctcccaaacttgtctatctattgcctaccttagggccttatttgaaagtttgaattcagcagtgtaactataaatatccacttatgaacttagagaaaggattaaatctatttcccacagataactgaaaaaaattatttggaatgaatatgagataattatttctttaaataccttacacttgatagatctaaaatacatgggtttttttttctttaattttttaatgtcaagtttaatcttctggctttttaaattaaacagagttctgaaccataattatagatacacctctcttgatgtttagatataacccaagctgagagagaaaattttacatttgcagaatacagtaatctgagaaagtttaataattatatttcttaagaaagcataaatctattttaaagaaaaaagattttaaaaaacaattttagagcaatatattccttcatgagctttgttttcctgcagtgcccaatgatccacttgtaccgactgctgtgttaggtgaggccctaaatctttatcatcttttcattgcatggatcacacctccttgcatgggtttgcccacatagagattatttacagtgcaggaggcagcttgattttgaaaatagacagccatggtattatcaaagagagcaactgtgttcaacccaatatcagatctagtggatttcaaattagcaaggcatgctatttaatgtattcttcaattcttggttgttagatttggagcaaaagtacatggcccttaatgtctgactaatattaatgtgtcaaaattagtagaatgaagccaaatgcatacatctcagggtgcaatgttgcctgaataactagtttatatgtaaaagtctacctaatggaaagggatgtttctaaatcctcccaatttataaccacgaaagaacaaatttacaagtaaatattaggattatgtgcatttgctctagcttttgtctttattaagaatgttttaatgtaggtaaagttgctaaaatcttgatgtggggtttgacattctacatgaaccttacctgataagtaatgttatctttcaagaaatttagaacaagctacttgggttaccactgtataacatctaagacaatgctattactaatgacaattaacgcttttacagatgtaaaattatattaatttttaaacctacctatatatttaagaatggaatgggtttcatttttcatttcactttgtaccctgttccttgactaattatacaccaatgattagtaatcagcttgcctgtatgtttacaggttccatatcaattttaccagcgtttctagttaagctttaaccaaagaaatatggaaactatcaaataaatatatcttgtaaattcccaaatgtcatgtttgttatttatatttaacatttcttgtgaacaaaaaactttaacttatattttatgcttgtatttttgttatacatacaatcaatgttcaattgcatttttaaaatattttggaacaacacaactaactcagttatgtaaaatatacctcttatttactaaaataaatatttaaaattataattttataattactataaaggatatatattctaaaataat

SEQ ID NO: 122773 - DNA, 1011 bp, Homo sapiens
tttaactgttgcattagttcttcatttccttatgaagtctaccatgacttgtaaaacttatattaataaatttgtatttttctcttcttaatctgtcttttgtaataggggtcctagccatgaacttttaacatcttgaaaggatggttttcatcccttatacagtctgataggagaagatatttgtaatacaaatttcagtcaaagctatatactgagcatttcagagaaaaaaacaggtagagatatttcaggtatctcaaaaggtcattttagtagtaatcaaatatgtattacatttcattttctactactgaagtgacaaaaatcaagaaggctgataatacaaagtggtaagatataatttaaatggggttggcatacgctgctggtgggtatgtaaattggtaatagtttggtattatcttgtaaagctgaatatttacaatctttgttttatcaaaatgggatggataaaactcagggaccacagtttgccaactcctaaaataaagagtatttgagaaatggtgaaaggattttaatgataagagtatatgaatgaaagtgtctcagaagatgaggttgaaaatgttgattggcacctgcttgtgaaaggccgtatgtgtcataacttttgccttttcctcttgaatgtaaagcagtgaagtcatttcttcgcatttaccttttagaaaactcatccaactagtaatatgtaggataaatctgaggtagccaacatgggaagcaggaggactagtgaaaaaacaagattgggtcttgaaggcagtcgaaggtggggtggagaattcagaaccaatttcagagagaactaagcagatagaatcaactgtgtttaagaagtaagacagtgcactaacgctctattttacctaattgaatgaatttagtgggaagcttgatgaaaaattaatatgcacattaaaacatttcttcttcattactatgaaacaaaataatattttactttttttaccattatataca

SEQ ID NO: 122774 - DNA, 1131 bp, Homo sapiens
gccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgatagaataagatttgtccagatgtttacagagctcttacaaggaattattttagtctgtttctaaattattttagtgtgttcatctgggttgaaatgttatgtgcttaaaggattgagttactgtgatgacttggaatatttaagtagctttgaattgtgcgggtatgttaaatgcctgtttgggaaagaaaaataatatgagtgaacagagattaaaatttgtgaattatctgattgccctagagatgtctctatttgagtttaaaataagagattggcctggtgtggtggctcatgcctgtaatcccagcactttgggaggccaaggcaggcagattgcttgaacccaggagttcaagacaaacctggacaacatggaggcacctcacctctaccaaaaaaaaaaaaaagaaagaaagaaaacattagccaggcatagtggcatgtccctatagtcccagctactccagaggctaagctgggaggatcgcttgagcccaggtgggtgaggctgcactgagccaagatagctccattgcactctagccctggagacagagtgagaccctgtctcaaaaaaataaaataaaataagagatcgaatagttctgttttaaaatagtctaggtgagaaatgatagtttggttttttttgttttaatcatattgtttaaaagaatacttcccagcagagttttattgggaaaccacaccaaaataaggaacatgctgggggcaaattcagtggtgaacata

SEQ ID NO: 122775 - DNA, 1055 bp, Homo sapiens
aacaacaaaagataattaccatagtctgttcttacatgaaacactgagaaattttatgtagacattgaaattacttcatcagtttcttctgtgaatgattcatttcacatttcccagtcttatgtaaattactctgcagcatttatatagcattagtgtcatgcaatttgtatcattattgaacatttattttcttttcaaacaaagtgcaaagtgccagaggatgggaagtatatctttagctgcagtttgaaagaaaatgtaccaagcttggtgtcggatgacctgggttctacaaagcagtcgtgtacgtttagccaaatcacctgttcaaatctaggttgcccaaactataaatgcacttgaatgagtgatttttcaagaatgtggggcaaaatgaagtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaatgctatggttcaatcatgcaatactcagatgttcgtaaccatttccatgtgaaaagtttagtataggctgtagagaatgacattttagacttttgaggggaattatttttatgtcagcttgaaattcttcttgaacttgatttctgacttgggggaaaaaaagcaagcctgatgtgcacaagctttatacagagaatcaactgtttttaaaagaataatccagctgctatctgatcagccaggtaggagttgttctgtggaaatgaagaagccctccattttcagtcagagtcacgcatataaaggctttgataagattaaaataatccaagaatgcaatttcaagatgcacagctagaaacagcaactaagaaatatccatatcttaca

SEQ ID NO: 122776 - DNA, 1038 bp, Homo sapiens
atgatagtgtgtaataacattcagattctatatattgataacatgcaaacaaatagtacattaaatagtttctataatatcacatctatctttctcttttttttttgccccttcaagcaacaaaatgcattatttttaaccctatgcaaccatctttcttaacctttggtttcaaatttagaacacttcttttcactgattggctttatagtatgatattggtcataagtgaatttaaacttataaagttattaataaaatagttatactccatttcatatttctttttcaaaatgatttcatactaaaaagtttggaatccttgacctaagtcaatgccctcttcctatggatgagaagactgatgtttattgatgatttgattttctgaggcagtacagacagttgaaagtgtgggaacagaaatcaattccctctacttttttcaatgcaccacatttatttcacactgtccatgtagaatcatcagttaaaatgatcatatatgttcaatccctattttcatatcaacaagaataatatgagtatataattaccagaggtctatcgtaataatttctctaatgtgtttaaagaacaagccagagatttttatttgatagagtatactgatagcatcaaactgaggatgccatttgtttattagggagaattttataatttagagtttttttcaaataatatcaacagtaaagtctaaattacttattgcctttaattctaggaatgtcgcattaagtgactaatgaaacggaaataactactgcccatgtaacttcataaatgcccttcatagacatttatgtcagagcaaagatggcaaaatacttgataatgacattatctccccctcacaacctttattttaatgctgtcaatcaaaactgagccagttaacatttctagagaataatattttatcaaatagataagttatttgtaatcatgataattcttggttggggcctctgtgataggctgaataatgtccccccacaaagatgtctacatctaatc

SEQ ID NO: 122777 - DNA, 1016 bp, Homo sapiens
ttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagcgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccactgcactccagcccgggagatagtgagagactccatctcaaaaaaaaaaaaagaaaagcatatttcaggtatgttcaggtatggataaagaaaacaacagaaagattaaggaataaaaatacatgatgacgtgaggtctttgaattgtggtggtaagtagatatagcattga

SEQ ID NO: 122778 - DNA, 1039 bp, Homo sapiens
actaacctgtttcattgcaaggtaaaaacaaatatttacatctctataaaaactaaaatatttttcaaagttcttactttagatttttaagtatccctaggggggcatattttttaaagttttcttaatattaaaattctgttgtttataatccctttttatgaccccagatggatcttcataataattatagtttatgaaacaggaaacattatctgtacattgactcttttttttttcatttttactctatcaggaaactaaaacccagtgcgtacgcattgctacaaaaggtaagaggtttgctttttttgcttgttttaactactctcaccccctttctaaaatggaaggactttgttccctgcttcagggctaaatatgacatttctgttatagttagttctgtgactcatgtgggtgtctttaacaactaatggggtgctacttcccatcctctagtacttgactgaaggaatcttgttatgataacaggaaagatctagaaaaccttagaagggcttatttctgccatttagtgtctgaaaaatcttgtgctgctgatcaaccaatatcttaggaaagcgtcagcaatagcagatgaaaatagcaagttgcttgtttaaaaacctctattactttccattgtagacaatcaaacataaaaagaaccaagctaattcatgtttacataagattatagggatagagattagtccatatcttcatcagtagtgcagttagcttgaagatcatttactttttttaaaacttattctgagaaaccagatctgtgatggctagctcataaccagggcaattcctgctgacctggcatattatggcttagctgcctagtttctttgacaagagaaaacatttgcatctttgaatgaatatttagagttccaagtgggggaaagtctcctacattctctgtgtttttaattcttcatttaagagttacttgattgtgccaacaaagaataaattgctacttggtgtattctagcaagagaaacatgaaaaagctgtctgc

SEQ ID NO: 122779 - DNA, 1035 bp, Homo sapiens
ataggaaattgctgggtttatgtaattgagtccctaaggtgagcacctgggagtgatacatgatatacaattacatcagtcatattatatcttaaagagtttaattggaagacataacaatccttttgcatttctgcaggggccgtgagagctttgggtattgattggctgcttttgaatcaaagctttgttgtttgcttgcctgtatgcttggcttgtaggtagcaaagaaaaaggccacagcatcttctaagatgtgctccagagtcagaggctgctcatggttgaagatgctcttctcgtttacctttaaagaactgaggtctttagagagtagtccagtgtccactttctgcctacatatcattccataccactgttacaactgggctactataaaaacagaacacaatggaagttattagtccattctgggtataatatagcattgagtaggaagcatagttttgtgtgagggttttgatctttagagaggttccaaattaactttggttatttggtctattataccagaggagtgttaatgaatgtctgttacttataaaggattttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgtt

SEQ ID NO: 122780 - DNA, 1085 bp, Homo sapiens
tggctcacacctgtaatcctagcatttttggagaccaagatgggaggactgctcgaggccagaagtttaagaccagtctggacaagatagtgagaccctgtctccacaaaaataaaaataagtagccccaaaaaataaaacaaatcaacatggtggtgcatacctgtagtattagacactcaggagactgaggcaggaggattgcttaagcccagtatttccagattaaggtgagctatgattgagccattgatttccagctagggcaacagagcaagagcctgtctctcctcctccccccccaaaaaagtagtgtgtatacacttgctttacttatgagagaatcaattgaagtctctgttttttcatcctttctcattttgggggaataaaattatcaattatatcatggaaaatgttttgttcttgttctataaacagttgtttgctttactacagaggttactgggcttgttttgaaaatggtgaaaaagtcaatagatttagcccactatttcaaaatattttattaccaacagttcactgagctctaggtatgaatggatcaccagtataagaaaatccaagttttcaagtatttaagttgtgcttcctttcttgtctttctatcactgcttgttctagcacaaagagattcacattatattttgacactggactctgtcgttatggtaaggagctagcttatgttcattaccatttttagtcttgatgaaccaattctgagacattgatacctttttaaattgttgtcatatagcaagaaaagagtattaagtttaaaaacacatttaacatatgtaaataatgaatacaacttaaaaataaggtagataagacaactgtatcagaacaatccttgtgcaggtgtgagccattaataatgtaacaattattaataatgtatgtgggttacattgaaaatcataattaattttacatttcaaacttttgaaacttgtaaaagggcaagtatgacaagcataggactcatttagaaggctgatgaggctgttcatttgcattttgctactctaatattgttttacaagctattgttttaa

SEQ ID NO: 122781 - DNA, 1536 bp, Homo sapiens
gagataagctgtgattttcacatataagcaatagtctgtgagtagttttggggaggaatgttaaggagggctttagtgaggattcagggtgaagtggagagggtgtttacttgtgaatgtataccgctctgtgtgttgattttgcagataaaaaacacattttcaagttagtgactagtatgcattaaatatgggagagtaaaagaaggatgtatttaataggaaattcacttattttccatctgtatctgattatcttaaaataagacttgttcactgtaataccatgtgaacattaacattcaggttttaattataagttataaactaataataaaatgtatatcatatattactttttgaaatcccttttatatctgttattctaagtcatttaaaccttgaaagcttgtaatatagggattagcattcccattttaatgatggaaaaaagcatctataaaactttagtgtgaaatttatctcttcactcccttaattactcttatatggcttttattatataccacttgcttcctaattttatttttatgatcagctttttataataaaatcattactcttgtggctgtatacctgtctatatgtttttgacattctgtacatttttacataagtgtctgtttcagttgtaccaaggagacatgtgtgggaaagtggagaaagggtgagcacttccaattttatatgtggctatagaaggtacatttcctagaacacttgctacagaagtgggacattgcttctgaatgtcctacatgtatgagccagaggatcctaggggacatatgtgtttgacttagaaaccaagagtaaatgactgtgtccagtcaggtatgctgagctgttcaggctggctggagacctgtatgattttggggtatggtgctgggtgcagtccagtagctggaagttggccagaatgccaagtgcttgatatatgtcctgggatgattggcattaccttgaatgtgacagagagtagaggagtgacataatgggattgcattttaggaatatcaccctgggggactgtgttttggtttaattttttttttaatcgcagaataagacacatgtataaacaaaagaatggctgaagaaaaacaaagtctgtgatacttacatatatagcacaagttgacataaatgccacttatacctgcctttctttttgctcctggcatgcctttatttcagtggcccctctgggtctgctctgtctctgggtctttactctgagctgtatacctgtaatatgttttgctctgtgtccccacccaaatctcatcttgaatcataatccacataagttgaggcagggacctggtgggaggtgattagttcttgggggtcgtttcctccaggctgttcttgtgatagtgagttcttgctagagctttttttttttttttttgagactgagtcttactctgtcacccaggctggagtgcagtggcgcgaccttggctcattgcaacctccacctcctccctggttcaagcaattctcttg

SEQ ID NO: 122782 - DNA, 1024 bp, Homo sapiens
gcatttattgctattaaaactgctaataaaatgtgtatcaaacatttgcagaaattctgaatccttctatggaacctgaggattctactttaaggtttaaagtcatgagagagagaggtttacattgaaagagttttcagctccttggtaagaagttttatcagtctcttttgctgaggggttcttgtgatagaactcaatagtgctttttcaatttataggatttcaggtaagattccacctccgttatccagctatcttctaatatactcttatcttctctattaaatgtttctctctgaaaatgatttaccttcttattcaggcttcctcctcagtagaataaccccaaactcctccccacccctatacatgcacacatgtgctattttatccatttaacttgtgtcttcccccaaagacttaaaaattccttcttaataatgtaaaaacttataaactctgctacaagcatacgtaacatttctcgaggctattaaaaatatctagatgtcaggtaagtgtatatgatgaagtaagtgattcaaatagaacaattaacagatggcagcaacaattatatattcatattcctggccaacagcatttggtagatataattaccttacaggtgttaactgccctttatggaatgagacatctctgaacactagagaaacatggttaacgatggtcacaaatcagtaaaaattctatattgactcatttttttagacaagaatcagaaagctaaattcagtttttggagtatagtgctaagttcagaaaaagtgaaacttaaacaggagagcaggtgtggtgtaatcttcaagttgattgctgggatggggaaaaaaaaaccccgcacattaaaagacatttaaaattcactcaacatttggaaggtacagagtccaaaaaggcaatcatttagggagaaggaagcagctgttttgacttattcctttgagtttctttaaattaccttagtttcatatgcaaaatagtattaacatgctttttt

SEQ ID NO: 122783 - DNA, 1002 bp, Homo sapiens
attctcttcagttctatttagcagacatttactgagtattctgttgttgttgttgaaggtagtgtgcaatatgtttctaatatgaatgtaacaaaaagaacctgagaatatcaatgaaatttaggtgaatacttaattcctggtgatcaaagctaatgggtgttctaatgaaaaaaagtctagcactatcatggaataacagcagaatctggagcaataaggcaagaaataattttatttttcagacaagccacattattaatgaaaacatgcaccacacatgaataacattggaatattacctctttcttgaatagcagtgatgagatggcctactctgagaggtactgaaaaatcagttgaggagattattgagcttaagtgtgtaataatcagaatgaaaagaaatacatgtagtcagaattacaagccaacttaaacagataattgataaggcaaattgtataatattcaaagcaagaaagaagacctagaatacatcaagatctctatctgtacaaatcgtggttcacataagcagtatgtgcaattagtggaaatatgtcctgatgaaatcaataggcctgtttaggccttacttttcaaaatgggcactagtaacatctttgatagaaagaattcttgttgcagtacattgaagtattggttcatgtcatttctgtgcagcactcatttatcatctgtttcaaatgaatctttttggtacttcatattagcttgtgaacgtacaaaagtatccttcctatcaagtaactctagcattagaaaagaatgactgcctcttgagagttgagtgtatagcttgatttattcatctgcaacagaaaaattccttcaaaagtttttactgtatcttaaaattttgttggaattctgtattctttcttctggcatgttattgtgatttctaccttaactctttagaatccagaggaggttcaccagagttttcttgtggtttctcctttttcctgtgaatac

SEQ ID NO: 122784 - DNA, 2065 bp, Homo sapiens
gtcagcatgcacgtatcttttttatggtggaatttttgactaatgagtttttgttagaaatgtatcagttctacttcattttatagttgaggtgttcatatgagtcagtctcagtaatttttgagtgactttctgtagaaagttgttctctaactagaatggaagatgctgacacctagatgttcaaatggggctgatggaaaaaaatcaggacaattttgtatcttatatgggcaacaaagcattataaaaggacatgaaggatggtttgtcatatccattagtttttgccgttttatctattagacttgcagtagcatatgtagaacacaggttgtgtatggtgggaataattttgtggaggatattatgagtatgatattcacatgctaaatgaaagtcaagtatgccataaatttaactaatgtcacttatgttttgttcacatagtagtggtgtcatcagcgtaatacaggaaagatttacagtacagcccaacatgactgctgttctctagtgtgggccccggtggggaaagggagaatcagaggaagagactattactgatggcactagttttcatttttaaaacacacagcctgggctgggcgctgtggcttacgcctataagcccagcactttgggaggccgaggcgggcggatcacgaggtcaggagatcaaggccatcctggctaatggtgaaaccccatctctactaaaaatacaaaaaattagccgggcgaggtggcgggtgcctgtagtcccagctactcaggaggctgaggcaggagaatggcatgaacccggcaggcggagtttgcagtgagccaagatcgcgccactgcactccagcctgggtgacagtgagactccatctcaaaaaataaaaattaaaattaaaaaataaaacacacagcctgtaactatttgaccttttgtcttttatagtattttagtgtgcttttatttcattttatttcattttactgagcattttatttcatagctttaggtacaaatgtggaaattttaggagcaaagcagtttgtaattatttgtctcaaaaaattgatttgacctttaaagacatagtttttgtgcatcaatgggactaatttgtttaaatagtttataaacaaactattaaccagtatgatatttttcttaaagagatcagagccaagaacaataacaaaaaagtgatgactcatttttcaactttcaatttatgttacaagacattatcacagcattcattggctctaatttgacattaaataaacacagtgaaaaaacaatctttgaaaagttattcatgctttcgtataaacagagagatggtggtttggagataccccttttaaaactgagcctcgttaatttaaaacaagcacaatgatacaactgtacttgacttgaaggagggcatattgttctgcaggcgtcctaattttacttctggtcagagggacactggaagattttcagccagaactgcagtgagagatgaatttttattatatgctgagatgctcagatgcctggaaacagaaaagagctaattttactgttgaaaagtagttaataggctacctgtttccaaatatgcacctgccatcccccaccactaccatcccaagtagatgcagactagagcattcatagtggtcgttcatccgatgtggctccgcatagatttttattaagtcaggcatggtttgtgtagccctccccgctcctggaactgatcacccatgttttttgctaccagagaagtagtttttcaagcaacacacagcttgtatgtggaagatttccaaagtcacaattgcttctttatcttccagtgactttgaaagaaagccatggcatgaatagaatgctcaaagctctgtccctgcacaatctgtagtcctttatttcagctatgctttttactgcttcttgggaattgatttttctcttcaatgtaccacacccctttcaattctctctccttaaaatggaaaagagaaagaaaatggtgcacaaggtgtctgagaagtagagcaaaaagtagacatg

SEQ ID NO: 122785 - DNA, 1054 bp, Homo sapiens
agtggtcagaaacatcagtcctctctgaggtgattactgaagtgaaaaagataagaaagaagccatgtgactctctgggggaggaatgttccagcagagtaaacaacatgcattagacctgccatgggcaatatttgatgcagtagggcaaggcaactcgaagtgtgctcaccatgttgatcatttattacaaatatacaacaagatttaaagcaatgtaatgtaatatttgaatacattgaactggcaattgatatgagttgcatgtcttttttatttcattatttggtaagttatttttattgtattttacaaaagtttaggctcacactcaattcagggaaggggcttgtccttcactatagataatctgagaagcatcatgtttgaggaagggaagagggccacctgggtgagttaggaaagagaagaccttggttcacttagctgtggtgggacaatgaggatattctcttctgaatgcaaaaagaatcaagctgggctgctaaaagtgagaatgggatgaaaagtaattaagagaggagatataaaatagagtaaatagttcaaggaagtagagtttcctgactgtggggagcacacacctcaggtttgtagtcaaaaattgaatgtgaactagtcattatagttatacgtttgtcattgttgttaaatccagccactttcagctgttttattacaagtgcagagtaggcagaggataaaatttaactcagatttgggtttctccagcaaaatattaagaggggaaaaaatagctgagagtttataaaaggatgagattagaatgattcacttggaatctaagctggataaagagtgaagtgaggacaggggatggccaatgaaaggccagcagactagaagtgccaatgaggccagtgaatccctgaatgggagcactagagcccatgagctgaaaggtaagggcaataactctgtgaaagggatgcccaaattggtgtttggaaatggtgcaattattggtaatgactggggtggaaaagaagtcatctcattgtggtaatattct

SEQ ID NO: 122786 - DNA, 1071 bp, Homo sapiens
ttcttaatatgctaactgtaagatacgtatgttgtaagataatagaatacacattatacctaatgtaatagaaaatattcaaggcataaatataatctgaaaaagcttatggttaatttttttagtaagtaatcttttttgatcatttttaactcctcaaaacaatacacttggcactgttgtttttaaatctcaagaataaggactcaattatttcttcaatttgttttcttcatattctgaatttcacctatatatatttattttttcatgggggagtacacaataattcagttttgaaataaattaaaataaactcagatccctttgtaaatgaaggagcattaatgtctttattaaaccacattattgaagcaagattgacatgtaaaagctgtacattttaatatacacaactttatgagtttggacataagaatatactcatgtacccatcaccacaatctataccataaatctctccatcagctccacaagttttctctcaccatctacattattattattattattacgtgtgtgtctgtgtgtgtgtgcgtgtgataggaacacaagaactaccctcttaacaaatttttaaggaacagtagtattacaaattcacctctagctttcttgaaaggcagtgccttttaattgtttatgccttcatttcattaggagtttcttctgtctaaaagcttattctgattgattttcccctaagcagcctaaaacaattgaaaaatcttgttattgtgtagctgttggaaagtcaactttgttttaaacaccacatctgacagttaaaatttactgtcaccacagtattgcccttcctgagagagatttgttgttgatttcctccctaattttgggtcacatggtagagaagcattgaacatatgttattgtgacaaaatccacacatggatatttatgaaactatagaaaccttttgcagttctccagaaacctgtgatgataacattctagttatctttggttatatttttggtgcaatatatgcatttattcagtactattaaatacctactttgtggcaagtat

SEQ ID NO: 122787 - DNA, 1013 bp, Homo sapiens
agggttagaaaagagaacaaatataagcatataagagtacagtgtacttcttgaaaatcaaactttgaaatttatcttattaaagttggtaaattcagaagcattatattctgtcagcacccacatatacccttgtctggctttgagagagttttatttttttaattttataagagttaaatttgaattggagctaatgtaactgacaagagggaaatagaagcaattggcttgcactaaacaagtttgaatggttgttaatgtgaatgactttcaggcagtgaatgtcagagaacagtagattactttctttacctcgggcattttaaaccatctcctgtggtaggattaacataatttctctctctctttcttgaatctaggaagcaaagtaattggagtctggtaattttggcctgtgggtgatgaagataaatcataacaagctatggaatacacattgacaattcacatagggctactagaacatgaactttcagtaatgcattaaacaaatattgtttctttctgatttatattcaagaaagccacagaactgttaattatgaatgcagttatcgtttgttatttttgactaaattcacatgcaaaacaaattgtttcaaaatataagctattgtgttcttaaacatgggctaagaagttgtatcttttatatgattttgagtgatcatatttgtttaaccgaaattatttgagattttaaaagaatagaggtggaagagaatacaagaccatctggtctagcccctctccttaaggcttataaatgtatacatcatcttgagcagatggaggtgtactcacctaaaattttatacaaatataggttctacagttccattcaatatcttattcttgaatttggtcactaaagcattaaaggatcctattttatattcagattattttagtattaagttcatcttgtaacatgttttaggctttggaagattagccttaatgtttttatttgtcaatataaatttata

SEQ ID NO: 122788 - DNA, 1015 bp, Homo sapiens
gtgcatgtttggatgttgtgcttttatttggggtggggggcagatactgatttagagttttctttctacaacagccaaatcctttctgtttaggtggataaaatgtgacatgggtgaactagctatccttaagcttgatttctttggagggcccttgctggaagtcccatattctgtaaagactgcatagagcttacgtacccaaattatttttttaaattatgtatatattaaaataatacatcaaatgttgcaactagaatttagaaaaaaactcattattttagaatgtttacaaaactattgtcatttttgtcaatgcactattatttttctctgttcctgggagtattttagttgtaaagtacaaagtatatacagttctatattccgcttattgtaattgccatcatgccaacccatttcctttgtttctacagaacattatcaccatcactttaaatgactgcttaatattctgttggatatatatatatatctgaatgtatgtaaccattcttatgttactgaaagtttggactaactcccgctattggccattgtaaaagccgcggtgaagatcatgaatgtaccttttttccacataactgaaaagttcttgacaaatactattcaactactttttgaaagtattatatcaatgcgctttactgacaccatcaaggccaatcatatggttttagtgcaagtaagtgctttataattaatcaagtccaactcctttattaatcatcattctgggcatttagtctcaatagggaagtgatttgatcaatatcaaacagctattgtaggagaaaaaccaagactatcatttgtattgcatttttaagcttttcttttacatgagtatctcctgtattctagactctgtctaaattactggatattctaagataaaaactctgttctctagctactcaaagtctagagaattatgattacagtagctcacaagtactgagtaattgctgtgtgtcaggcactagtgtaa

SEQ ID NO: 122789 - DNA, 1984 bp, Homo sapiens
attttagttcaagcaaataccgaatacttttttactacgtggaaattctctccctcagtaattttgttacagtcagtgtaaaggccacatcttataatatggataagaaaagttactctggacaatgcctcgttgagataactattttcttcagaatgtcctgttgttgaggattacctcaggagcttgacacccagctgcagaacacagagagattttccttacactttaagcctttctgttgccttcctcatgactaaaactgagtagtgaaaataatagtgtatggagaaaacacaaaaaaaatgaaaattaaaaaattgtatataaccacacatcctggttctttaccatgttataatgggaggaattgttagctattaattaaaagccaataaaaagtttaaatatctaatttacttgactacatttttagtgtagtgtttattttgtcttttgtttcttgagcatctgtttatcattgacagtattgttgggctacccaccaggagtactgagctaccatccaagcaaaacccattcagttacctgatgtatcgtagaacatattttttagtccagcatcatatttatatatcaaaaactcctgctgaaagatgtttactaataggaaatttaacttctcaactattagcctgagacttagatgatagagagtccaataatttgctgattgctgtatatatttatctggttgttgaaaaggagcttaagctagaagatgttgggtaaatttccatggctcagcctaaatctcacaatttgcttttcaaatattctgtatgtctatgtcctttcaatcgaggtcatgtgacaaattgtttctgtgatagaagataaactttctgagggagaggcaagttgaccccataatctcaactagtcagagaaatcatttaaagaggaagcaatttggaaactaaaaattagttcactctctattccaaaattaatatcccatgctaatgtgaaaaattgaactatggagtccattttactaagaatactgcatacatgttttctaataaaattacacttttctacatatacatacatttataatgtacatataaattttaacaattttgacaatttggtattccagtgatttccctcttgacttcctgtgcccaaactactttcttttaaatatctcacctgctttatttttttattttcgtcaaaataggtctttaaaaaattagcattaccacacagtgtattgttaatataatgtaatttttgtttaacttaggaattatttgaaattggttccagatgtgaaagccatggagattgcatgtaaataatattgtgttttgaagccagttatactgtgttaagtggataaaaacatgttactgaatattgatttatccccatacttatgttctgagtggactttggactgtttaagtaaaaatattactataaagtgctttgaagtgttttattctgagaatagccctatctatgtgagagggaatgaggatagttaacttacactcatagctgcttttttgtcttgctctattgtccaggctagagtgcagtggcgtgatcttggctcactgcaacctctgcctcctgcgttcaagcaattctcctgtctcaacttcccgagtagctgggattacaggcatgcgctaccatgcccagctaatttttgtatttttgtagagatgggtttcaccatgttgcccaggctggtcttgaactcctgacctcaagtgatctgcccgcctcggcctaccaaagtgcttgaattacagctgtgagctaccgtgcctggcccatagctgctttctaacttataaatgtcttgatattttggaattatactgtctttttatctgattcttttttctgagaaacatttaatttgtgtattctttgtggcataaaatgctttcaggctcaatcacttgtagttttactcccaacagtattaagtttatttgtt

SEQ ID NO: 122790 - DNA, 1149 bp, Homo sapiens
atgtcagacttttaatttaaaacctggacatagacatttaaagatagctaatgcatgaggggcttaaaacccagatgacaggttgataggtgcagcaaaccaccgtggcacatgtatacctatgtaacaaacctgcatgttctgcacatgtatcctgaacttaaagtaaattttttaagccaaaaaaaaaaaaaagaaaaaaacaaaagagattaaaaaatgtaattgtatggcgctggagcaggaattgatacccttcagttacaatatggagatctctcagctatcaacttatattagtgcatcattttacaaaatttcataccaaagaaacatggtaccttcttcttttttctataatgtttaaaatagtagccttcctttctcaattctttattcgtcttacatccactgattgaggtaatattttcaggaatcttcaatatctatgaaaatattagtgccattttatgtcttatggttcttttctccagcaaattttcagctgacctggctgagcgtggaaaaggatagggaatttgaaatttacagaaaagagtatatgaatagtctggattggtagccattttatgtccttattttttaaaggcatggtatttatcaaagtagactaggaagctctcttgttacttaggaacagtagctgtgaaagaagaacccaactccttagctgtgtaattgcattacttgtgctctagaaactattttactagcctggaaatttctcttgctgtgcatgttggattatagaactaggactcccttccagtatttcatattttggatgatatgacttattttgatactatgaatgtcagatgccccattaaggtgtgaaagtgagtgtgttcaaggggagttgaaataaaaggtcttttgctggcttggctgtcacactggtataaaatgtctttgaacaggtaactatttttacatggttaagcatcttaaaaatattattaacttgttattttatcagatgggtctataattattgccaaccttcagcttccatctatttataaaactaggtgtggtgattttgatagcactttgattattgaggacaggtattttggcccctaaaggaatggtaatagaattagatgattaaaatattttttcaga

SEQ ID NO: 122791 - DNA, 1147 bp, Homo sapiens
ctttaggaatgtgggtaagccttaaactaatcatagggcattaagtaaagactcaatacaggatgaattgaacaataggtgcttagtgcatagaaattatttgtatttcctaagtttccatttcatagcctttagcctatattattggaatttttcatgttgtttaactgtggatgaaagcacagttttttaactaaatggaaaatttagaaagagaaaccaggcagttaaatatgatgtcttttttattgctgacattatctgcatataaaaacacatgtaagatatatcatgtggaaagatatcccccactgcttcatgtagattcctgactgtattttggttgtcggttaagtggaaatctttttcctcttctttgtaaaactttttacttcatagaaataaagcaaactctctacaggcttctctactttctcttcagaattttattgctcctgataataatgctcctggacctttttcctacatcaatgttttaaagggttgggagagggaattttttttttttttttttgagggtgtaggacttttggctaacagcatttctcattctcaaagaatgtcattcactgtagtgggtggtttgaaaatatttacttaagggtagataaagagttcccacctgacataatcttcctgtgttaaaatccccactcaatttggcatttctgtgtactgtgcaggattgctaaaaagcagttaccatgatcagactggttgatgcatggtaaagatgtaaagcagggtgtttggaattcaacatggatggtagaaatgcgagatgtcagagaagccatatattaaagagaatttgaattggaaactgaatcccaatctgccaccgagaacattttgatcattttgatttattaaacttttataacaacattcagatggagctgaattaaaacctttagtcttggatagtttatgggacaccaaccactgtgttaccggtatcattttgaaggatctcttagcgtcagtgaaaaggggaaaaatgggtgggtaagatacttaatttaaaggaagttttcacttatattcttgcatctaactttaaatccctcttttgtttgcattgtgtcacttaaacatattttataatttcaacatattagatacc

SEQ ID NO: 122792 - DNA, 1012 bp, Homo sapiens
caggtgtcactgaggagaattaatctatgggaaaactgttggtgccttcaaccttggctgcttctgtaacttctggctcacaagacaggagtgtgaggagtgcaaaccatgtcccttgtgctttcctagtttcttgtcacctgctctaaactttagctgatagatgaatagtagcttgctatttaattctaattttctctgcttttgtctaagcagtagtgattttgccatgtatacactggtttacagttaattctgatccacttaagagaccgtgttctctttcgtagctaagagccaacactcggcagtcctgcttttcattgggccattggtatattctaattcacagcattatcttctttctgcatagctttatataaagaattctgcttataggtcttgagataaagtcaccgatctcatatcatggattataaggtttttcttctgctttctggcattttggatatgtaatgatgagcatcagaaagtttaatcatatttactttttagaattgttaaatactcctgaagtcattttggttgattttatgtggcttcctaccgtaaagagatcaatgccttgcagatataaagctttcttttccttctttaataatttataaactctgaatttaatgtttacagattacataactgatcataaatgaataatgcgtataatattctttaccttccttatctattcttggaacaggactatacaagcctggcagtcatggaagttcaaggattgctttttatcgatatctagaaataatttacttctctttctgtgcaagaacaatatgctctcctgtttgcagagctgccccttcagtgtgtttctaggtgtgtcacgtcaagcactttgtaactttcccattgagctcctgggatcagtattacaacatggatcactggcaggcctggtttcttctttatgaaaagtagtctgctagaaagatctaaaatttacaaaattattttattgtaaaataaaacgtag

SEQ ID NO: 122793 - DNA, 1054 bp, Homo sapiens
atgttaatgtcatatatattgactggggtcttgatctatgagtgtacagacatttgtcaaagattaagatctgtccaatttactaattatgtttacctgaataagacacaaatgaggaaaaaatgagtaagtgacacattttatcaaataacgaacttactggcagtgctaatcaagccatagatggtaatagcctacaggcattacttgcgtttttatccatcttgtccatttcaagtgatttgattacattcaaaggtaatttgtaatcattagcctaacttgaaataaacatgttctgagtttctgctttaagaacaccttataacttgaggatatgaaagggttgtaactggggttggactgaaagttatgcattagtattctattatgaaggtccagtataagtggacacctacagggtaaatcaaatagagcctattgctgcaacatctgtcagaccatatgctttggcttcaagttcggtgtagaaactaaaatactaatgactccatccatcattacagcgcttggcaggcctgcatcattgaattgggcagagaaattcaacagtggagttattgaaagtagggaattgtgtgggtagatttggtggcaccatttgttttggtgaattgaaatgaggctgtttaatgtgtgactggtaatcctatgcagattgtcatcaaaactgtggcaattgggccaatctgtcagtaatcgccgcaggtgctggcactgtgcctcctccgtgggcctgccaaaacaggagagtcagccaccgcttcgcccttggtgaggctcatcattgctagaatagtgtgatacagctagttgctcagccaaaggaaatgtcattccttatggagcaacacataatttaagcaatggcttgagagtactaattggagagtgaaatcagtaaaatgagatgcaaattgctctcaaaaacaaccagagcgaggctgaccccctactgtaccaaccgttctcagtgaaggggcagtgaaagcggttggtctaaaacttctgaccacatagtgcgttacctgtc

SEQ ID NO: 122794 - DNA, 1061 bp, Homo sapiens
ttgtatttgttcctttggcctggaacatcaataatctgttggttgacactcatccttgaaaattcagctgtttaaaactcagattatcttactaatgtgttcagtggttcacatactgcttggcacatagtaggtgctccatgtatgttaagtaaacaacaaaaatggaaaaaatcaatatgcgaaagtttacctttaaagagattttctatgtctgcctatatattgcctattcaggatatataacaatacttggtaataactgcttaaaaaatttaagctgcttaacctctgtaacgtaatttttcttcaaattttatattttgatttgtttacctgtacaagagttaggaaattacttacattataaggttaaatttttaattcttactgaacaaaaattagatttacttttgcatatatttagctattcccctccactgtagaaattccttgaaaactattgttgtaaatattttctgtttctttttgacaggtaatatttgaagctgaagtctcaggagggagaagtggttatattgccattgatgacatccaagtactgagttatccttgtggtaggttgtgattaagaattgtatttttctatgtcctttccacacttgccttatattggcagtgactattgattgtttatcacttggtttttgctgtctctcttgttattgttagtcctagccttctattgagttttaaaaggaaactgatatctttctagagtttttgaatcaaatatttttcaaacttgtaactaattgtatacctattaggagattcttttaaattatttcattactgagaacaaaatatacatgcaaaggcagctgttagtaggacttgttcatttttttggcatcattaaattgtctagaaaaacagagaagaatagcaaatcagagttcaacagaaaggaaaatataaagaagcctcatgaagttatttgatctgagttgagggctggggtgaaatgaagagaaataattagttcaccttattccaaatttaggactactttttttctcctctgtcataataaatgt

SEQ ID NO: 122795 - DNA, 1003 bp, Homo sapiens
taaagctcaatttaaatgaacacatatgaaactttttctcaggggtgtagtaatcttgtttaaagtacaagaagttaaacaactcaagaaagtgaagctaagatagacctagaaattaaaataatttaatgaatactgacaacaaaactgaaataaccaacaatgatgtgtatttattcattagaatgtcattgttttcaaaaaaatgatttttaaaaactttttttctgtaacttctctttccttaaaccacaaacaagcaaataaaacttattttcctaggatacatttatacagacttcaggtattacactgttgacaatcacaccttttagtttagatagcacctttctatatgctgctatttaatccttagaaaactttttttgaaagctgtattatattcatattatggggttaagacttagctctaaaagtttcaaatctcaaatttatgtgaatcctcaagaatttgtaaacaagagggcttggagtataatacagggtttttttcacccctgagaaagtggtctgtaccagagttgtctcaagttatacattatttaaagtttttaatactattttctatttcttgctaagcccttgttccagtatttacaaaatgacatgggaattatgttcccaccaaatacatttatgtgaaatgtaaatcatatgcacacacatattgcacaccctcctgtgttcatagatggccacccttccatcatgaagcattctgcttaccacaaagaccccatcctccatctcactttcagcttattccagtaaaatcaattgtcacaaagggtaaacttggagtagaaaagaagtaatgcaggtagtttatgattgggacagatggaagggagatgagccatccattccagcggcttaccttatctcattgttattgactttgaggtggttgtagtgtgagaatggaaagggtttaatggaaccatgctgccatcttgtcaatataatgtctagtcagtgtgct

SEQ ID NO: 122796 - DNA, 2399 bp, Homo sapiens
attttgtggtccaaggatgaaaattcatagaagaaggaattgtggtctggagagagtaagtagcataatcaagattcaaatcaggcttgacctctaaattcagtgtttcttagcaaattgcacgtaaacttattcttttaaaactgcctaatccagtgcttttcagactttttccacgttggtatactgagcctcattaacccatctgtctgggtccccagtcactgccagaccactggaaagtgaagggaaacaggtatttggtagacatttgctatgtgccactgtgcagcgtttagtgatattgtcaaaagttcaagcaatagcacttacttctgtgtcctttcccagcctcaggaccttttgctcttctagtagctttagccttgtttgattcttgttctgtatccacaacctactgccgtccttcctgcaagaaaatgtgtgtgctagcttagtcacttcagtctgctatagcaaaatgccataaactggatgtcttataaacaacagaaattgatttctcactgtcctggaggatggggagtccaaaatcaaggcaccaacagacttggtgtctaatgagggtctattttctcgttcatagacagtgcctactcactgtgttctcacagtgcagaagaggcaaggatctctcatgaataagggcactaatcccattcaccaaggtggagtccgcatgacctgatcacctcccagaaacctcacttcctaataccatcgctttggggattcaaatttcaacataagaattttggagtcaaacagatattggaccatgacatgtatgaatttttaaatttttaatgtctctaaaatacactaagaagtaattaattaaatgttgtaccaccttagagattcaaatgctttcaaatttcaattcttagttcagggcaaaattttgaaaggtaattccatttgatgagttcacttatatatcacactgcatagtaagcaaaatgcaagaactgtggcaccagactatctgggttagaatctggtgctgccactgaatagctgtgcgaccttgggagagatacttacctttctttgcttctatgtcttcatcagtaatattgcccctacctcatagggttgttacaagaaccaaatgaattaatatttaaagcagttggaagagtttctagtacatgatcagtattatctatgtgtttgttagcaaatgactaattaaaaagttatttatatttatagtaaattttctttaaattgaaagtttcaaaaattagttatcttagcagaatgtatgtatatttgccacctcatgtataataatcaaatcagtcctaaatcatgtagcttttgtggtgatatgatgatatacggagtaggacaaggtatatcgggtaattgtgtagatctttgagtgtattcaaagtttggcttttaagtgagcttgtcacttcgtttctctcagctccatttttagtatctataagatgtgactattaaaatctgttctacacacttgtattagtctgttttcacgctgctgataaagacacacctgagactgggcaatttacaaaagaaaatgctttaatggacttacagttccaattggctggagaaatctcacaatcatggcagaaggcaaggagaaacaagtcacatcttacatggatggcagcaggcaaagagagagcttgtgcagggaaattcccattttaaaaatcatcagatctcgtgagatttattcactatcacaagaacagcatgggtaatacctgcctccatgattcaattatctcccatgaggttcctcccaggacacatgggaattgtgggagttacaattcaagatgagatttgggtggggacacaaccaaaccatattaacacctagcaagtgttttatggggatcaaatgaagtaatgttcatgaatatactctgtgagccaggtatggtggtgcatgcctgtagtcccagttattcactgaagtgggaggattgcttgagcctaggagtttaagtttgtagtgcactatgatcatgcctgtgaatagccactgcactcgagcctggacaacatagcaagaccctgtctctaaaaaaataataaaattaaaaatactttgtaaactataaagacctatccaaagtaaatatattcttaatgatgacgacttatgtatttaaagcactgtacagttttttgcatttgctgtaaatatatgatggcaaaatgcttacctagaagtaacagaactgcatgtattactgtgtatctgatatcaatatttaaaatagtgggctgttcttctttaaagaaaaacttatctttgcttatttttaatttccttgttagcagtgggtgcttagtacaatactccaaataatatcactcctgag

SEQ ID NO: 122797 - DNA, 1053 bp, Homo sapiens
tgattcctgagatggttttggctgagaaataaattaaaattttctgaatagcattttgaagaaatgtgtactatctgaaaaatttgcaaaaatacattctaaaagttaagactactggatgctgcgtattgtacattatctaaagacgcatatataattgatgtttctgacattgctagtatctgtattgtatatggaaaatgcttggaattgaatatggtggaattgcagttttaatggaatatgcttactttgtaatacattgactctccttttatattcaatgtgtactaattagttatggtcactgtatgtgtcttcctaatgttaggggttgaagtataatagattgtaaaataccttgacctttgagccagtagaactcagttaaatttttatttgtcactaatttaatgaagcatttggaattctatttaagctatatgtgtcacttttctcatcccagaaaatatgttgatccattttagatactttctaaggtttcctcagtaggaaaatcctaggagaggacttagaatataatcttactgctcaaaatgattatatttatgctgattgcatatttacatttttcttttattttaataacacatggttgatattgttgtaatttattgatgtcaaaaactctaccaaaattataatataactatgagaaagtataatcccctttacagctatcttgttttatgaagtggtttccaggaaacgatcttagcccaaaagccagaactgcctattatgggataaggataatcgactagcaggtacaatcagcagaaaggaaagtgaatttacttggtttaaagactttcttgcagtcacagaaaatgctaaattgattttgtttttctccatagaaaaactgcagcacgttatataagaggagttgctttgggagactataataccttttacagactaatcagtgattttaggaaatgttgttgttggaattagctggaaactttgtaattggaattgactcaactttcatcacaatctctctctcctcctttttttcatattaaa

SEQ ID NO: 122798 - DNA, 1046 bp, Homo sapiens
aacaaacagttttaagtacctcagatgggccaggtacttctgcaaattttctccataccttaggatattctttgtttggactagaagactagaattaattcaagacagctattcaaacctaagccatttgctgaggtcgattcataaatcatgttaaaatgttagtctaacctcacataaattaatatgcgtcctttccccaaccttcacttctttggccaggagatgaaagctcaacatggacttcccaccccaggtattgatctcctttcagaatctgcctctgtattactgtttcgagagtcagggtcagcaggaatattgttttgggagaacaggtcacatattgcattagagtaacatatgattattttctgacctctcttctctttaacttaattctcagtgttttgacagagctcttgcatgcctgttccctaataaaggacaaaagacaatcattttcttatgacagtttcgtattttatctcaatctaacagcagcatgaattgataactacttgtacaagtaatgttattttatttggttcaatgtactatgactgacttttatttaaaagacccgttctgcaaattaccttggtttatacttaataggtagtttttataagcttagctccaagttaaacgttcaatgtttgttttattgaattactttctatatgaacttgagtagacagctgttttcatgttagtgagacttttttttttttctttcagactgacactgttgtgccaagctataaggagtagattcttcaggcagaggtcactcattgtctttcagttagagatttagaaaaacttttctaagctagtgctcctgtggtattgcatgctacaaagtggggaggccctttgggacatggtcaagtctttttaaagatcaaatcctcaatttttggaagagtatatatatctcatatacacagtttcttaaaatttagggtttgttgagacacatggaaaaaaatttaaatgccactgttgagtaattttatgctgtatactttttcagggaatag

SEQ ID NO: 122799 - DNA, 1067 bp, Homo sapiens
taacctcagtagaaatttgggggacttgttctcccagggatttgtatgatttccagctctgttacagtcaacttctaatggctcacagtctgagcctctacataagtgcttaggctgtatctcagagtgattaatgactgagtaggaaagctaaacacacagcactttgtgaactaaagaccagatcaaaccagtctggattctacccccatccctggcctctttgctcaggaccccatcctggactgttattactgattaaaaatcatctctcttttgatgtctgaatgtgttggagtgtaacaagagcactgacctgaaatgaggaggttggtatttgaaccgaacttgaacattgtctctaatacattttatcttattggatgtgtctcattatcatagcctgttaagaattttttatagtaagtttttcagacagtgcattcgatgtgttttatagtcttgtgtgtttgagaagtattagttagttatgttatctttcaagtgtttgataataatattaaataataagtagactaaatctaaagaccaagcccagtggccttgtgcaggatggcatctttctggttgataacaatgcattagtcaatttttttccagtatagaggttagactagtcataaagtgacattactttgttattatccagctctcatttctgcaccttgcccataagtggagggtgagagattctttcaaatgctttattgaaatgtagacatattaagacctggccaggtgcagtggctcacgcctgtaatcccagcactttgggaggccaaggtgggcagatcacaaagtcgggatttcaagaccagtctggcaaacagagtgaaacactgtctctactaaaaatacaaaaaattacctgggcgtggtggtgtgcacctgtaatcccagctacttgggaggctgaggcaggagaatcgcatgaacccaggaagcggaggttgcaagaagctaagatcacgccattgcactccagcccaggctacagtgcgagactccgtctcaaataaataaataaataaataaataaataaata

SEQ ID NO: 122800 - DNA, 1026 bp, Homo sapiens
tgacctgttttaaccctttgtggtgggggtgttttgttgcaatactgctgtgggaaggcaccaccctttcttgttttccacataggactcatatattcatattttttatacttattctgccctctaatctctttctgcagccatctcattcattttcatcccaactaccattccgttttgtacacttatagctatattattgcctctttatctcacaagttgtggtatgataaataagtgatgtttgtacactgtttttgcaaaaaagctcacagtgctttctgggggtatctactaattaatctttacagaatccctatgagatagatagggctggatagggtattcagcacacaattcactagaccatgctgtctctctattatgataaaggattattattatgttaaaatgtttatacactgaatacataaatttgtagagattgatgtaaaccgaatcccttggcaaaaatatgaacatgcctgtagcataaaattgcaattgtgaagcaggttttatcaacttctggtgtttaaagaattattccagatttgcacattaaacctctgttggatagcttgttttcgttatcttgcctcttggggaatgacagggagcagtgagctactgaacttctgggatttcagcaagtgacaaactcagattcttgatagcgttatttaaaaagtatagcaagctcctctggcttgtgtgtgactcatctacatgtatataatagcttgattgacttatataattagtacttttatgtttatatactgataatatttgtggaaatctagtcaggtattttatgcttttgcagagtttgatgtggattagctgcattgccttttctacaaaagcaaacaccctgaagagttgtctcctttagggagggagcttcactcttttcagtcaacagccatgtatagtcctaagatgctttagtagtgtttcccccaccgtagcatatggattcactggggaaaaacacaaataaaccaggcagcagaaaagaaa

SEQ ID NO: 122801 - DNA, 1051 bp, Homo sapiens
agactgtacttagattttataaatttgatttgtggctcattttcttgaagaatagcacatataacaaattgtatttggtgtagtgttaataatgattgaaatcttagtaagacaatataattggacatttctggaccctgaaacagacactgcttctaaaactttgctgtgaacaagaatttcaagtccattctagtggtttataatgtcagagtctttaagaatcacctggtatgcttttcaaacatgcaggtccaagggccctaccactcagaaatgatgactttccatatctttagtagaacttagaaatgttaatttataatatatattttagatgggtctaatgcaagtagttcagagacaccacttcaagaagcactggtgcacgctgtagccatagtgaccatagatttggtggaagtaagaatggattgctgaacatgggattcagatggaaaatggaagaaagccaatgcagtaataagaaagaagaaaggtcaggagcttgaggaaacaattataccaagagaaggtatttcatacttttaaatttaaaagtgctaaagtggtatttgctaatttttaaggaattctcagttttcaaagctaggttccactaaattatataacatatacttaatgttaactgactatagagtgtgaagggggagagtatttcaagcatatgaggatgaataaacagttttttcctaaaagtatttgtaatttaatatagtaggtttcaaatgttcttgtttcatcatttttatttgaggggtatcttacttgtaattctaacatcaaaagcagaaccagatgtctaaaatctttggtttgatttctaacagagctgaatcccatgcccttttatcctctgtttcatgtattccacactcttctaaagtagagcattcttaaagcatcactatggaaattctaggattcttcagcacacaaattgaaaatgattattttagaaagttctcaatacaaaattgagtatgcagatagagatattttcacatgaaatggggaaataatctagatt

SEQ ID NO: 122802 - DNA, 1174 bp, Homo sapiens
atttagcgttctactgaattctcttgaacaaataaatctggagatgcttttctttgtgcaaagttgcatttctttaaacaggtaatcatcgttattaaacttagcaattggtagagttatatatgttttaatttcaagggctttaatgattattttctctaacaaccagattttagagactcataagaagccacttgatttgcacatatcacacacagaaagggttcttagtgagcctttccattcaactactttcaaaaaaacttaaatgttttatgcattttacaaataactttttctcttaaagtccaaccaaaggggtgttttgtgtatttttatcctttacatccattgaaattacctgttctgtatgatataatgaaacatgggtacttatttaagctaaaatatagttgctaaagttgggcctccctgatgttaaatgctacccccttcagtagtgacattaattaaagaaaacttgttaatttgtgagttattctaaaatactttctctcataaagaagctatgtttctccttctaactagtatacttaggttttgcttggcaagactatgtggaaagaggtcttatgtcaccccagcttagcagtgaagagcagaaggcactactgtgcctctcttggtctttttaggtaaaccacaggcaaaatatggagcacatttcagaataatgttaatgctccaaaattgcataagtcctgggctccaaaattgcataagtcgtggggctgtgacacaaccatcttccatgattgtgtttcagtctgactgcagtgttgcttttgtcttcgtagggtaaactctgttgtttcaacaggtatctagacttcaaataattgttaaatgagtgttgtaattgaaataatcagcccttggaactgcaatcattatgaaaattgtatgctctttaaattctatgtaaaaatagattgttttaaagaaaaaaaattcattttaaaaacagaaatgtgcttgaacaacttattttaatggaataaagttaagcaacgaatcttcattccacagctttaacaagtcttccagcttaaggtaatcaactacagcagatattattttaagatattgaggtagcaaagagtcctatctacttagagaatgtatgatttataatagaataccatgcactaat

SEQ ID NO: 122803 - DNA, 1041 bp, Homo sapiens
ccaagtggttccaagtcggacaagttctgtgtccaatatgccaagtaagattcattgtgccatagaagggcatgctactccccaagatctcctggagaataaagtgggttgctgttcacaaatggacctgctggttttaatgcagcccagttaataaatggcattcactcagcatacagccaagagtactccattgattggcagcaggaagctccttgttcatgttgagagttcctttttgcggtgccacttgcctctgagaattgtcagtgggctgccttcacagtgcagcaaaaggtcctttctgctttttcattgccatttgcttcccagtttggagccagttgagttatttagctatgggcctgagttgtgtaaggtacagcatttttaaatgagtttgtttttgtgtcttccttgttcggagttttttgtttgtttgtttttttggaaaaacatccagcaaaggatacggaaggcaacgttatcctgtgcttcttagttatcactatgctaactgaaattcagtggactacccttgtcaagaggttatgccgtatattgagtttcagccttgggtctcactctagttcagagagagctcatgttacagaaacaatcctctcacctcagccaataaatcctaacaaatcatctctacacccagtgagaccatgtatatctatcagctatcttatggagtgaccagaaatcagagagaaagaaggcacaatctacttcccctgttatccaagtaaaagcttagtcatctataactaacttaataaagcatgtgcttgttgggtaaagacagagtagctcactaagcttagaaaagaaagataagagaaaggctattcattgtctagtacctttgcatttctgattagcctgcatataagtggatggcattttttttgtaggcaccgagactggaactttccatattatttttcaatcttattacctctactagaaagacagtggataagggagattacttaaaccattttttgtgatcatattgttgggagggagtga

SEQ ID NO: 122804 - DNA, 1167 bp, Homo sapiens
aaaaagcttagaaccctgtgaaggtgacctctctggttcctgatggtgatttgcttttattacaaaatgtctgctctactttgactttaaatagttgttgttgattcattgatgaaacttatggttgtgtaaataaattttaacagatgaacaaaagagccctggtagttaacagaacaattaatgtaaatctgtgacaagcctcttttcattctgctcagtcatacctgcttttatgtagggtggtggcagctgccacagtacccttcattgtttcttttgagaaatatttccataaattagtccaattccctttcagtaactgattgaaaaataatgagcggtcaggagaaataagcattgtttgttcaatgcatgattttttcttacttaggagtttgttttatctaaggggaatgaggaagacagatgctaaaaggagcagtggaagagataccagttctttgcttatgttctcaactagcactcactttggtttgctgaatctgaaaaaatacatttctgatttcttgttttgcatacttctttattaattatttagcgtacattgatcaggcagataaatgtgagaaccatttccgtctaatcagtttaatgatgtttctgacaatgctatactgtttcatataatacatgacaaatagataacaatttaaaattatttttgtcttcaattatgttgtctgctgactttgatagttaattggaattggtctagtttttagggctttccagtttttgaacaacttgaatttttgtgtgaactctgtccattttcatttcaaagacttatttttcttcacttcagtgtgtatataatatgtgaacaaaatattggtgttataagggacaaacaaaaacgaatacgttttttatctaaaatttaacttttgtgctgtggtgatttcagtttcaattcttagaaaacaaatacatttttcatttgagagaatgtgggaagaaggaaatatacagcaaatgtcagacatttgtagtcttttcaattttattattcattacataatattacatagaatctaattattctgttgttagtggggttggaatataaacgaaaacaaactttggacactaaattttactcatgtaatctagtggacaatttatagttaattttagctgtct

SEQ ID NO: 122805 - DNA, 1005 bp, Homo sapiens
tttaaatctcaaggtctaacacaaaattgaccttttaaagaaataacagcatccagggacggaacctcatagtgagggttactgaacaaactctccaaactagtaaatgaaccttttttttgttaagagcatataaactcagtcacagaatcataaagtgggtactgacactattgattgtctgatttaatcataattcaatgaatcatttctgaaacaaacatccaaagctttgtgaataacttatcctttttggcttatttttatatgtcatttaatttattcaattaattaatcaaaattaaaataattaatgaaaatgcctcccccttaacatagttcatgaaactctacatcacatttatttcccaaatgttactttcaaaaagtcagtaaatcagtccagtctgaagattacaataaactcaaaaaggctatttcttcctgaacaaagctgtaggaaagaatctgtcaataagtagctctttgtcaaaccaccaacaaattttggacctaaacttattttaacacatagaaatactttctctagtttgaaggttttgtgccaatgtctccaaacacttcctcatcaacagggtggggaagaaagaggggcaatctctcattaccatgggatgcatatgtatatctatgtatgacacttccccaataatgggggtgggggaggcaagagggcaatctctcattaccatgagatgcatatttacatctatgtattacacatatagtgagaactgatgacatcaaaacatacaccagaaaagtacagatgattacctgatattcattgggccaaaaggtgctcactgctagctcagcccgaagccaatctctacccgtgaatccagtcacattccaaattggattggcaagaggtcctttattcaccctaactaatatgttcaaagtgccaggattcagtcctttctggctatataataggtaactgaaatcaatgcagtgagtgtcgttctccttcattgt

SEQ ID NO: 122806 - DNA, 1053 bp, Homo sapiens
ttttactggttttattttggatgggggtggggtgatggtagcaattctgacctttggattttagtccaaatattgattctgggcaactagaacagtggccaaaactacctctcttactcaccctaagaaacttggttgtgggactacagctacctataaaagaagaatcagatgtcctgtggtattattgatgtcccttgtgggaccttttctaagtctaaataagtccttagggtcaagctgtttctggaagcctggcagaaagtttatctgcagcaatttgtcaccatgagcttacttgttagactctcatttatttacttatgttcattttcttaggtacagaaggatatttttttttctgtgttccaggaagcaatttttgccaaagctaccgtggggaggaaaattatgattgtgtttcaatcacaattagttgcaattttgcctctccagatacatatgtgtgttgtagcagcttgtcagttttttcttaccccaaacacattgtcttttgaattgaatgctgatcaggataaatatataacacactcaaaggggaattttggtcttatatttgggaaaaatacattagtagatggctactcagattcaagatgtgtttagtgagggtcaagaggtgaatatgcttcagatacctgaattagttacatgggcttgttagtgcaagattaaatggctttaatttaactgccgatagagtctgttgtgggttcctggaagtcacccaaattgttaatcactattgaaataacatattggtaaaaaataagaaaatttattaattttaaaagttagctgtgtaagttagaagcttagaatgaattttatttcccttgtcctctgtagtattttactgaaaaaaggtttgtaatcagattgctacattccatgctccataataaaatacagagcagcattattttgataaagtaaattgactcttatattttatttataaaatatttaagatttttttgaaaacttttcaaaagcaaaaaacataatagcattatgggatttatatgtgta

SEQ ID NO: 122807 - DNA, 1003 bp, Homo sapiens
aaatgtttgaaagtttttgcccttagggttttgggagttcagactggtaaattctaattttaagaaggggaattttaaactctggggtacattttaaggaagaactaggtgagaaaatgagctaccaggaacattcatttaatcaatttacttgtgaaaattacatgagaaactgatgatctgtattttatgatattttttctttatttttgaggctgaagttctttaacaaacttttcagttatctatcaaatgttccttcagatatttaaggaattatagtgatgattttctctctctcctttttgtctgaacatgtcctgtttaaattcgcgttcattttctaccacatagtacacactaacctctctgcctctataaaataagaatactgttgatgtggatttacagatgtctttttcccgtgtttatatcaccaccgcttattttggcacagtaatgccaccttttatttacttaaagtgctaagattaggtttaaaaatctcatttatcaggcccttgctcttcaaagagtagaagatggtagaagttataactccaagactgaatgagtcatgtttcatctgtagactcagggctgtctcttttagattcctggctaatttcaggctttgcctcacttttatgattcatcagcacctagcgaagtatcagacatacttgtttgtagaggtgcttagaaattgaagaagagttgaagtaaacttgtcactctttttttttgcttagcttcttttaggttagagggctaagagtatgacattaaactggagataaaagactcaatttagtggctctaaaggagttaatatggtttgcacattgaaagctctactagctaacaggtaatataagcttgcttggtgataacttttcattttaagagtaaatattaaattgtgttcaaatcccacatattttggcctcatggacgtataggcccagtgtttgcattactttaagttattctagagtaacta

SEQ ID NO: 122808 - DNA, 1060 bp, Homo sapiens
atagaaatttattttttggtaatttgataaaatggtttgctaggcagctttaccctttattctcacttttggacgttgcataattactgaactcagttgttctgcatgtaagtgtaagaaaactttcatcttcacatcagaatatttggattgtaaacaacatttaaagaatgtttaggtgttgtaaaacaatgaagtcaatatactcttaagaattttagagttagctgttaccataagggaaaccagcttttttgtttctgtgaatataattgtaactctccagtaaagtgttaacattcattaaaacttttactagttgagttctggtttctgtaaaatatttgttgatgaaataatttcctttaagaacatgctataatttgcatgtaattacttcagcctgaccttgaacagataagggctgaccattggaggctgaaagcatgtgtgattaaaagttagtctagatgaaagtggcctaggcttgaatgtgagcttcatcatgtattagctgtgtaatcttaagcaagttagtttaaattcctacgcttcatagtccatgtaaaacaggaataatactagtgccctcatactgtcataagaattggatgagttaatacttataaaatgcttagcacattgccttactctttctaatcatgttaaccattcttattgccagttatatagatgcttatgtggtaaaaaagacatgaataaaaatacaacaaatttagaatgtgtgagatatatcgtaacattaaacatgtaaaggaggctgggcgtggtggctcacgcctgtaatcccagcactttgggaggccgaggcgggcagatcatgaggtcaggagattgagaccatcctggctaacacggtgaaaccccgtctctactaaaaatacaagaaattagccgggcggtggtggatgcctgtagtcccagctacttaggaggctgaggcaggagaatggtgtgaacccaggaggcagagcttgcagtgagccgagatggtgccactacactccagcctgggcgacagagtgagactcagtctcaa

SEQ ID NO: 122809 - DNA, 1083 bp, Homo sapiens
gtaaatgctgacaaactggttagaattaaatggggagggtttgggatggagtcctggataattcagcgtcgccaattgtcagtgttggaaaaccagcatgcagaatatagtagaactgcatttaaattaaccatacatcaacagatatttattaagggcctaccatataccaggcatggggttagaaaagtcaacagagtagtagattattcttcgcttatggagtttacatccttaaagaaggtggcacatagagaccaaggtactataatatagtaggtccaacccagctagcttccctgcagtgctggggctgctgagcatcaaacgagaagtttgcttggtgttgggagcctgtttctatgaagatatctatcttctaacgctggagtcatcctctgaatccaaagaagctaatactgtgagaggtaggagggaagtaacatgatgaagggaatagcagatctgtgtttgcaatctgacttgcatgctcattaagtctaaaagcaggcaaactgtcaccatgattttaattcactctcttttatgtttcatgaacccacacagttggttttatatatgttcaatgcacacttgacatgcctccacatcctcattgtgtgttattaatactgtaaatatgtaaggcattgttgtcacagtctctgggatcatagacttgattgatttctcaactctgtatcccgaggtggataagttaccttaaacttaagagtttatttactcagccataaaaatggatactgtgatatccactttgtagtagtcttttgcatgtctgagatgtgtaacccctttagtccagtacttggtacaaatagatgcttagtaaatggagatgtttttgttagtataagaagagccacaatttttatttaatacttaaaattgagaaatagggaaattattaaaactttaacatacaacaacagaagagatgtgaaacatatttatgtacattctttcatttagagtttaaaggttttaattacatctgttgtattagttgaaactttcttgaataactacagtgtttttccgtaagtgatccaagttttctat

SEQ ID NO: 122810 - DNA, 1040 bp, Homo sapiens
ttttgtatgtcaagaatttaagaataaagaatagtcagttttcacatgcagtattttgtttaccaggtagaagcctaacttaaactcctatttatcagaccaggatctgatatattttgaatgtcttataaaatatctatattgttcttgtaaaatgtctatctatattgttcttatatctgaggttttacctggggttccctgcctttaaacgttatttacatatggaatattttcatttttctcttcaaagttaaactgtactttggaaaagagctcactctctataatcattactgcacttctcaaaactgccaccttttcttcaggaatatagaagtgggaaatgattctgtaaaatttcaaggaaagagtggtgggacagtaatggggaaataacctctttcccttggtaaaatgtgtaatatatcttttaaaggcaggaaacttgacttgtgaagtgatggtagaatttaaactgcatgcaaagccaaggctctttaaaagaacgtgaattaagtcaactatgtagtttagctcttgggtgatttttttgttgttattgctgtgtgtgtgtttttttttttgtttgtttgttttttgttttgttttgtttttttaaatagagtgaagagttttattcttctatagcctctgaataatggaaagacttcctggtgcctgaattttaaagaccattattgtagtctataattgtattgtactttggaactagagagtactgtagaaacctagtccaaatgccttactttacagacatggaaacttagttgcagagaagtagcagtacttgcttggtgaagagcacgtagctacttggagttaaggtgacaattgtcatggctcacccctcactctaggttttgtggtcctaaagagttaaaggaaaataatttctgactcagatactcctcattccagttagtagcaatcttgagttagtagcatttattttgtgttaaaaataaattggaagtgagttgacaggaatgataaagtttcattgggggaaaattagg

SEQ ID NO: 122811 - DNA, 1025 bp, Homo sapiens
aagataaagatggtgattggttgggtgagttagtagttagggttctttcagtatcttagagttgactccacaaccacagttggaaggaaggaggctctttaaccaaagtatgaactactgttgaaatatgctgatgaagtgtgagaatgacagcagcagattgtaatggattttgaagtgttccaggttttaatagtaactaatagtagaactatagttcaaatctgtaatgacaacattgaaactgtagtcaaaatactaaatctagattgcattaaacctttttatgagaatacgtaaaattatcatatgctaacaagctatcaatctgagttagaaatgcttggcaataaaagtgttgtttcatttgattgatattgaagtagccgtttgttttatactaacttcacattatggtacagatagagtccaaactgatgaaacagatgtaactaataaaatgaatcgacagtataataattgtaaagggaaataatcgaagacaaagaaagtgttttttgagtttttttgctgattgggtggtgagagtggaagagcgtgggaaagcgtggtataattcatagacaaatcctagtatttctctgtattcagtttcatttcactgagttgtctgattgtaattgagttgttcatattgttctcttgaaatgttttgaggcaaatgaaatcttctaagaattcaagtatagtgaaacaatagccacaagacatggtaaacttattgctgatgttaacaaaggacaaaaagggaaaacatgatttgtatttagtagtgttggtgctattgcttggaaccaaatatttaaaattatttgcaaggcaaatagatttgactttaatgatgaattttggtaataaatcatgaagggaatcttttaatctttgaagtaataagctaagcgtgcttttttgtgagatgaattgactttaaaaatagtaataacaaaagtctaaaacatatttacaaatgatgatttttgataggacttttatataaaaatttg

SEQ ID NO: 122812 - DNA, 1093 bp, Homo sapiens
atggactacttgaagggtaagccacttaatgaaggctggtttttaatgtaaggactgttaccctcgcagacataaatgcaacatgaaaaatgtctaaattacagtggacagaaatggcatgctgagactggaattttttcctgatatttcaggtacataatgcatctaagttagatatgtcctaatatatttcaggggaaaagaatagcctagtattaaaaaaaaggaaataaaaatgaatataggtgtcagtgctagagaacttccaacctcctagatgaattaagataggaacacacagcaatttcaaagactatatagtcacctttaacatataccttaaaatcaatacatagtccaaagactcaaaatttcttttccctggtaggagtgtgaccgaaaatacagttatgaccttatacttctcctctccaaaaataaacttgactcaagataggtaggtactatctcagtttaaaagcttattatctttcaaacacaagaagaatgccagggaaatacatacacacacacacacacacacaacaaaaaaaacaaaaaaaaacaaaaaaaaaccgagcaaacaagaaaaggtaggtaactaggaattattaaaaatatatatgatattaattatctcttataattaatgtgaaaaatatggagttatgattatatattagattatcattacatataaaagatgctttaaaatcttggaagaatgttagttttccaacctagtttctgccaagagtggtatgttgtaaagacctctactccctcaccaaagaggaaattattggctgagatgtatttttcaatgaaaagtgaacattttctaaatttagagcatatgacaacttagaaatgctcacagcatcatgaagtctccacctagccatgctgattaaaaagacgctggcttgctttttctaggtttatgagaataaaattaaataggacagttttacaaacttcatcaagctggttatgtatttctgtatgttcctcccacctcagttatttaagagttggagattaaataggaaagtagggtggcaattttgactattcaaaagttatgttttga

SEQ ID NO: 122813 - DNA, 1038 bp, Homo sapiens
gtggctcacgcctgtaatcccagcactttggaagaccgaggcgggcggatcacgaggttaggagttcgagaccagcctgagcaacatggtgaaaccccgtctctactaaaaatagaaaaattagtcaggcatggtggcagctgcctgtaatcccagctactcaggaggctgaggaaggagaattgcttgaactgggaggcggaggttgcagtgagccgagatcaggccactgcactgcagcctgggtaacagagtgagactctgtcttaaaaaaaaaaaaaaaaaaaagtccttatgaacatagaccatatttttttgtgttttatttctcaaaaaaaattatttttcttagacaaaaatgtcaacttctgtaatgtaagttttaaaatatttttgtcaagaattaaacaagatgtttttcctcttgttagaaaattaattgaattcaaaaataccccatttaccaaacattatattgagttgagatttttatgtaattagacccttacataattattaagatttgaccttagtctttataaatattacctatctatattggatacacttaaatgttgttaattctatcaaaaaagtgttctcttttcatatttctttctctctttttgtttttgacttttgcttgtcaaattccgatcttctgtccctcaaaagtctattgtatatatattttcagaacccatagagaataagagctgttgcatagaactagaaatcattctttgatctcaaagacatgtgtgttcttgacattgtttgtcaatttttttatgcttatgacctcatgaaataaatttatttgaccattttactatatgttctctcctagatctgagagtagggattgtgactgacatctcaatacatttatctttgactgtaattataactgctttttatttttaacaggtttttgcaaaatagctaattgaattttagtttagagtctctagagaacttatttgatagtatttaaaattatgactgaattgtatcccaccttcagtctagtgtttt

SEQ ID NO: 122814 - DNA, 1035 bp, Homo sapiens
aaacaaaaacaaaacaaacaaaaaaccccaaatgtttgggaactctataaaagctggctctccaaacctaacttgttattgaactgtgtgatacttggtgctattaactggcttctgtttattaactttttggactgaaagccaagagtgagagaaaaaaggatgaataaatagattagaatgaaagaagactgaagatagatagtagagaataataaaaaaaattgtttctattcatgaggagatacagtaccatcaatcattgcttaaaatgttctgtagcagttcctacttactacttactacacagttccacatactagtttggtcagattacaatgatgatgactgaaaggtctgccaaatagaataaaaaatagcatgcagaagaatgagtacttcataagacagttctagtgtccccaaatcatatgaaattatgaacacctacttaactcagtcatcaaagaaatgcatatttaaaacacagtgagaaactactgtacaatcagtggaaaaatgaaaattttaattccaagtgttggtaagaatgtagaataagtaaaaccctctaatactactgttggagcataaatctgtacaaccttgtgaccagcaaatccattcttgggtataagcccagcaggactgagtatgcatgttcaccaaaagacatgtgcaagaatgttgatagcatcagcattcataatagttccaagctaaaaacaacccaaatgtctgtcagcagtgcaatgtataaataaatggtggcatattcataaagtgaaatattgtactgcaaataaatgaaagaaccattgctttatacaataacatgaatgaatttcgcaaacacaatcttaagggagagaaaccagatgcaagagagtatgtattatatacatttatataaattatgtaagtttcagaaacaggcaaaactaatcaatgatattagaaatcagcatattatttacttgaaggagggtttgggtaatgatggttagtgcttgtcaggtggcatgaaggagtctt

SEQ ID NO: 122815 - DNA, 1052 bp, Homo sapiens
aaaaagagtaagtccttcttgagtgtgaattttagatatgacaattttagacatagccattagaaatgaaaatgttaattctgcttattgaagagagaaaattctatcagcagcatccctgaacttgctgatcaatgtgatttaaaaaaaaaagtgaaaacatcaacaataaacaatttatcacaagcacacaaagtaaataaaacctaaaagttacatttctaaatgtaatttttagtttgtaaatgaatatggtaaatatttccttgaaaaattttgtgttggttcccccgtgatgtgtacttttataatagaatgaattaaatttgctttttactctgaattgtcactctccgtgattgagtaggaaatggttatttttgaggctgaactgagccataatttcctttgcagagggaaaactggaactgtgtggttgacactctttgtttcttatatttgacccctactttgtcagcagactcatttaattttgtgcgtagatttgtattttttctttcaaaggtatgtaaccttattttcctggtgcattttaattaaactactgtaatttttcacctgaattttctctgtggtatatttagactaaacttttcatataaaattaaaggatgtgggtgggctgggatgcacacattttgaatgtttatcatcatagaataataagaaagatgttgatttatggaaatgttaccattgctaattaccattgatggtgggtaatgaatagttgaagaattactgctcagatgaccttgttggctcacctttgatgaacagcttaatcggtggttacagtacaggatgatatgcacagaaaatgaaagcatttgaaattcagccatatcttccaattaataggacattaagtaattaatcatgcagaggagggaaaaaggtcacggccactttgccgaatgaaacagtgtttagtcttcagagaggtgagagaaagcactcatgtatgttattcttttagtcatctctttttataatagatactatttttttcattttccttctgatattcc

SEQ ID NO: 122816 - DNA, 1050 bp, Homo sapiens
agcattgaagatgattggaaagagatattaatttaccagcaaattaacactccatctcatagaaagagcactaataaattaagatctgctccatatcaccattactaatattgttttagaattttttatggatttaaataattttacacacatacagaggaaaacaaacagtattatttagacattatgaatttatacttagaaggcccagtagcatcaattgtaaaattactagatttagatcattagcaaaatatttgagactgcaaattttcaaaaagaggtgacttttccaaatatcatcaataaattataagaaagtataatgtgggaaaggctagaaataaatataaaccaaaatattagcacttactacttctggtttttgggaatatatgtgatcttttaaataaatttaaaaagccctattgtttacgtagtatttactgtgtgctgtgaactgtgttaagtaatttttgtattttaaaaatagctattggctttacacttcatttgtgttctgaccaaatattttcattagtcccctttgagatccataaagcctttctgagttttgtgaatgtaatgcagctaaagattataattgtaaaactgcattccaaatggcacgtattgtaatttgctgctacttatatctgcttgaagctgtcaatatgtagagaatagatttgatcattgaactgaagtaaaactgctctcaatttaggagtgaaaaattttaaggccccacctactttctctctgggaaaagatgtttctgttttctgtgtgtgtttatattttctctatttaatgtagatagtaatgttgactagtttacatctgacttttcttccaggtaacattgagatttagaaaaagtacaatatggctggcaccctgagtttttggagagcttaactttgtgtccgaaatgcttaagaagaggagtgtgttcatttgctgtggttgtgattatgattataaacttaaggctggtaggccgggtgtggtggttcatgcctgtaatcccagtactttgagaggctg

SEQ ID NO: 122817 - DNA, 1044 bp, Homo sapiens
cagccgggttcctaacaagccacagacatgtaccagtccatgacctgggggttagggacccctgctttaggacatgcagaacaagtttgtaatgaggactgcgacctctaggtcaagccacatttttcctaaaggtaacattttatttggagtatttggaattttgaggagtgcgagggtggggatggtttgaaggaactgtgattatgttaaaaattaacacctaatggattttagatggttagacctttgtaataaatggaattcataaagcctagcattggcaaaaatacatatcaattttttttgacgagatacagtgtctaatagaatgttagcgtccatctttgcatctaaaataatttaaaaacaaataaattcacttgcacctaggcatttttactttctctttcatctctctgtatatgggtgggaagtaatgtgatacattgcccagaatgtgaagagtgtgagaggaacacacacaaagtggttgccaagaatgtgtctgggaattagacacgaaaaggaccacgttcctttttcttctcataccacgtaagattccctgtggaattctgcttgttcctcagggaggaaaagcaaaccatgagttcctggcaatattattggctatgagaaagttaaggaagagatactgagtgacaaaaataccatgatgatcgaacaaattttcttgttattaagcaaatcaaaatggaaggcccacctttattggctaattattatatgttagtgaagtcagaatgatttataatagtgatagacccagaaagaacctttaatgatatgcaaacacattagttttcttgtattaaagtgatctgtacctgttgacattattaaatgactcccatgctttccattctaacatgattgcttttgaatttgcattattaaccattatagtttttctatgtacaaatggtgtataaacttctctttggaggtgctgatatttaatggcctattcttgggaaaggttgcagggagaatattatgatccatagggcaattttgaaa

SEQ ID NO: 122818 - DNA, 1039 bp, Homo sapiens
tgaaacagggacataggcatatttttgtatgattcacatcagagctgataatcttaatggtttgtaaagggcctaaatgattctacagttttatataaagcatgttaaactatcaaggctcattattacataactataaatggacagagttttataataagaaaaatgtacatttgtttagccattgtctcctaggaacttctctctattattacactattgcatttgcaaaggcaccaaaggtgcagtttggtttatatactgcagtagtaattcctaaaagatttaattgtatcaggttttttaacttaaaaatggaatcctatttaaagtatatccaaatattcgtacaataagaagttatcacagtctacctattttgtaaatgaggtgcagtgtttagttttcattggggtttttgattttctgttttgagcatttaaaacaaaatcctttgaaaatagtagttggtgatcacaatggtttatgacaattttaacaaattgtattagaagactctaaggagctgtattttcaaccgtgctttttctcttccttccttcctttctcttccctcactttttttcttcctcttccttccttccttccttcctttttgcattggggtaagaacataaataatattacatctttccactatgtctaaaaaagttggaggtggagaacagtatattttccatgaaaatgtcagcctgccacatagctctgcttagtaggcaaaccgttattcatttggattctctcttggctttacatttggaaacagttttagtgttaggtacttatgattgaaaaggagatctcatgttgagcttttattgcgttggatgcgcttaaaggaggttttgtaaaagaccattgcttcattaagaaaggaagaaagaaaaacaaacaattacatccagggaaatgctaggatttttgatagtttaacatgaccatgtcttgagcattttcagttcataatgaggcttgccctaactaaaatggcatttcatttcggttgatgtactcttga

SEQ ID NO: 122819 - DNA, 1093 bp, Homo sapiens
gtggtgagatacatcacctggggatgggaatcgggggaatgaggaatttgatcagatgtataataggttggagggttctcactaaactgataagcaggattttgctaacattgggctattcacgtctggcattcttggggcctagttgagaaatgggcttagaagagcctgaataaattctggtctaggaaggctgggagtgctggctcacacctgtaatcctagcactttgggaagccgaggcaggtggatcacaaggtcaggagttcaagaccagcctggccaacatggtgaaaccctgtctctacaaaaagtacaaaaattagccaggtgtggtggcacgtgcctgtagtcccagctactcgtgagtctgaggcaggagaattgcttgaacctgggaggtggaggttgcagtgagccaagagcgtgccagtgcactccagcttgggcaacagtgtgagactccatctcaaaaacaaaagaaaaaaaaatctggtctaggagagtgtctctgtcaagccccggaaactttcactctttccatatctctatttgcttatttcccaggcatagcaaactgaaatcattacattcctgtacaaatatgtattttcttcctccaaccttccctgctggctttgactcagttagtgattaatatcagaaacctgggagtcataattccttctctgtctctgcctcaccttcaagtattaagctgtatttagtttaataacagatctttctactttattgcatttcaccccaacctcaccgttttagtctctgccacttggatgactatacttgctccctaatctagtgttccctcaaatccaggctccagacaacttgtacctttggattataatatgataattttacttttcttttcccactttgttcctcctcctctttcccctttcctctcttctttcctcctctatttttctagtctccgcatcccttattccctcctacttttcttcttctcaattcacttcctcacccctcttccctcatctccttcttacgtctccctcctccaggtacctggcagatagaatcataaagacttgtgtgtttcagtaat

SEQ ID NO: 122820 - DNA, 1055 bp, Homo sapiens
tatgcagtagaatatactgtatagttttgaaaagaaaaagtattacttgactttgtcttatttaagctttagatattctgaggggtaaaaaacacaagattgcagttgttagaaaagctgttttgagcatttttcccctactgttttccttagttttatttgcaagctggagcaggtattaaagatgaagtgttctggtgggagcggtagcccagagtgcttgaagcattgctaatttcaaaccttataatttagttaaattgaaacataactgcatttagatgaatgggctgctagttttccttcccaaagcaaacatgccaacctctcattacttcttgtctgtgctacggcttctgtgctattcagatctgctcgtttacacataattgacatgtaacagtgtcacagactttttattttgcagaaagaatttttaaaaaattaggaatgctttccatagcatgccgtatcaattattctacattttgaagtgagaatgacagagtgatccagaaacttggtgtttctgtggaaagcggtttgtacagtacttggctcatgcttttacagacctgggagtaagtgacacagtaggtctgattacaaatacagtttatcttcatttggaatccatgacttctattaaatttaattacttcccccgtggcttctattaaatttaattaattccccctgcagctggcatggtagaggtgctgctgctaaatgaaggtgattgctaattgagggagttttctgaaagaggttttaccctttctcttgtttatctggaaatcgcttatccagccagacatctgagaacattagtgagaagtgcaggttgcaaagtcataggtgagttcatcaccgttacttagagaatggtagattttttttttttctttttctcttggatctgattctgcagttaacatgccttttggtgagaggccagtgtaggattctaattgaagaaaactggcccagtcttaacctatacaagatggaacatgttaggtctatatacttggaattttctagcaaccctgtcg

SEQ ID NO: 122821 - DNA, 1051 bp, Homo sapiens
gcgttagaggtgaaatgcataaaggggcatccaacatggctggtggctggccatgtgaacaagacatttgcatttgccacagcataaagaaggatatttctgagtcatggagtattttattatgtttatttggccccaatatttccaaataaaaagaggcctttgcttttgtgctacaggcgtttcttatctttaggaagaatgggccgggcgcggtggctcacacctgtaatcccagcactttgggaggtcaaggcaggcggatcacaaggtcaggagttcgagacaagcctgaccaatatggtgaaaccccatctctactaaaaatacaaaaattagctgggcttggtggcacacgcgtgtagtcccagctactcaggaggcgaggcaggagaattgcttgaacctggtaggtggaggttacagtgagccaagatcgtgccattgcactccagcctgggtgacagagtgagactccatctaaaaaaaaaaaaaaaggcacggttttgaatctgcacactcaaaaatggccacagctttcccgctactttaagcactcataatagattaagcatgggtcagatctcaccactcattagctattgggtctgaccactaattatttagtggatctctagatcagttatgtaacatctctaaatcttactttcttctactgtaaattagagataaaaaaagtagccaactcctagtggttttgtgagcatttaatgaaatgatctatgtaaagtgctcagcatggtgcctgacatatggtggagacttgttatatgttagctattattattttctcttaaagtactttaataaactgcatataatttaatcctcagaataactccaaaattaggatttctcttatttcacaggtcaggtagaaatcttggcattctggcagggcttttcactaccaaccaagataacagcttgcttattcaaaccaggagctgcttttagtgttggtaatgatttcatagagagtgatgctatctttttttcattaaagtgggatgataaacattttcgtacc

SEQ ID NO: 122822 - DNA, 1050 bp, Homo sapiens
aggtgttcaaaagtattgtgtttgctgtataaattgtgtctggacattttttctatccaggtacctgatagccatctctaggaggaaagtattttctaactcttaactgtgctggacaaataccaccagaaattgtgttcttctctcctctaaaatgactgtatatcttcaccctcccattaaatattacataagacattagagtgtgaatattacaaatgtatgacctttggtatccctattaaaacaagagggaaggagaggtagagaaatgggcactaacttgcttcaaatcgcactctgaaataagtggaggagttgggatttgaatctgattctggagtcaggtcacttgcttctgagctcatatatagattgatagatcatttctgaagtaggatatgctgcttatgctttaattttaactgttttcagtattaaaaggggagcgtctttccaaatttgagcatatctcactgtagcccctaagtgggaatgatagttttctacctgcaatatacctgctttcaaggtcaggaaagcagagaattgacatgagactaagaagaaaatgagtgtatttaatgataagaatttataatgagatttcaaatcagcaaatatacccattttggatctatttatttattttttctgtgcaacttaatagcattgcagtaaaaacttgctaatttagatgacttgtgggcaacacctgtttgaattaactgaaagtctgaatcacataataattttgtatacaataagttttattatttttctgatacataattaacatcatttaggagctagaaaaactaagcttctgagttacttagaatagtttgttttatatgctattaattgccttttaaaatatttaatattttctacttagagattgactctttgcaaaaggcttttatatacagccctacatttaatccccagaggaatccttatttttcagattagtcaatttggagtaaaaggagagcattaaaaaaatttcttcaggaccagatgtctggttatataattctatatcaa

SEQ ID NO: 122823 - DNA, 1048 bp, Homo sapiens
agagattacataatttaaggttgaagtaccatatactttatttatatacattactaaactaaaagtatgatagttctgaacttggactatggacaactgcctgggtctttccggtttttaagcaaacattagatgagattcaaagttttacttgcaaccatcacagagaaagaaaatgtccttcattggctttttacagatagaaagagagaagagcattcatttattcacttcatgtgtggttttataatttcctctttaaaggtaagtctaaatttgaaaaatacatttcccaaaatgtttctatttccctttcttaaagacttatgtttcaataacagctcccaacccacccctgtaatccaaatcctatttggtcctgcagtgaagttaaatgtaggatcctgacatcaatttgttgccatggaaataattgagatgtcaatgtttccgcattatgactgtaccataggagcagatgggctgacaagggggaaaatctgcaaatatctctctaataattagccaaaatatgaggtaatattcaaaatttacattattataaaaatctgagtcatatctatctaaatagcacagaatacaaccaatttcaacttccaagtttactatggaaaatactttcaaagtatacaaacaggaaggtttaccatattcttttattcacttgattatgttttcttgcttgttgcatcactttttgtgctgcatctataaccaagttcagaataaatcagatttgacaaaagcaaacctcattccacacagagaagtaggtaacaatattgagtaagttgaagagacagacagacttagtccatcaactgctttctctgtcttactaaaaatattccccttgtgaagaatactggacttggctaagtaatcatatagctaatcacttgcaataaatttttgccaggtcctatatttgccattgtgcttatgaatttgtcccagaaaactgactacttgaatacaaagaccaaattcttttctgcatcctccacaatacttagccacatctccc

SEQ ID NO: 122824 - DNA, 1147 bp, Homo sapiens
aaattgtgtggtacctccccacttctttctcttggtcctgctcctgccatgtgagatgctgtgctccccctttgccttctgcatgattgaaaactccctgagccctctccagaagcagatactaccatgctgcctgtacaacttgtgggatcctgagccaattaaacctcttttctttataaattacccagtttcaggtatttctttatagcaatgcaagaacagactaatacaacctctttgaatcttttcccattaattatggacaactgttatctccagtgtaatgttattattctgatagataagtaccatgattgtcttgtttattagaaatggcagcccatgaaggtttcttacttggaggaacttaaagaatgatagcaacagactatgagcattttcttgcagtctatagagtacagggccagacttctggcctgtgctgtttcactggttcaaatgactccatttgtatttgctgtggatgtctgtgttttagtagcagctttgggtataaagctgtcaaagccatcacttcagaattcataggtgatccacagagatccaggtggtgggagaatggctttcaaggtgaaacttggtgaggtggaacaaggtttccaggtggttgtgggtttcttgcctgtcttccttttttcttttgtcccattgtaagtagtgggcataaaagctatgggctataatgaactttgccaagttttgatgccatgccctgaccattatagaagcccggtaaattaatttagtgtgatcgtataactataagaagatgtttttgatttattggatattaaaacttgaaggaacatagggataatgaaatttatcctactcattttccaaatgaggagcctgccaaagattcccaacacatttaccattaatctttttcttcctttgcaatagattcctgatacttttaacctgtactgctcatatttaaacattccaattttcaagccatgaggatggctttttaagtgtatatataattttaatgtcaatgcatgtatttccaaaattctgtgagctttaataatagaaggaatatttgaatgaccatgagaaatgtccgtcgtttgtgtgtgtgccttttcattggtgacagagatgagtgtaagga

SEQ ID NO: 122825 - DNA, 1043 bp, Homo sapiens
tgtgaattatatcttaacagcagttaaaacaaatttaccttatcctttattaaaatcaactttgctagaatttaagtgtgtgtttttgttaacgtcaattgtggccaggtgctttcatcttaaaaaatgaaaaaaaaacaggtcaatgtgtgctggaacttttgtaagcagttaattcctttttaaaattggtgtgtgtgcaaaatttattttaatgcagtttttcccccaaggggacttgttaggcaaatgtatttaagtgtccttttaatgcattttatagcttcagtttattcctttataccacagtgatgttccaacatctgatgaattctggcttttcattaggacatctggatttcacacacacacacacacacacacacacggaataacaaaagataaaacatttttcacaaggtggttatacatatctatactacaaatgtataaatatgttttttcctaacaaatcttgacaatacagaggttgatgtgctgaagagaaacacttcgattaaattggtccattataagaaatgaaaaaagatgaatgtaaaggagtattttaaaaaataatttctttccagcttcatttttttcttttactattcttccttaaagatgactgtaaactggaatatcttaggttaatattatttttatatttacacctctaagtgttcattattttatatctgtccttcattttgacatggctaattttaaccttcaaaataaatatataaataaaccaatgtaaaactaatatcaactttgatcagcttgaccttaactaagcaaatagtggagaaatgaaagtttcttacagaagtttaatgtcttaaaatggggagaagcattttgctttcatctgctccatcagctacactgggacagcagttgtgtctccattaaattaggtgtgctttgattctccaaaataaagaattttctagacacttgacttgtgtcagtgacttaatagagaaggaacacccccaaattggcaactctgtttatctttaatgattacttctttt

SEQ ID NO: 122826 - DNA, 1001 bp, Homo sapiens
gagctgttgtgtgaccatctgttgtatatatatatatatatatatatatatatatatatatgtgtatatatatatatatgtatatgtatatatatatatttaaactaaaataaaggctttagatggctcctggtgaaatatataataacatgttaaaaattcttaatttattacttttgatgtatggttctatcagcacagcagatttcagagatctgctttgttgattttttccaaattaactttttccttccttttatatctcctaaggcagatcacacaaatggatattttgggttgttaatgcactcttttcttactcaaaagtcctagggaccttaagtaatttactttgccttctgtgccagctttcatctagtttatgtcttcatattttctttccatctagagactagacgcctgtttgacttaatagttgaatttatgactttttacttgacttctgttgaagcaactgtttagctacatgaagagatttttttttgtgtattttttatagtttggctcattgcctaaaatattatgcaatagtgagtaggtgctttgcattccaggcataatttagtttatctaaaagtttgtcatgtaattcatggaggaatcatttatttaaaagtaaagtttggccgggtgtggtggctcatgtctgtaatcctagcattttcggatgctgaggcaggcagatcgcctgaggtcgggagttcgagaccgcctggccaacatggtgaaaccccatctctactaaaaaaaaatacaaaaattacccgggtgtggtggcaggcacctgtaatcccagctactcaggaggctgaggcaggagaattgcctgaaccctggaggcgggcgttgcagagagccaagattgtgccactgcactccagcctgggtgacaagagtgaaactctgtctcaaaaaaaaaaaaaaaaaaaaaaaaaaaccgtgaagattgacttttatagagaaggctgaattattttgca

SEQ ID NO: 122827 - DNA, 1034 bp, Homo sapiens
ttattaattttatctttgattttggttttataaatgaagccccatgagacaatgggccgagagcttgaggcttggaccctctgctcacatatggtctgcctcccatgcctcttgccttcctggggtgggttagtgggagcttgggcacaggtgtgggtatggttgagtttggtaagtatttactgagttatgatacagggccccaggtacctgtgagggtctctaatcacctcatggatagtcccatgcccaagagagcttgtcattcaatagcaaataaaaaataagtgacaagttgagagagacacctgggaagaaagataaaggaattcattttcctggtgtttgaataaaaggcctgcattttcattttgttctggacaagtgataaagtcagccctgacaattgttaatagtgaactagtgcttggaaacaagcttcacctttggaacttattgattcgtttccataatttttacattttttttaaacatggtatatgaatagatttggttgtacttagaaccctaaggaattcccaaatattttataataagaattgtctttccacagattaaattgtttgaaattgagctatttatagccttatagtagtaacaaaaggaatttgaatttaaaatatggatttgcaaaattaatatcaaagttttacaattatttttaccctgaaattgttgaaaaaaaagcaacttgtttaattaaaactcttcatgatcttttaaaattttcattttatttcatgatttagtgtgtgaagactttttttacgtaaagcttttctatatcttcactacctttccctgggtcccacgttcatttcagccttgtctttactctcaattggtttaacataccaaactgctcttgttggaaattataaattttatttgactgctttattgtaggacatatttgctttgcatgaggacttttaatacatcagaatagtgtagggttgtccttggcaaaatcccaaaccttttttcagagcaaaaaacaaacccgggagaga

SEQ ID NO: 122828 - DNA, 1044 bp, Homo sapiens
tctaatctaaatattcacattaaaataaaaatatgacttgaagcagccaaagtcttatttgtttggaggcatagatatcaagttaacttgattgttttactcttctgtttcttctcctatcctcaacacttgtgctagaatatctctttaaagctactccagggtgttagtaaataacaataatataaaaaatggccagcattttgtttcattggatttgaaatggatttctatgttggaatatacattattttggaggtatttttaggttattggaagccgagtgcatcaagcatgctctctttgtgtgcattctttattaatttgtaacagcagcttcccttggcatacatctacagctaagtacacaagctaaccttttgtttcttgatagatggcttaatatatgctttctagctagataaaataaatggaggaaagcacttccttatagtagtcatttctgtttcttcaatgttagatactggtttgtttttgctcatcttgccatggatatagtgatctttttttcctacaaatgtgaaaagtacatttatcgttgctatcacctaaatacttcgtttcaaaaaattgtgagatttctttatcaatgggaacttctgtggaaaagaaacttaccctatgttggtgaaattgaatacattaaggtttttttttttttttttttgaaaaggtgtttaatgtgtatattgaatttccctggcttgaggcagtgttttcatttcgtacagagattttaggaaattatttctgattgaaacagaaacattggaatttgtcaaagggttagagaaatctctgactaaagcaaagtgccaaatactagttaggttagagaaaatttaggagaaaataaaacagaaccaatggaaatttgcttcttgggtgggtggacatgtctaaatatgaattaccaacatggaggttttggtgttgtccaccgaagtcatggaattgctggaggttttggtgggaaattcttttctgcaaatctattttagaaaaagttttctactcatgaca

SEQ ID NO: 122829 - DNA, 3439 bp, Homo sapiens
gacagtggttattgcatgaagatctgtggcccgttaggttacatggaaaggagtgattcatgaacagactaaaaattcagattatacaaaatatgtcaggttttgtttttgttttactttgtctttaatgtttgttttctactttgtttattatagaaatggatgctcattctagaatgaaaataatggagtttcaaaaatgtagctttttaacccagtagtagctttacaagataggttttgtatgctgatcagcaggagattctggttatctgagtcttcagaacattcgttcaggcattctgtactctgagagactttaagatcatggaaattaagagttttgaaagttctcaagttctcaaaagcatccttgaaaaataactaggaggtgagtcatttaatatttctgaacatctgatttctgatcgtaaaaatcaattaggaaaattaccactttgcatccataatagtaaatattgatttgggaaagaataatcattggatactaaattggaattaatagaaatttgacagagagcaggatatttgcatggtcttaaagcacttccctacagacattttgttaattgcaaggcaaaaaaaaaaaaaaaaaaaaaaaatagtaaccatatagtggaaaaactgaatgtcaaaattaatatcactgaggggaggcagacagatatcatgtgctttcaggtatgatactataagaacacaaaaccacttttgtagcattctggtgaagaatgcattacctgaatctcatcatgaggaaatatcagacaaatccaaatagagaaattgtctaaaaaaatacctggcctatattctttcatggcagtgtcatgaaagagaaaaaaggctgaagaactgttttgcattaaaggagatttagagatgtgagttgaaactaaatgccatgcaggatcctgggttgaatcctagactggaaattatacttaaaaaggacattatggagaaacttggcaattgaatatggactgtgaattatatcaggtgtttgaaaaattttaaaataaaagaagaaatacatattttagaatttgcaggcaatactgttgtctcatgcaacaactatccaattctgctgttgttcacactgctgccacaaataatgcagaaaagaaggggcatgattttgtcccagtaaaactgaatagatgaaatcaggtggcagactagatttggttcacaggtttgtcaaactctggattatataactgtggtgtatcaatgttaagttttcttaatttggcatcaatattgtgattatataagagaatattgttacagttggaaatatatattattgaaatattggggttaaagagcaagttgtatgcaaccactctcaagttgttttaaaaatattaatatgtagaattatatataataaatggtaaatagatgtaaagatgggaaatacatagtagaagatgttgaaaattggtgaacttgggtaagggatattcaggagttctttgtgttagtctcgcaacttttctgtaagtttgaaattatttcaaaataaaaagataaaaacaaattcagggagttccctaagctaaagggggggggggtgtcaaaaattcagggagttccctaaactaaattggggagggtgtcaaaaaacaaaacaaacaagcaacacacatgtgcacacacccacttgccgcatgtagctcgggtgcaccacctgtgacataacgaaccatgtgaataaacagaagcaacacaaccgggcttctgaggcactattcaaataaaacacagaattaatgaggagaaaatttcagagaaacaaagaacagaattagaagcaaaagctcagcagaatcacctgatttcacttggctttatcctctctggagggaagaagcagccttggagagatggcaaggtgtggctgtgttgctgtcaacttctactttgccctcttgaactgtctccttcatctttccattctccaccctcttctttcccccctctcttttcctctctctctctcttttgtttctgcaaccgccttttttcagtcttcttattttctttggctatgttttattgcccgctcataagctggcacacagacttatttgcttctgctatgttcttattatacattagctcaattaaagtaattgaagagaaaccataatcagcatgacgatattcaactcatttgaaacccagccccaaatacagtgtgaaaatacccattgttaacttcatgcacactccacatacacctgttgggccactagcttataggtaaaaataaaaaagaatgtattttatcagtgagtccatttgcctggtccatttcacagccaggccacattctccttattaattgacctgcttttgttgtgagttttttttttttttttttttttaggttgttttgtatctagtgaatgcctttctgatttaaatttttcagtaatttataattgctttcctttaaggcttctcttttctcctctgtaatattatccctgtccatctctattgccccaaactgttcttggtaagtttctatcattattatttttttctggaacaggattgtctgagccttttcttctcatcttccctaatagctagaatcttctgcccattcacttttcccccccattcatttcctgcctcagtttctacttccaaatgtcttgaaaagtaaaattttattttgttgagtaaaatgtaaaaagaatctcacagtacttatatcagaaaactggatgccctgtaaaataccttgatgtgtggcatatttcttacagtggctgggaaaatgttgaatatatgtattctctgaccgttttcaactattggccatgactatcattttctcccaggaatattaaattcatttaaagcccagagaacagtgttgcataaaatttgcttttaaatgatgtccttcagtgatatttattgaaggcattatcatatattctaagaatattttgattctctaacttatagaaggcaacctagctcttaatgtaatgtgattttaactttccttgtcttgtttattttcagtttggtgacttactctctcctttaaaaaaaaaaaaaaaggaagaaagaaattcactacatggttaaatgcagtgaaaatgtgtactatagtttcttttttttcctttctttttaactgtggatgttaagctgtatagcccagacttgtaatagtttgcaggaaaggcttcttagccattaaaaaaaaaaaaaaaaaaaaagagagagatattgtttcttcttctagataatgcctcattgaacctgtaaaatctgtatgttaagaattatttaaaagaaaaattctgcacaatattgatttctttttttgtcttgcctcttctgacatagaaaaaagctgcaggcaagtattaactgaaac

SEQ ID NO: 122830 - DNA, 2689 bp, Homo sapiens
ttctaaaatttagttcagggtaatttcacaccaaaatgggtaaacatttttatccttcttggctttcatgattgctctgacttcttcataaaatttggaaatcacgttttaactttttattgcctctttattaagtgcttggaaaacacatggaagcctttttattttacatactgtggtaacatcctagtaagattttattcgttttcactctcaagattgattttttttttttagaaaagcagtttagaaagtacccatactcgttgaaatttgtcatcatctagaccttaatatcacatatcctaagttccccactaattatttgcagatttccaggacttaaatatgtgctaaacctgaaaactatgaatgcatttgctgaatcaaaccaaaatgaaattgttttcttaactatgaacgagactaaataattttaaaacactactcagccacagtaaaaagagtgttgaaataaaactaaatatatatatggtatacacttgttgaactaagcctgctttattaaaatgactttatgattctccagtgtattgtttatacatattatttctaaagattcatgtttagctgataattcatactgcttacatatttttggattggttgacctcagacaacaaggatggtttctagcacacaacacattctgaacatatcatgagcaagatgctacccaagttgttttgtttgttttcttaaatatttaaccaacaacaaataaaagtatatattcaaggtactaatatgatgatttgatatacatatacatgtctaatgatctccacaatcaaatcaattaacatatctgtcttcatccagagttatcatttgtgtgtgtgtgtatgtgtgtcccaagatattgttgagggtctgattttatgaccccagtaaaaatgatggacataggctcttgatatgaggggaaaagtgctgtaaacacaaagactgccttatggggtgagagtgtagttcttgggtgacagaagtaaatctgtactgtgaatgtcctctttggagaattacaaaatgacatgatgactgaactgtaatggaaaacttgttttggtaagatatcctttctaaattttttttaagaaaaagaattctaagtgctgagttcaaagacttagtagaatgctactgataggaggattttagtgtcagtattaaatactgcacaaatacttgacactgaacatcgtgtataatggatatggccatatactgtctttttaaaggaagtgcttcctgctttttctccaaaatagcaacatatttttctcattagtgaaatgatggctctcaaataaatatcccagcccagtcctctgtttttcagcccagcctgtgcttcagatttacctaagaccataacccacagtgatgcccaggagtacctcaatctcagcatacttaaaagcaattgtattatttgtgcccaaccttgtttcttatgaattttgcagagttttagttacctaaacttgaaacttgccagttggccttggttcttcctaccttccttacatcaaatcttgcactgtctccttaaaatctctcatacctatgtcttctgcatattccagtactgatgtagttaagaccttcagagtatcattcctagaccgtggcagtagtctcctgtcttccactttagttgcacagataacatcccctaaccaatctatctttcgctgttctcgcgaagtgatctatctgaaataaaaatctaatcatgggagtctgtcttaaatgttcactgcctccctattgccaacagaaagtagctttacctctcaaatgttttctatgcacaagtcactctttaaaaatattatattgtataatccaaacagcaactaaatgaggtacttacctttattatcaccattttataaatgaggaaacaaatacagagaaaataaatacctggcccaaggtcacatagctgataataacagggccaggattcggcccaagcagtctgatgatagatgccctgtgtgtaaacactatgcaatgatacttctaatttcttagcttcccacaaaggcagggtttgaatttcaaagtgaaccaagagaggatgggcccattttatatcatcctataccaatgaatgtggcctgccttgccacactgtgtaaaggagattgtttcacattttatggtataaacttaatgctgaaaggcagtagttcttatcgcctgagttggtacaagtactaatggttcttaagctatttattacattgtatggcatcagttttagttgagacattgggtgtttgtaaatgcattcgcaacacccatacatgatcttttccttttagcagcatcttttcctgcccttgtgctgttgacagtttggggcatacattttgctgcaaagaaaaagataatgacagtgagcattggtatgaaggtatttcccttcttgcttctgcctgaggcacttgtgagttttcagttgttgcagaagttctgaaaacttttatattttgatggacagagccattgaaaaccttgtttcttgaagttaagtttgatttgagaaaaggagtatacagatacttatatagccatatgttgccaactccttgccatttattcagtccacagcttgttcttgttctaagcatttattttattttctgaggtcatt

SEQ ID NO: 122831 - DNA, 1616 bp, Homo sapiens
aagaggaagtactataaggaattttgtatcttaggaattttatttcctagcaatatatcttaacctaaaactggagatgcttctttatttgcctgtaaattagcaaaactttaatattgtcttaccaattttatttttgtatccataatactgcttttctctgatatgggcaagtgaaaatgaaagtaactgaaaatgttctgctgaatagcaaacacccaaggcatcgtcatctttacttttgctaaaaaacaaacagaaaacccccaaaactcacatgtatttgaaatcatctctttccgagagtggcagagtatcataaaaatccaaaatggcctgtgcctatggtcttgttttgtaacattattttgtttgcatttgtcagcatgaaggtcactttagggctacctgaatatctgtattgcactctccagtgtggagagaagaccaaagaaggttagagcagttccggaactagcacatcaaataaaagtaccaagcagtacttgaggtgtggtcagctgcaactctttgcagccaccaatacttaggcacagtgatgggtccagaatggatccagtgagaaggcaaaaaaggaaggtctcatgtatttgctggtattctatcagaaaacaagagttaggaaggagagtgtaagtaaggcatgaaggagtccatgagccataagcaaaatcacatcaatttttaaactctttgatctttgttctgctttttttccccactgaatggtagatatcagaacactatctccaaagattgtctgaattaattaattcccaagtaggcaggaataccaaaccctctctttcaatgagtttaaatgacgttccacacatttgccctaagtaaggtgatacttaaattgtatctttacacgtattgtgcagttcctatcctaggcctcttcattttggtggcagtggcaatggcatatggagagtgatggctggagaaggagttgttaaattatcctcaaaggcctcagaattgaacattgtttcttatttctgtcctatgaaaaaagacggattttaattatgatctttttaaaatcaggttgggtttttactaataaaaaaagtcagtgtttaaattgtatatttgaatgttttctctctacatttttttaatcacaaatatcagctacatgttacacagtttttcatttcttagtctttttgaatgaaataagtagtcttttctttggtgcttttaaatactattagttgaaacttggtggttattcttgaaatttagcttttagaatttaatttattctaaagtgtacagaaaagagattgcaactttgtggtgaatgttgaatgcagctatgaaaacaatgttaccttttttcaagatctcttgcctagctataatacatctgctagttactaagtgtaactgtgtatagggtacagaaaagagattgcaactttgtggtaaatgttgaatgcaaccatgaaaataatgttaccttttttcaagatctcttgcctagctataatacatctgctagttactaagtgtaactgtgtatagggtacagaaaagagattgcaactttgtggtaaatggtgaatgcaaccatgaaaata

SEQ ID NO: 122832 - DNA, 1080 bp, Homo sapiens
tttttagacaggacgaatgttgataaagaagagaaagagtcacaaataactttatgagcctaggggtttgggaggacaaaagtaatactgaagattacagggaatttaggaacacttgcttattgttgggggaagaagagctcaggttttcacctatccaattttagttgacatgtgagtgagatgtcctgcaggcatctggaagaacaagcgcgaaaggggaatgagagaggtcaagcctggtgatggctcctgggtttcagccacagtcaggctgtcattagaacagaaagtggatgagaacaatgagctcactgaggaaggaatcagaaaaaagaacattggcctaaggtgtggtattggagtgggagtcggggcagcactttcgtgtaattcagagccaacatgtctggaagttggaagtcaagggcaaacatttagagaaatgggaaaggcaaagggaatctgagaggttcagaaagccaccactgagtttggttatgagatatagtaagtggattctgggcaactgccttgagccttgagctatttcttgaatattgaagtgaaagaaataattttgtggaggaaatgaagattataagaatagagtgcttattttaaccaaaaaccagaagttagacattctagcaagtaggaaaatagtgttaagtaaaattcaagacacttaatttgtttgctgtgagaaaagaaaagcttttttctccttttaattctgctttcaacgagcaattaactatcccctctaatcatttctctttcaaattctacctatactggtttaccatctatccaagtgaagcatctctctcttaggaaggcagagagtgaaaacctatgtgtgaaacctctttcttaatactcctattgcaattaaaaatgtaccccctcccaatctgtttactacaaagaggccctatgccagcttggtgtcatgaccaccatctgtaaacactatgtgtgaattaagatggattttgttacagtgaaatttggacattgactgggattgagtcaacatggaattttataactccatttagttcatacggcttaaag

SEQ ID NO: 122833 - DNA, 3544 bp, Homo sapiens
aaactgtcaccccctttttattagttttttttaaaaaaacaaagataacagaattttgtgcatttttggtagtattctgtgggttaatttttaacagctggattattgagaaaatatgaaactatttaatgaacatacattttagaattcaactaaaattgaacacaaatgtaaactctgccagtcactacttaagtggcattaattaaacaattgcttcttgatcaaaatgaggatagcttgtcttctgactttgttataaaaatgaaaagatggtatgtagattttaaaaagtgtgtttatcactcaagaaagacgctgatttttctttgttttacaattatttttcgtagaatcagacattgcttatctggtcattattaatttattacttaataacatatttccagcagaagctccattctgtttattcttggaacttgtcaacatccctcttctccttcgaaatcctttctttggtggtgattactttcagtcttggtccccttagaagagctactccatcgctcttccatgggctcttccttcattcgctagcattcctcatggggacagcaactgtgcaaaatagtcttcttttatttgcttcattttatttatcatagcaacacacatgagacacattatctctgtgtctcttcatgactgggaacttgcctttgtaataacagtgattgttatatattaggcattatctgtgtgtgtgtgtgtgcatgcattttcaatgaatgactttctaggtaaaacattttaatgatatagatctatgtaaggctacattggcatgagatgccaggagatttttccattcactctgttttcttcccagtgaaagaaatggttgaaaatctgatggcagcagaactacatgaagactaaatagcacaatagctggttacttacttagaacctgatgataaatttgtgatgtgtactaatataaccaactgttctaaatttttaaaactgattatgggttgattgccacagagtcataggttaacatttttgtagacaactaggtatttctgataattttcctaatcatacagttgaattgtaattatatagcttgtatttatttgtgggtagcattaaaactgcgtataatttacatttggtatatggacctcattcttccttttcattgtgggttcagagacctcagtctaatgcatttgatcccatgtgcctcctgttgagactgtctgcttcttaaaatggaaatttaatttttatgatatttgtatgtgttttgaagcaaattaaaattatagtagttagagttgtggatttgatttgcattttctgaaaggaaaggaaactattgagtttaaaaatgtgattcgatttgaacaaactatgctaattaaatttattttcaaggacactattagcagaaaaaatataaattggtgcaattttccattgcctcattttgtatttcagaagtataattcaacattttctcaacactttgtttttaaaataaagcattaacaaaatttacaagtgacttatttgtgttttaaaagtttactttataaaatattagtcaggaaatagtttcttccctagtttacttgtaaccatggggacaaatatatgtaagtattatcacttgataactggctcaacaacaatgaaattagcatcacaaactcagacttattcaaatttgttgaagctagtttaaagcctctaggtagaaatttattgaaggttaataatttactttaaaatttaagattacaaacaggattgaaattaacctgtagcaagcattatgttttcaaaatagttataattttactgttggggtttaaaatcttgctaagcatttatcattaaggcttctagagaaggaagtaaaaagaagggttggtggtactgaaacctatatttttgagaaaacataggtttgctaaaagatcactgtactttagtctgtcttcagcataatttaggaccaagggtgatgaataagtccattaataccaaatgagaaaaaaatgggggatttttgtttgttttatttgatacacgtggtaaccataaggtgtctatctaggatttaccagttaattatatttgaagggcactttggtcagtagctaggatatgtttctgaggaattaagggaaaccagggatgcataacagaaccacgaagaggggaaaatacatgggaaaggaaatgactgaccctggaaattattaggacatcctgcccaggatgtcattactaaatctgtgttccattattttcataaaaagatatcatctatacacaccagaggacaatggcaagcagacataattgggctgtgaacatttcatatcacgttagcctagtacttttaattagagtttcagtttaattatagtataattctaaactagttgcaggcactgactatctgatgagggagtgcagagattttatttgggacaggttggttcgtcatatcaagggatagctgtgattgggtgcaaaatgacattgaatgcattgtgcaatgtctgagacctgagattaggggaacgtgtcagttcctttagtcacattagagttccattactatgttttggaccttcccttgttcaccttaattaatacatagttacccagaaagagagtcaggttcaatattactacactttacctatgcaaatttataatatcagagggagaagaagatgaaaaggaaatgaaaaatcaaaattaatattatttttgaattaaattatttttataagaaacatgctgctttttgcttttaaacacacaaagtagcagatgtaaatgaattaataggataaagcaagttgctagaaaaaaatacctctcataggaagtaaaatcagaattgtattattgaattaaattattttaatgaaagacatgctgcttttttgcttttaaacatttcgagtggtagaaacaagatgtaaatgaatttgttggataaaaaaagttgtagaaaaaacacgacttttgtaggccttgataatgtaataaggtactactttgctcaaacttttgaaaataaatagataaattgctgggcctagtgttgttggcattactacactgttgagggcttctgtctaaatatttaagagacattcagattagtataattttattttattaagaatcatgcagctaaggaagttagccttagttggcccagctaagaaaaaaggacaatgttggtgcatcaagtggttttatgagcaggataccacctggttccgtgctctgacttcatttgttgttgtctggaataataactcttcattggcttaatgcctttgcttgtaagagacagatgctatctgatccctcctgtcagaagaattcccagaataagccattcaaccaagaacaattgctgtcttgttgattgcaaacagtagaagagggaattctctgtatttcctagcaccttgctgtttggttggtgtgtgttcatcagtagcagaaactgttcactgaccgacgaactgaagtggtacat

SEQ ID NO: 122834 - DNA, 1640 bp, Homo sapiens
tgtctttgagggtgttgccaaagcatatgaacgtttgagtcagtggtttgggagaggcagaccctatgtctgggtggacaccacctaatcagctgccagcgcagctagaataaagcaggcagaagaaagtggaattaacagagttgctgaattttctggccttcatctttctcctgtgctggatgcttcctgcccttgaacatcagactccaagttcttcagcttttggactcttggacctgcaccagtgatttgccaggggctctcagatctgtggccacagactgaaggctgcactgtcagcttccctactcttgaggttttgggacttggactggcttccttgcttctcagcttgtagacggcctattgtggaacttcaccttgtgactgtgtgagtcagtactccttagtaaattccccttcacatatacaactatcctattagttctgtccctctagagaaccctgactaatacaggaatctacacctcattgaatgcggttttgggggcagaaaagtttgataccttttcttactggtgataaggctctcatctgaccgctcctattacaaaagacaggttaacaagagaaaagcatagcaaatgtatttaatcaagttttatgtgacctgggagtcttctgaaatgaaggcccaaagacgcagggaaaactctatttttattcttaggattgatgaagaatggacactcccccatcactctgttactattagatcattcccttttgtgaacacctgtctgttcattcttcttggcctttctgtagtattgcttcctcttgggtatgctgctggacccgccctggaatgaggctctttagggaaggatggagaagggagagggtgacctttctgggttttatggcctgttttggaggagaggagttgccttggggaaaacaaattttgttttctatgacttgcttcaggggagatagagggataggagacagaagggcaggagaaagtcagaataaggctttgcttctgaggctgtttttgaggccttcccagtttcccagtgtgccacagtgccatacttctgtgtcattttctgaagcccaacacagtcctggagggactttcggtcaaggtgtcctgccttcttttatccaggaggtgggttcctgagctacaccaggaaaatatgagtcctacttcagaaagccatcctctcacaggtagtgaacattgtaaaatttaaaatgtcagcgctcacaacatgcagctttcctgccatgtgaaacaaacagtagaagagaattagggagaggaactggaggtactctgccatgttaacattccctggttcagttgttgttgagagctagcttctttcttgtgtatcctgtggtttaactattcaacatttcctttgattccacaagtcaatacattttttctttttttctgagctagtttcagttgaatttctgtcacaaccaaagtgatatctatgtcaattaaatattttttctgtgttcatattcataaatcctccctccctccctttttatttttttcctttcttccttccttccttccttctttccttccttccttcctttctgtctttctgtctttctttctttctacaggatctgcctctatcacc

SEQ ID NO: 122835 - DNA, 2752 bp, Homo sapiens
attccggcttctaaaatacttacattttggtggcacatgggacaccacactctggattgggggaaaatttggggtatgggttgccacaaaaatgagcaaacatcagtgtctcctgccctttccaaaaagcacaagggggctatccaagagaagggagaaagcaggtctaggcttggaaaggataggtggaaagtgtggcactagcaaggggtttttggaaggcaagggtttccatatgcaaagattgggagatggagtatttcagctgaagagaaaacttaagactattttcaggccaaacagtccaacttgaagagtgggttatattcaatagagtagtaggagatgaattagatactgagcatgaaaataacagctatgaacttgtcctcatgccaggtgctgcggcaagtgtatttacttattaaatacttcaaaatcccgtaaaataaatattattgtgtctccatgttacagcttctcttggggccatatgagtaataaaagacaaataagtttcaagctcaggtctgtctgatatagaaatacttgatctcaaccaccataatatattggaattttcatttttggatagttaggctacaaggttctcttgaaaattttgagtaggcagttgcttaaatatgtacaatgtaacagtatgatatatcccataatagtgttagatttggggtattctgggaacatgctgaagaggcaaactactcagttgggggtggatggatggaatttgcctaggaggggatatcagcattgagaccaaagacatagagcagttatcagagccaatgaggagggttttcttgatagagaaggcagcatgtgaagggcccagaagtacggtactaggaactgctactggtatctttgaagattctgtaatagagatgaatgtggcaatttgttgggactagatcatgaaacccttgggtgttatgcaagggaatgatgactttatcttggaggcaacctgatgatatggaagagttttaggcagataggcaggggagtgataggatcagacttccacaattagaagattatgttaaattcatttaaacaaatgtgaacagtagtgaatcaattcccaggggaagtttcattgccaagtattcttcctgccgtgaagattagcctgttagttaccaagccgctttcgttttcagtgtctgtgcttgtggtcggtaacttttgctgctgttgttctgctgctgtctgccattccattcgccatctatcacgcacacagaaccctggccaggatcatgaagggcgattgaaaaggtaacaagagaaaaaaaatgatagattaatgtaagcctgatgtttgttttagtggcagattttggtgttcacatgagtgcctgagcctgtctaaattaatctcatattctcaccacagtcttctagcttgagaattgactgcaggtaaaaataattggaaattattggtgtagccgaaactgcattacagctgccaagtgtggatacaccggagccaggctgcttttgtctgcttcctcataaacattctttccgcattctttatcagcacataatcctgagacacaaaaagcctttgtgtcccactgggaatgtgagaaaatcaaagctatctattggttttgctcctgttaggaaccactaacatttctatattaaccacccatgttttgaattgagatagatgttatcagcaagatgtgtcctccatttatccccaaagatatcactgtcccaatacaagaaatcttaaagacagactgcaaatgtctgttttcatccacttgatgctgtgatttgtggatacttgttagacatgtgaatttaatggggcttagcctaatagtaagcatttatatagaacttcccatgagccaggcacttgtatagtaatacatctaatcatcaccacagtcatgtgaggtagctattattgttttatactgtttgttatgcactgaattgtattccccaaaattcatatgttgaagccctaacccccaatgtgattgtatttggaggtagggactttaaagaggtcattaaggttaaatgatgtcataagagtgggccctaatctactatgactgatgtccttataaaaagaggaagagactccaagaatgtgtgttcacagaaatgaagacagaagaccagaaggtggctatccagaaatcaaggagagtcctcaggagaaaccagccttattggtatcttgatcttggactttcagcctctggaactatgagaaaattaattaattatttaagccttcaagtctgtggtattttgctatgttggccctagtatactaatacatacacattttgctgtgtgggaaaatgaaggcacagagaggttgagcgactgccccaaggtcacatggctagaaaatgacagaattaggatttacacatggggagtgtgattgtggaatcaatgctgttaatcaccatgctgtactgcttctcatgaagacagaacttcccagtattggggcctgggcggtatgaccatattctgcctctggcatctttcctccccttattttctgtacccagccctctgcgttctagtgtataatactcatggactgttcaccttgggctatactatgtaggaatgatgcatctgcagaatcctttactctcgtcatggttggcagtttgctctggtttgagcaatttcatggctcagaataagtagggtcagcaaacatgttaacatt

SEQ ID NO: 122836 - DNA, 1240 bp, Homo sapiens
aatgcagtgcattgcagcaactgagagaagcccactcactatggctggggaagaggcgtgaaggagagtctggtgagagtggccaaagcttcaggtaaaagccagagcatgcaggaccttataactaacgatgacgacttaaaggaaaagacatgatcaaattttcataagtatcgccctcagtatagtgtgaaaaagggtttggaggggccacgtggattttggtgagaccagttaggaggacattgttgcagtctaagtgactgtagggtgagagaagtgtacaggtaaaggtattttgaaggtgggagtgatggagcatgctagtagatttgtggggacttagagagagggaaggatgagagatgctgcctgagtatttggtttgaactgtaacatttaaggaggatttttttttttaggctcttgcctccacgaggatttaaaaacaaatttgcatattaccttttccttacagttcacataattccttttttaggcaacatggctatatattcttttatcttttccctgaaattgcgtctcttattaagatttaaagtatatatctatgtacatatgcatttgtttaaaatgtagtcatttaaaattcagttctaaacaactgggtccttaccccaggcacctttctatattgattctcctttaacttccttgagtgataagctttgctatttttgaagttctttgcctattcactttctcttctttagactgtgtatgaatggatagatacacacactcacccacacagtttgttttaaattgcacagagttgatgtataataaaatatgaagaaaggaagaaatatttttaaaattcttatattttctttagtggtttgtcttagaaaatgaacacataccggagagttgagaactgagatttttgtttattttatttatttattttttgtgagaatagcaaaggctttacaatgtgactgcttactaatgtcagaaaaatagcaattcagctcttactttctcccctatactttcagggcgttatgacagttttaatgtgagttgtaaaatgtagggaggtatactctaattctctttcacacacataaatcaagtttcaggctcttttggaaatgtttactagaaaaaacatcatgggcagattttaaaatgcttttggattgcatgacggcgtggtgccacttccattgaagtgttgtaatattttattttccttcccaaagcgtcaaga

SEQ ID NO: 122837 - DNA, 1042 bp, Homo sapiens
tataattcagtatatatcctgaagactttgagttatgcacattgtcatacttagacatagttctcaacctttagaggatcagacagttatctggacagaggagcattgatgccactgttctccagcattcccttagcctcatcttgctaaaagcagaagaggatattgggatgcaaataaagtagaggaagggctctttgccaagtgctgtttattgaactgagtaaacgtctcccccatgggttggagggagctggttcgtttaagtgggcaagaaaagccagtattcttccaagtaatgaggtttcttaaataaatattccaaatgtagattctctgggctgcatcaacaaggggcaagcctgaaaagtcccctcagtatccaggagcccaggttgagaagggttctgttttgaaactggaaactgtccgtagtttggatgggagaatgcttggaatggaagctaggctgtgatttgtctttttaacattcttgacagaaaaagggtgttaaggaagcaggatgactacagtttcaggggatttatttacagctcctaagaaaattaattgtttttttgcttttgtttttgtttttttttacaactcagacaaacattatgctaatagaaaagtatctaaatctactcatgagaaaaattctttaaggatgcatattagtcaacctgttcttaaaactacttattgttaaaaatacttcgtaatatacacaacatattcttttaaaatgttctacagttcagattttaaagtgattcgtagtcatctcaccccacctccagttaatgagattttactgtttatttgttagctacatctaatagaaaggaaaaaaaaaaacaacctttttgataggtgataattacttaaaaatttggatccaaattaagagaacagagctcatcaaaatatggatgtattaacactggaatgtataataatgggaaagaaggtataagaatgacagagtgagaaattttaaaagaggggaaataggatgaattcaatcaaaacaaggaag

SEQ ID NO: 122838 - DNA, 1028 bp, Homo sapiens
taggtagcaaccagcttaaggaagaaaaccagaccaaccatgaaatagaatataacaaaaacaataacaaaggtaatcatacattttgtagaggaagagagaagtattgtttcatgaaactttggttttaatggaatagatttatgtatccttatatgtctgtgtactgagtcacaatgcaaaaagaatttctaactgtgggtctggccaaaaatatgggaaagttactatacttctctcatacaatgtttgctataaatcctattcacacaactttataagctccaagttttttctcttaactattatgtcgtggcacttcctggtacagtgcaaagagcatagagtttgcgtaatttggtaaatgagtaatttaacttatatagcctgtttccttatcctcaattcgtgtataatttctggatatttacagggttgtgagaatcaaactgggtaatttatgttggatattcttttccaaattgagctacacatatgtaagttactatgattgtaatgccttgccctttggcccttcaaatactaattgactactgggtttgacttaggaagactggattgtcttttaaaatatttttcgaacctgaagatttacagttcagtgttttcacttgtagagatcagtcctgttgagtactttttacacagtcttttgtttcttctttatgacaggatgttgtgaataaagctaaggttttttttttatttacttttcctattttggtattactcttgacaaaagcaatggaaggcaaatgtactttggacatacctgtatgaactcattattcacatttgtcttcaaataaagctgcattttgattttaaaacaaaataacactatgtaaataaaactcgatttaaaatttacgttgaaatacctattgtgatactcaatggaacattgaaataattttgaccaataaaaatatatccaagacttaacaacaacaaaggaataaaaaagatacacaaaacctccaatcaactgtaaaacttgtgagtag

SEQ ID NO: 122839 - DNA, 3118 bp, Homo sapiens
ctctgccactccaagcagtgcccatcccagtaagtattatgtcctatctgggagtagcactcagatttagaatgagagaattagaattaatcaacaagataagagggatctctttaatgcctaagaatgttggtatattgtttccccaatggttatagaatgagaaaggaatatcactattgcttctgtttgcatttgacacatatgctaaacaaatgcactggcttttagaacgtgtttatgaattctatataacatttttctttttctttttggaggttgcctagctatttaattttccttagttcacaaaacaatgaggtagtttcaaatctatttgaaccccaagactttttcaagctgctgttctctgggtaaagccacttagtcctggcacatggtggaaaggtctggctaaagttttgacaattattagctcatttgcagagttgctctttgacctgtcaacacagaggaaagcttttctaagctgtgagaaggattttatgttagactcgagctttagatttcttttatttttccaactttttaacactatcttttctagctttaattgacacaaacttctcttttccttgtgtaacacttgtgcactccagatgttagaaatccctgttaactttcttaccggagaagctctttgcactgcaggcttgaatgtcactgagataatgtccttacaatatttgcaactttgtgttctgactggatgctcctactaacctaggtcttctttgtgattgcggtggcagcagctgtcttcataaactcatcttcatttattttttattttatgtgtgtatttattttttttgagacagagtttcgctcttgttgcccaggctggagtgcaatggcacgatctcagctcactgcaacctccgcctcccaggttcaagcgattctcctgcctcagcctcctgagtagctgggatagcaggcatgtgccaccacgcatggctaattttctatttttagtagagatggggtttcttcctgttggtcaggcctgtagtcccagctactcaagaggctgaggcaggagaatcgcatgaacccgggaggcagaagttgcagcgagccgagatttcgccactgcactccagcctggtgacagagtgagactccgtctcaaaaaaaaaaaaaaacaagtaaatttcttaagttgttatcattttggtatactgtttgaccagattcagtctcaataaaaggagcattaacaaaacttcaaaacttctatggcacatctaaatttaaatatgaaacagttctaaaagcagggatgtatacttgcttgtcctggaccccagaatcgtgactcacttattatttggaaagcagactgctacatattttggtcacaataatacctaaaggatactgaatcagaaaatgagtaactgaaaatgggagatctctataatgaaaacactagatagtagtatacttaaatatgatagtgtacatgagaaaccataaattttaaccagtgtgattcaggctctggctttcaatctatttgcactagggtatcggacaaacccacaaccaggaaaggtgagcgcagatattgccagaagaacccaggtgctctgattgcttactccttaggcaacgtttcagattttgcaaggtacattgtgccctttcccggctaattcttatcaggaatgcacatcccagttgaagcctgctaattgctctgagggctgttgtttttacctttaatttaggttcaggagtctgtagggcaatcctttgaagttcttagttacttactgttcactgaagtatccacttgagatctttcctggactctctccacagtttgttcacaatttggcacaccattggctgaaagtactctatccttgctccttgctcattgacagttatactacaggctgcttccagttgccaacacattttagaaaagcatataattttattaagagtttttcctgttgctttcacatgtagtcaagtaaagggcaggggacagagaaggggcaggatgtcatgtcagcatttacctttccagaggctaatgctttgaaagaataagaggggtccttttaggtcaagactcttattgttcttgtcacctgatttgttggcattgcagttacatcacgtgttgtcttttatgtgagcaatgacaaaaaggatatatctattctgtacatttttatcaaatatgatatccttcaaagcttgttaaaacaggtgatatcagtctgtgttcttaatatggtcttgttggcaacaccttattggggcgggaaccattgatttgtgcatttccaggattgattactatccctaataaagttagtctggtaggcaaaatagcaagaccttatctctacacacacacacacacacacacacacacacacacacacacacaataataaccaggcatagtggtgcatgcttttagtcccagctattttggaggctgaggctggaggattgcttgagctcagtagttaaaggctgcagtgagtggtgattgggcactgcactctagcttgggcaacagagcaagaccttgtctctaaaacaaaatacataaagttaggctggtgagctagggtctcttcatttaacaaaatatgtatgacagagtttatctgatttctttcatgttagtttggttaagttaatcaaatagtaaatgcatgttcattctgtgccaggcagtgtatatagcacagagggcaaaatgatttagttgactaagtccctgcacttaatgaccttacagactatttagaagatctagaaataagtaagatataattaagagtgggaggtacaaaaagtgccatcaggacgtggagaaagtacagtcactcactcctgggtgattagttaagtttctcggatcaggccatcaattggcaaaatccttatgaatgggcacaaaatgtacttgggaaaatgaggaagtaatagcgatggtggtaaatgtttaataatcagctctcaagccaaaaagttcaggttttatttgtttgttttgagatggagtctcgctctgttgcctaggctggagtgcagtggcgcgatctcggctcactgcaacctc

SEQ ID NO: 122840 - DNA, 2838 bp, Homo sapiens
tctttggttgcatcttggcagaaaatgtaacccagactggttgcaacaaaaggtgaatttatttgtctctcctaactacagttcaggtggagcttgatttagaagttgacgtaattccactgagacatgatgtttctctgcctgcttagtttagttctagggtattccaggagcttcttaggctccatatagaggcacgatggctgtggcagctcccaccgaacaagatcccaggttcaagtcccttaaggaaatgtgaattatctgctggttgcacctgataaggctctaaggtttacagtgcttgaatccactgatcttgtttccaaccattgaatctaaggctctgactgaggggaagttagtgtgctgattggcttggcccagggtttgtaatctttctaatggggaagaaagaagatgggagatgatggggaagagacagtaggatcagattgttctctgttgtggaccactaggtgatctctaagtgggaaagcgtggaagagaaagagaggaaagaggcaatttgtgtctggcaggcttgtatacatttacagatcacctgtttttaatctgagagtgtttatttattggctttccctttaaggactactttaaagcatgaatttatattatttccattattttattttccttgtctcagtattgaattagtctaacattaaaaatttgtagaatttggtgttaaaaaagatcttagaaattaatgaccccttcatttgacgtaagttgcccaaagtcatacaggtaggaagaacttgagctcaaattaaagattttaatgtataggttagtgttcttactatatatgtatcatatattaatgtatactatatatatatcattttccttaacagtaatctatataattattatttaagattaaaaaatttttggcttgtattccaaatttctgaaacaatatttccaaatataaacctgacttagtgattggatttgattagaatagtagtctgcatataaggtgataatatgtctgtgaatgcaagagactatcttagataactgcttggttttcagatatcatgacagaatttatacatgtatgcatgtataggtgtttgcatgtatgcatttatttatttttaatagaaagcaaagggtaaagtaagctgtggtaaatgatattgacacagacaaaacctactaactctactatttttgaaaacctcaagagatgatggtgattttatttttaattttgatcctctaacctctgctgcctaaatttattatgtatatctgagcaacatgggatattaggaagagttgctataagaaatatcttggggtactgaataatgaataaaatgtagagaagtagcagctgtttgcctagctacctcctctcctaatgagagatttacccaggctgtcttaatcacatgttagtgctagtggatttgactgaggaccatggctgtgccagttgaggccaggggatagtctccaggcactttaatggtccgtaatggaccttcaatggccagggcagctggcctggcacataggggtgtagacagtggttgaggaggaaggtttactgacttcatcatgcttccctttgtcactggaggcttgttttcgtacacttttgtctattatcataaataacttatgataataacttatgactctttttctgtcttatttatgtccttatgtgatgactgtcagtcctaaatgatgaagtttgtaataatttgccctaaccacctggtcagttggagcagattgctatctggtgttgactcattatgcccctttatctaaaccaacacttaaatgctcaggaaatatatgaatgaggtgaaggggctggcagcaacctacctcagaaccaatgcctttggagatctatgcaggaggctgtttaatgcacagagcactggccttgctacaggaggacttatgttccagtcttaagctctgtcactttctgaaatttgggagcagtcctttctgcttgatctttcatttctttatcaccaaaatgagaatattacaatgaagaatgactttaatgtcttgtctagtctactgaaccagacacttttaaggtgaaatgaataatatatgtgaaagtagttttatatttgtaaactaccataaaaatgtaaattttgttaggaatagaaactttgacaataaggaaagtattgctgaaggcacaaaaagtgtgtatgctgaagaagggaaatgaaaacaataaataaatgcttcatatatttgcatgtttaagtgatacattgcctctcaatgttggggaaagtggtataataaagaagaatgagcatggttcttgtgaataatgggtgattctgcaatcatgtatcataaagagcagtccccccaacttttttcacatatatgtatttcctatgtatgtataaataaactttaatgctaccaggtagttcactagccctcccatatctctgggggatacattccaaggtgcccggtagacgtctgaaactcgtatggaacccacccttaaatatactataccatgttgtttcaatctgataatggaaatggctactgagtgactaacaggcaagtgggctgtacaatatggacacactagacaaagggatgattcatgtcccgggtaggacggagtgagacagcatgtgatttcatcacgccactcagaagggtgtgtaatttaaaagctgtttatttatgaaattttttcgttttcttttcttttcttttcttttttttttttgagatggagtttcgcacttattgctcaggctggagtgcagtggcatgatcttggctcac

SEQ ID NO: 122841 - DNA, 1095 bp, Homo sapiens
atactatactgttatacttttaaggataaaataataaatctttctccagattggtatctattaatataaacccttcccagtgcagcctgttccttaaccagctgctcataggccgattctccaagcgctgttcaaggcagcagctgaccagccacagaaattcccttaatccgtgttggatagtggaggtgacctagcagctgcttaagtgacagactggcaacagttccttgatgtgatttttcttaggtcattcagtaaattcaagagtagagaggaaggctttctagggtcctcactacccacccagggattgatgactgattgcttcatggtcattggattcctcactgcaaggtgtcctgggattttgtggttcatggaccaatataattagcatcatctggaaatttgtgatgatctgtgatcatcagagtcaccccagatctactgaatcagaatctgcattttgatgaaatccccaggtgatttgatggaacatttaattctgggaaacactgctctaggacaaagaaagctcagtttaaaaagattgtcacatgaactttaccatagaatttcaagaatattgcaaaaggattaatgataacctgaaatacatttccttggatttatatttctttttcctttctttttctttttctttatttctttctttctttctttctttttttttttttggagatggagtcttgccctgtcacccaagctggagtgcagtggcacgatctcggctcactgaaacttctgcctcctgggttcaagagattctcctgcttcaggcttccaagtagctgggattacaggtgcgccaccatgcccagctaatttttgtatttttagtcaagatggggttttaccatgttgcccaggctggtcacgaactcctgagctgaagtgatattcctgttttagccttctaaaatgctgggattacaggtgtgagccaccatgcccggcccctggagtatatttctgatcaatatttacttgattattatttaatattccagacacatcaaaacaacagtactatacaagctttttaaaagaatgctcagatgactttgaaaa

SEQ ID NO: 122842 - DNA, 3832 bp, Homo sapiens
ggatttgcctttctccacaaattataagtttgttttgtaaatacttccttttttttctggctaccataaatcatttgatattttattgtcataaaattctatggcagtcagatttgttgcagacatagattagagatgtattgaagattggaggtgtattccatattgctggtttttcttatattttactttaactagtgaacttttattccttttgagaaatttaaataaacccactttaaaagtccaagacaaattcatgttgagaatttaaaaatatctgaagtatgtctttcaaatcatactcattaagatcagtttactttccgatatcatgtggttcctaatgtagtaagcttcaaaagcaaattttgaaaggctgagcattgttgggactttgatgtgtcatatacttattcagttttctttgtttaaaccaaaaatgtaagagtgttttcattattgtgacttttttcttagcttttgcagttaaagtgtaaaactgctgcactgtgagcctctttaaaaccagaacgttctgtaaatcccaactcatacattctttcagtttcacctctcacttaaaatgacacccatgtcatatctgaggaaaccgaggcatagaagaataaagaagtattaaagtttattcactgggttgtatagctgtgatctcttgatataatgtaagaaagttttctgtagaaggacttagatgactgacgaaaccagatgcaggtaaggtgacttggaaactcagctttctcctctgtaaaatggggataataatacccaacttgacctttccacatgttttttatgattaaatgaagtaatttatgggaactagcactgtaaattgtaaagcactgtgcagctatctggggtgtaatcatcattaagtgccttagtctcagctttttactccttccaaattctctctccagtaagtgcaggctgttcaggatttgtgtgtgagtgtgtgtgtgcgcacgtgtgtgtgtgcatgtgtgtgtgtgttttcactcagccagtcattcatttaattattgtttaacatagttattgttaaacataaacatactagattggccagaccataattttgtcagcacaatgatcgattatccttaatttttttaacttacctcgtataaatccttacttgagttagacccatggaagagtcactattaacattcctggcatttctaactacagaaaaaaatatttttagtcagtttctttagctgtttgtttaactgttggttcaggttttcaactctgtgttgagaataatatgtagctttctagatgcagtcttatcaatgacctagagagggactattgtctctcttgtatgataggagcctggaaatacagctcgagatcctgctttgtctatagttcctgacatgtcaccctgttgatgtgcacttagaatgctgtaactcatctaagcagcacctgagcagtatctgactccttgttgtctctttaggtgagattaatttctcttatacttattacctgctaggaagatactttggagccagcttgctttaaggtttgcctgttagttttttttggttttgattggctaaatatccctcgatccctcaattcattaaaactccacgttctaatcactagcaatcatatgtagctggacatttccaggactgtttttttttctctctctagttctcttgcatctgactcttgattttcctaggtcgtgagatgtagttttgtgtctggcctacccagacggaaagaggagagtctggctgctgtttggacattggcatgtgtgctgctgacagctcttctctttgtgctcataaaagtgaatttcaaaaataaatcaacccctctgccactctgccccctcccacactccctcctactcttttctagcaaaaacagagccccacatatatatacacaagatcacagcccttttgtttttgccaaatatattttagtgctgtacatgtccttaagaactggaaatatgactcatccactaaccaaagctaatgccaacattcccaccaaatctcatatttctagcaatgatggtttgttacaggtttttctggcctttaaggtaatatttaattcatgtgataagattccatatagaaaaagtgtgttggctactaatatttttaaagtgcagtataccaggtctactcaaactggtattaaagacagtgaacatcatgctaaatagggatctgtgctgctcccatttcccctacttgcttttcatggagtgcaggaagagagatgctggaagattgagagcaggaagcatcaagaaagtttacagattgttcttaaagacaaaacaaagaacacagggattctgtgtgtgtgcacgtgtatgtgtgtgtgtgagtgtgtgtatgtgtttttgatcttttacttaatttttagaagaggaaaaaagtcctatggtatttttgacttgtttattgaaatcagcctttgcctttgcgcaaacacattttctagttctgtcaatgtaaaaatttccctctgtgtattcttctcagtctttacactttgatcatatgtatctggtctgtgttccttcttcaaatggtgtttctttttgcctaaaaaggttgtaattgcttttgaacatgacttgtttttttaatcaaaactcatgctgtttgtcatagtactgaaaaaaaaaagtacaagacatcaattcatgataggtcttaaaacagtatttgataacaaagtaagtgaataatacattaatcaggctattttttatttcaattgaagcaaaaagcaaacttgcatatccatgaactaatcttttaatgtcacagaacatttatttgttgctgtttctgaagtctttaagttcccttttataaatggggatagacaatttcagaaccacattgcttgatattttgagataagtgagataagttacatacaactatgccttggaaaactgaaaaaatgttatgatgtttgatatcagtgtgaactctgaatagtttgtaaacttcacactccacattagtgcaaatgtgttttgtgaaaatactcctaaagaaacgtagtttcacataaaaggtttttaaagtttcatgaagattctgttgtgggaagtatgtttattttccttttgtattcttgtgggaattcttttgatctgtatttaatattttaataatgaaaactaagtgtatgtaattttaaaacttagtttcgtgaggttttttttagattgttgaggttctgggaaaacactgggcctgggatctaaggatcacattgatcctctcgtggaacattgccatttccccacttaactctggttgaaatttttggcattctccttcgtgtgttgataatccataaaaattacaagtggcttattttgtcacttacagttgttttaggatcaaattaagttgtcctaaatggaataatccgtgtttccacttgatatgattattgagctctgataatgaaaatgatgaacagggcagtgctggctgaatcctccaacaggtgtcattctaggaattgttttaataaggggaattcagaaacaaggcaaaataaaatagtgcgtagtggagttattgtttgtatttattttgttgggaaatgtgaaagatgtaagtatgtagtcctctgtgtgaatacacacacacacacacacacacacacacacatcttaacaatgctaggacttagttgtagaaacatttaggttagaaagaaggtaagggcatctagagatggtatcaaaactccatacttaacatttttggaaagagtagtgaaa

SEQ ID NO: 122843 - DNA, 2346 bp, Homo sapiens
cccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtgagtggccggggggcgtccccgacgaacgcctggagtcctgggctcacgaggggtgagccaggtccccgctagggctggggacaaggatcgtggggagctctctctgtccgggggtggggaacacagggtagagggagggctgtccccagagttcgtgccaggtgggacgcggggcacccattgttcctctccgaagcttgctcggggctcaggctggcacggtctagccggagagtgtggggacctgctggcttcggcgtctcgcgtggcctgcgccgggctagtggggaagagagaaagaaaaagtagttacgactcccgtgacggcactctgttgcttgtggtgcgggtttgttgctgtctgccacttgggtgtttaaacaaattccctgggaagccattgtcagaaatgtggagattcgaagggactgacctcggcgcgctttgccaggtgctttttgtcccgggaataacctcccctgactattgtctaactacttccccgtccctcccggagtccccttttctcctcccccagctctgggttgctcccgggcttgccctgtgcgctcgggcactgcttggagcatgttctgtgtgtgtgttggcggagccctgtaagatgtgttgaaatgcggttctaaggacccactctgagcgttcatgggcatcgaggtctgggcgcctggtggaggaagcctgactcgcgcgtgggagcccgctcctcgggcaaaaccaccgccaggctggccccgcgctccccggatccggcctggggctctggccccgcgctccccggatccggcctggggctggaagcggactgtaaatgtctgccttctgccggagaacccaaaaggagacaagtggagcgtctcgctgtagccctgggggttctcggtcaagccgctcagagaagtccgtgaaccctggctctcccggtcccgccctctgttcccctccagttttgttatccttcgtgtaggttggttgcttctttcgttctctcctctgggggctctgaagtttcaccaggtggacgctggggagcgggctcccgagcacttgtctacctcccgccagtcctgacaacttttctggccaacctacccagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactcaaattgttgttttctggagtaatcgtttatttcccttccattgctctcctacccccgccccatttagaactctgtaaagggagttaaacaacagattcaggtggcagcatgtgtcgtacattcaggcagagattatgaaatggcagcacgcagaggaaaagccctgtatataattgatgtacgcagagggtaacagctctatgcaaaaaataatccaatggtttaattgaattctttctggagtaagcattactgcatgcatttctgacatataatgcccgttagcattgaaaccgtgcttgatgtaactcattatatgcaggcaagttggagtgagtattgatttctgcacagtgtttgtcactgcacggagagcctacgcttgaaaaggcttgtagtttgttaattgaaagtttgaactctaccagttgcataattaaacttacatgtattcaagagttgcaactattaatgtctcaacagcgatggatatattttcagcagttagaaaactttttctctttttaaatgttatttaccctttaattaacaaataaatactacttttcctccagctgaatgtgaaaatgagcttttctgatacctggagtttagatacgtacaataaacaattgtgttcttagatatctagttctaagtactttaactaaatatgcctggcttttctttagtgacaaagcataacatttgacatgatgttgtatatttaattaatataatgtgcattcctaaaaagtacagtaatcacaggattgcatctcaagattttgccctttaggaatgtatgcccagaaatgaatgtcttttattcccagagtttaaag

SEQ ID NO: 122844 - DNA, 1034 bp, Homo sapiens
tatgccacatttttggtctgttagaggagcatgaaactagtgatggtcaggaaatgattcagaaagcaagtcctaaggcagttgcaaagctgtagaaggaaagtcctggaaagctttaatgttttgggcttgcaaatgggtctctttgtcctcaaatgttttaagaataatttttcagtcataatttgtaaaaaccaatggcatttttgttgaaaatattttggcctcttgaggtggacttgcagaaaatactgcaacagcacttttgtacccccactaaccatttcgatgaactcagctgtatcatctcctgccctcacccactgtttcactcctggttactgccctctgttcttagcatatatgataccctgccatggctcattcgttctcagcaaggggacaaggaactcaagaactggcagcacgagagcaagttgcctcaggccaggggtcagacccggctataggtcttgccttgtctcctctccactttctctatttctttggctctcctgacaatttctcatagcttccctgtttgagcacacattttgcttttccccttgcatttctattgatcatccagaagctgtttgctggggcctttgcaactcccagcttgcaatatttatgtccattctcttgatacctatgtgtatccatttccctgacattttaaaatgtgtttctcctcagttttagctcttctcctgactactactttgccctgtccctagatatcctgccataattaatgttgaatgaaagaatctaatcaaccaagactggaaattcatacagactttgaaatggggacaaaatcttacatttgtttctagtgtgtccccatagatttgactatcacactttggggcatcagtggcattaagtgacaaattacttctgggagttgtaggatgattctatgtcaagctctccactcagatccaatgagtcactagttcctacttatgaacaggtattaacttgcttcatttgcaaaccccagcaagaattttggtcacaagcca

SEQ ID NO: 122845 - DNA, 1003 bp, Homo sapiens
aaaaatacaaaaattagctgggcatagtggtgtgcacctgtaatcccagctacttgggaggctgaggcaggagaattgcttgaacctgggaggcggaagttgcagtgagccgagactgcaccattgcactccagtctgggcgacaagagtgaaacttagtctcaaaaaaaattaaaaatacaaaaaaaaaaggaattaagattctttattcttaagaaactgttaggtgtaactagataatacatcaaagtataccgagttcattagacaatgttattttgataaggaatactctaaattttctgaaagaaaaatggctatccatttgtttttcttagcattttagtgcctgctatgtgctataccacaagttaggttgcgatgatgtaaaaatcaattgtatgtgcatttccacaaggagattggatttagatttgtgaataggattaatggggaatgtatccctagcaaatgggctttgatttgagggaagcagaatatgggtacaactgattgtatgggtaaaatgtaatgggaagatagagaaaggacactgttagttgggtaattgttaatggagatagtggtacttaagctggaagtgcagttagaatattgaagactagatcaggtcagaaatgatgaggctcagaattagggttgtggcagtgaaaagtgagaacggggcagacagatgttgcagaatgaggtcaaaaggatttgatgattccattggatggagagaagtgagggagcggagtttaaagacgtttagaagatgatggtgcttttcactgactcccagaactgggagaagtactgatttgaaatgaagggattggggcaagagaggggtaagtattatgggtgtgaaaggagagaagatgaggatatgttgagcttacagtgttgaagaagctgaacagttagaactgagacatcttttaggtaagatttctttgaaaatgtatatttagaaaatactttgcagggtggtgatatt

SEQ ID NO: 122846 - DNA, 1041 bp, Homo sapiens
agcataatttaaggcaagaggatgacaatagacaaattgcacccacttcaaaaggagagagtgtgtttacactgagtatttgttccaaggagctgagaagcaggcaccatgccctgatgggcccttcacactgggttgctgtcactgctgaaagagcagcctgtccttgtctgctgtactttcatcttctgccatatttgtattcatgtgcgctatcctcccacataaaagagcacagcttgctattcctgcctttgcttctgtgacctgcagtaaaaccattaaagatatattttaaggctttttacatggaatggtaattatgcacaatggtttttaatcatttggcatctagcatggagccttcagagagtattatgcctcagagagctgcagcttgcgtggatcttgggaggggcccttggtttcaggggctttgtgttctgtgtgtgtgtgtgtgtgtggcaacaccaggtagtgacaacagtgtcacctgggaaacagaggacacagatgactgcttggtggacttgaaaccagctctaaacagctgttgggttctgaacaaaactccaggaaaattgttcgctgggtgagctggtgggatgaagagactgggatgggctgagggtggagggccgaacggataccctgcacgttatttgtggtgttgtcaagggagagtttagagacatcacatgaatctcaccttgctgccaatttggttcatagaaagtcacagctggaaatcttcttagaagagaacatcttgttctcaagcccctcattatacagcggaggagactgtggcatgcagaggtgaaatgacttgcctgaagtcagttagctgcttggtaaaactagccaagaatccaggccttctgattcccccaccccagcaaatagtgtcttttttttttttttcatttaaagagaaaaagggtggatatttattaaatagggggaaagaaacagtaaagtagaatgaacaaagtataatcctattatcaaggcaaaccactgttaatatttttatattca

SEQ ID NO: 122847 - DNA, 1024 bp, Homo sapiens
gtgagaataggggagcagagcattgtgatttggcagctcctagaggaggggagtaggctgagaaagtcttggtggggggaggcagtaaaaaaaaaaaaaaaaagagttacgacttcacatacttttggtgaatctgaatgagtctccttttgatgcgaagtaggtggtataagagacttttcaaataatttaactgtccaccaacgtagccttctcttcaggcagtttgttttgcttttaaattatgagagggtaccaccctccatcctcggtgtgaatattctctaccagaatgcaggaaaaacgttacctgtgatatgtgatcttccttttcattttaatgggcacattgttgccactcagttctgaaatagagaatttctccatcttccacttcgttaactttgcacaatatattgaagaatatttaaaatactaaaactccaggtgactgtagacacctaccatataagaaagtgggaatgtcaaaataatgagatatccatgaagtgataatgtaagctctcttaggtttatttccttttttaaaaaagttgaatttagaccagagaaagcttgaacctgataaccaaattagcacacactgtagtcacaaataaaattctgaggaggtgttttggagttgaatttaaggggaattttaataaaaactgtctttatttcagtccagcaaagtagctttatgcaagcataagtgcctgaggagaaaaattatacaaagtataagagataaatagatacaaagttgatgtaatttctacttgcaatgtgtaacagggattatagtgtgccaaaattatggtgtcatagtgaatatatttagcataacttttataatatttgttcactctagaaaattaaggcaatactgaaaagtacaaataaaacaataaattgcctataaaaccattgcttgaatatagcttcattaacattttgatctatattattttagttatttttcctgaatttatttatttttttttttgagacgtttcactct

SEQ ID NO: 122848 - DNA, 1536 bp, Homo sapiens
tgtgatgttgagtcttccaatccaaaaataaggatgtttttctgtttgttcaagtctatttttatatctttcaagagtgtttaaagttttgcactatagattttgtacactaattgttaaatttatttctaagtactttatcttctttgttgctaatgttaatggggctttgtctgctctgtgttctccaactgattatcctttatgtaaatgattgcagcctgcccacacctccgaggctggccctgtggaccagttggccttatttcttcagtggaaatctagtcactatgatgtggtagttggcgtgttgtcaccttgctataaccataaacttcaaaatgtgataagcagctggctgatcattggatacaacatcctgcattaagtcaacgtgtgcttgtcaaattcataatagatgcccatggctgctaagggcctgtggaagaccaggaggatccctactactcaacatcacaaatccagctttgaatcaggaaattgaggcattcagtctttctgaagacacttcatcagggttcgctgaggaccgagttgtcagtgtgagtttccaacttctctacacgatccttattaccagtcttggggtgttctacaatgccaatgatgtgggtttccagaggaacgtcgctctcaagctttctcaggcagaacgggaagaggcccccttcattgttcactagagtcctccaagccatggtgtgcaggtgaacaagttgtgtacaagcacatggaacaattcatcttaccagagagctttgaaggtacaattgtatgggagagtgaagacctccacaactttgtgttaagaaatcttcacaaagtgacactgaatatggaggggggattcttggagtcattacagctggggagggtgcattgcctcatgaattattggaaggtatggagggagttggagtggttttagatgccttattgaaggaggaaaacatcatctatgatgatattgtttttgtggatgttgtcaacactcattgaaatatacctgcaaaattattgaactttatagatggactatggaaacaaccaactttgatttgttgctaaagacagatgatgactgttacataggcttgaaagctgtatttaatagaatttctcaaaagaatctgaataggtctaattttgttggggatatttcagactgaattgggtagttgacagaaccaggaagtggcaggagttggagcaccctggtcatgcttaccctgcctttgcatgtgggtcggggtatgtgatctccagggacatcatcaactggctggcaggcaactccaggaggttatagacctgtatgtctatgtatgcgtaagcacttggatggcagccacaggacctaacagttaccagcacagcatgtgactgtgtgagaagacttgtcagacaggaatattgtcttccccacagtattctccgcaggagctgacagaactgtggaaactgaaggaattctgtggtgatccttgtcaatctgaagcaagataacaggatttg

SEQ ID NO: 122849 - DNA, 1491 bp, Homo sapiens
gctgtgagcacggccctccccctcaccgcccccacccccaacgcctcgcatcccttggcccgcttctccacctcggggccaccgccagaaaaatgcattcgagatcattcagagtgcacagaaacaaaaatagatttttaattgttaggttaggggaaactgagatgagaaataagaatttggggtgggggggcgcggccggggcgagtgcgtccagttctccttttggttttcctagagcgttgtttgtgatgtctttattggtttagggagtccgagaggctctatgctggctatctcggtcgcgtggatttttgcgcaagtttttagaaaaacactgactcgagtagagagcatttctccggaaagtttcaagtgcagcaaaatagcgaacgtgcaaaactggccaaggggagacctctagtggttgaacgcgtcttttaagttcggaaggccgagagcaaagtttggcctttactcgtagctacgtagtccgttcagacgtggaagtaattagaggacctgagcgagcagccagatgttgtgtgaaaggatgctgatcagaaattgaaagtttagtaaatcgaagcaatgaattctgaggactcagaccctgtaacttccatccgacatgagttatatgggaaagacactttgcttttattcagagatttgagattgatcgctccctgaattggaaacaattgtttgcttttgcatttatcggtgtctgtacctctgatcaatttttaattaacgagtctcagctgatgactttattttgaatgttaagaaaactgctaagttgaaatgtgtttaaaactttgaagaaatggaaaagacctttagttgagatttgtcttttatatgagctgttcattttactgtctgataagtgtaaggcaattttatatagtttcttagctgtatagttatgtatagtccgagtaagtagtcccttttggttctaagactgtaattttgtttcactgagtacgaaattatttctgaatacttgtataatttgtgatttaaagtccttaaatacatgggcaaaaattttatgtaatatctattctttttccagtgtgttttctgtaaaatatctttaattttaaagataaaagcagtgagggaaattaaagttgactcaaatgatccttgtaactttcacctgcctgtcatatacaacaggagagacgttattgggtgaatttaggacatgggaatgatacgaatgattaaaatccatttcaactcatctagaaccagcttattttattttaatttaccgagtggcatggtgtaaaattatgcctaagtgattcagaatgtaagcttcttaactggggatggtggatttgaaggtttctttttgatgacagtgttttgattttaccttccctctctttaaaccaatgctagaacccttaggagaaatcttgagagtggacagcaattgtgaagatcgccagagagttctgtgtttca

SEQ ID NO: 122850 - DNA, 1011 bp, Homo sapiens
tgactactttaggttgggttgtcagggagccctctcaaagacgatggcatgaacagtgtgatctgatgaatgaagaggagtcagctatgtgaagttgagagtgaggcgtcttctgggtagtagaacttccagaggaaagtccttaaggtaagaacttgcacagcatgttttgttcgaggaaataaaaggaagtctggtcactggtttaggagagggtggagtaagatgaagttgaagaggtacctgtggtccagggcatgtagggttttatggtaaacaagagtcgagggtgttcattgtattctgagtgtcaggggaagcctctggaaagttaagacaagggaatgctttgatatgatgtatgttttaaatgaccactgtagccctgagtggaatcagggaaaccagttaggagtttattgcagtagacaacgtaagaaggctgaagatgatggaagtccgtggatttgggaatcaatgttagaggtagggttgtcagagtgtgtgaggaaaagagaaaaatcagggataaaactttggctttaacaattggctggataatcctgtctcttactgagaatgggaagatgagggtggagtgcagaacacagagtcctttggccatgatgggtttgaaatgctgattaaccatccaggtgaagatcccaagtaggcatttgtctacagccacatggagtaaggaagaggaagctgagggtgtggattgggagtatctggcctatgtaagatgaccttgaaaacccagggaaagggactagaaagagtagagaagggaactggattggaggagacatcagcagaggagacaaagaggagccagtaaggcgtgaggaaaatcagagcagagcggtcacgcagctgagagcagaaagtgtttcaaggagcggggagcggtgtccatgcccttccaaccggtaacacgtggatacagtcttattttgtaataacctcaggccaaaagcaacagttttcagatgaactatattctta

SEQ ID NO: 122851 - DNA, 1070 bp, Homo sapiens
tttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacagatgctttttacatatgtatgatttttaagaaagcttctcaaataggagaggcagaacaagaacaggaagagcatcaagtatttggacattactagctatgtaatgaatctgtaggattcagaattgtcaaactgtgtcccaagatgatgacaaaaatattgaaagattatattgttaggtcaagtccaattcatccccattgggaatttttttcaagtgtaaagcatagaactaaagcatagtttaaatcatgagattttaaacatcttcttcttttttttttt

SEQ ID NO: 122852 - DNA, 1074 bp, Homo sapiens
aacacacactgaggtgtttagaatgattttttaaccaagtcctactagatagctcataattatgagataatgtaactataatttgtaaccctggttataattagctttgtatctgggctgggaaagccttcattagagttgtatggaaagtccctgtaggtaaattccaggcagttagcacagaaaggcttcacctgttgcctttgaggcaggtctaggtaaatgctgtagtgtctgaagacacccgtaatcagaagggattcttcaggaaagatcattgtaaagagggatggctgtacttgttattttaacttagtggaatttttagtgaagcttttgaatactacaggagttagattgttatatttggacttgtgtagcttcagaattttgacaatagctcattggccagaaaaggataactactgacatatagagggaacggatctgaactgattggttaaatgctgtacttctcatgatgactcttagcataaaggaaagaaattcatatttagcttaggaagatagataagaacaaagataaaagcaaatgtcaacttttacatttcttaagcaaaattagtagaggataaaaaataagcccttgtagtcatacacgttacttatcaaatagagggtagaatttaaaagaggaaaaataacttgtgcagcaacagaaatccaaacctgcaatgagatggacctcattttattaaggaatgtatatctgatttacagttttatcaagcagatccacttgttcctggacttacgctatgttttgtctgctgagatctgatatgtgctcaaacactcagaaaacatcagtgagtgcttattgtggtgtcatgctagctacccttccaggccttttctatgggcttataggctgatggagaggggactgataaatgtaccacagatcacctggcagctgaggtggtctgagagcagcaggggaccagtgcagactgggaagcagcatagtgggttgcagagggacctggatggggagttgtcatcttgactgagtcactaattaggtggctgtgggtaagtggctaagttcct

SEQ ID NO: 122853 - DNA, 1049 bp, Homo sapiens
gctactctgattgtattggactaaatcatgtgcccaaccctgtgtatatgtggttctggtgctgggatgaggaggaggaggctggtagggcactatgataggcagttctgtcaagattacatagagttgtggttctcccaagaaaataatgctgccaatcaaaaacaatagtctattattgggaataattccttccttttttgggacagccctctgcacaatgatctggagtttgcacatggaagcaactcaggtgcccaagacaatgcgtatcccaaaagtgggacctttctcccaagcaaggtatagcccagtgatgaaataatgccctcatgtttaaactttattaaaaggaggattgtttccagaatgggaaacacccattctggaatgaatgggaagccaccatttattcatatctatgtacttctagcaaatatccctgtgccttatttccagcccagagattttgtttccaaaagccctgcccatctagtgatgatgagattggataccccctactttggccattgtagagccagtgaaagtttgaacagggagctgaagtgattaacacagaactattgtttatgcaaatacattgggttgttggaaatgcacagaggggagtggcaggcacagattaggattttcatttaggaggcataagatgataggtttccaattagagtaatggcagcaagaatttgtgagcaatattatgaagttcttatgaggttatatgtcaggatgaaggagcatctttgttgacagaagcatttgtggaatgaaataggccaggagggagtagactaggaagacatcctgggccagtaggtgaaatggctatgcgtggtagataggttaatagcaaatagattgtgtagacaggaggcctgtggtcaccatgagtcctaggggcatgtatagaactgacatttaccaaggatctacttagtatggtaggttcatgttgcatactttaaagttattatattaatgtttatataaagtcagggaggtaaataacttactgaaggttatgaggc

SEQ ID NO: 122854 - DNA, 1059 bp, Homo sapiens
ttggctcactgcaacctctgcctcctgggttcaagcgattcttatgctgggactccacaagtagcctcccaagtagctggaactacaggcacacatcaccatgcctggctaatttttgtatttttagtagagatgaggtttcaccatgttggccaggctgggcttgaactcctgatctcacacaatccatctgtccttgggactcacaaagtgctgggactacaggtgtgagccactgcacccagcaaaatcacacaaaacagtatttttatgaaaatactaagccttttctttgaaaaggaaagagataatatgttccttatactctaagtattaacagtaattttaaattgtattcaaaatgctaaaattgaaatattgaaaaataaaaaatacacaagtataatcatcgtcttcctcacatacatttttttttctccctggttaagtaggaatctctggaaagtccacattttagataaagattttattaatatcacttggtcttatcacactttacttgacttgtggaaattccttatttattttgtgagtctcccaactctcaaactaacctctattcagaacttttcatgcataattgaatataagacaataataacacaaaattaatgatgcttgttaatgaatatttagctcagtgtcttctgggagatctattcaaatatacttattaagtcatcagacatttattgacacatactgagtgctggccattgtgttccatgctaagagcataacaagcttttctcaagaaactcaggctagagagccattgggtaatactttaagtacttagagcaagggaaagagttttgcaataagatgatatatgggactccctgagtctacgttggggtggcagtaatgaggagtgaaattgtgaattaattcagtaattccttaaatctggtatttggttaagtgatttgaaaagacaggttacaaaaaagaagtcaaagttaaaaaggcagcacatgccatccatctccaggtaacaaggccacctgcatcccaattcttatttctagagatacc

SEQ ID NO: 122855 - DNA, 1010 bp, Homo sapiens
tcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcgga

SEQ ID NO: 122856 - DNA, 1965 bp, Homo sapiens
cccaacatacatcttactgtcataatactgtgtacttcttcacctccatgcctctttcctcattgtgtttttccacctgaagcaccatttccattcgttttagcacaaagaaaatagactttgactttccctttccctgagtatagctttaaaacctaccttggtttctgtctttaaattcttacatatgaattgtctctgttttatgctaataaattcttttgcagtgaactcttatttgccagttgcttctagcgtacttgtcaattctccaggtattttaaggccctcgagagtggaatagtgtctcatgcttgtcttctggtaaacatactatttaatgtaagactaggcagacagtaactgttgattacttgattgaaaacttgatgaatgttacttaacatttttttcaagcctgtgtttttggaatatttaagccttctgttttttttttttttttctcttctagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaacttgtcacttctctttttctaaagggttaaaaaaacaaacttgagtgatatttttcatcagaagtcttagtattttgtgaaaagtagcatttcaaaatctgttttcagctcttctgtaatttgatgatgctgccaacatcactatttgaaacggtgaaagcgacgttgaaagtttgtaaatctaatgttgagagtgccagattccttctgcctggttacataatccattccagcttttacg

SEQ ID NO: 122857 - DNA, 1008 bp, Homo sapiens
ttgagaaacgcattgtgatcacaggagatggagatattgatcatgaccaggtaaataagttaagttctagttttggaaatggccctgtttgttttctaagtttcacatttgtcatcatgtcgcatacctgtgtaaacctcttctccccaaacctcctggatgaagtccacctcctaagcaggacataaagacacagcctggatacaagctttcctacctctgaatcagaataaaacacagatttctctttatttcccactggctttacatgcacttttgggtcaacgtaatctggaggatttctggaaaacataagattcgtgtgggcctggtttaaaggcaagtgatcaaatatttaaaaatgaatggcagttcaatgcaccagtttccaaaaaatgaagaaagccactaagcttgacctatgcctacttttaggaacttttcaagtatatttatggcattagaaaagttgagctatttacttccaggtgttttctcctattgcgattattgggggaggggaggtaatacaaggtttcttacaaagtgaaaatttacattgattctgaaaattttttaaaagaatcatgcctccattctaatgttaaatttggcagcatgcatggctttgagcaggtgatgaatggaactgctggagactttgagagcagttttaattttagactgcagtcccaagtgatgctgacaatttttttaaaagtgattttaactcagctttaaaggagaccaagctgttttccttttataacaacttgaagaaaaggaaaagaaatattcaattgactatctcagctggggagtaggagctaacgatagttacacagctttggacacaatactgagctcaggaaagaaaattttagagaacaaaattcctcatttgagaaaggcagcctatatgtgatcagagataaatggatttttcatgcctaagaagaaaattactcccaatttttttgacctttgtaagtatgatttgacttacat

SEQ ID NO: 122858 - DNA, 1030 bp, Homo sapiens
caacaacaatttaaaaaacagcaaaagtaatttgtaaatttaaaaatgccgcataaatgcaaggtactgttggtgctcattttaaagcatatccagttattaagcatagtgataagcctggtttgttatggtaaaatgctgtcacttgtgactgagagtgtacatttatcagagttgtaaatgttggatgtgcgctttcccaggaccgtgtggtatttgcttattgactgtttagaaggtcacagccagatgatctcctcagcctcatccagtgtgccccaggcactcgcagcttgtacggagcccataacgctgtgaggcagttcccccaggagctccctcctccagccccgctcgcagcctttgtctagccatgcgccatgtctacgtgtatgactacttacgcagggtgtcatcaaatcaaacattcaacaaaaatctcatccatcttccgtatctgaaaccaaagcaaatcctttttaaaattattgcactaaatgcaataaacaaaatcagcaaataaatttgtatgctcagaatccatcagtcaaaaccatcacatcatacagaagtcttctgtgatgggaaaaaaatatatatcacatcaaacagtttctcaaaccaaaaacagatacctaaattcttataatttcttgtaattctgcaagtaactgatttctccctactctcctttttaaaaattggccagctaggagtaaagaaactcgggaaactataacagaattcccttaaaggaactacttggattaaataatatctgtcctatcttaatcaagtgagattaagatgggacagatgccatcttgaatattgataaatgagttttaaggttgctctcagctgagggatacttgtggatgctataactttagtaataggattctctattgagcctaaaaataaagcacaaagtgtttctagaatatcagtcttttgctgcttgttgtgtgtggccttacaatgatccacaggtctaggtggactcccatctctgtttgctctgactgtg

SEQ ID NO: 122859 - DNA, 1318 bp, Homo sapiens
gaaaattattttggatatggcatccttgtgtgtgccttgatcccacataagcacaaataggtttcttatgaacagcttggcgggggagcattagtgatgtgtctgtgctgtgataagttgccagaatgaagacatacaggtgcatgacccaagtttgaaagagatttcctcttacagtcagaaaggctctggaccgtccagttatttcctcgtgtcagtgtcaggaaacagagggcaaatatgtttcgtgatcttaacataaactgttaggctattaatttgcttcattgattccccttggaaactctagaatcttctgcatctttcaatatcaaagcaaacaagttaaaatctattttaacatatgtatgggatttatatatatgtaggagcacatgcgtatgtgcagtattgaaatatatgtgcccgtatatatgctcacaacatgcaaactattacaggaacaatgtagttgatgaaaacaatcgctagaggtaagcagataaccaaatcatgcagattcagtttgtcctggtcaggttctgttgcttggtaatttgataaaatgtttatctatttttacccacctgtgcttaaaaaacaacaaactcagcgcttctggtcactgtggaaacttctctgcctggctctctagtttcattttctagcttgtgcaaaagtccttcagacaaattctgtcataattcccttgtagctttcagtcccacctactatgtccattctcctctcttttctccactcacacagttgagtttgcttctccatgtgcacctagccttttgcctctactcggtttcaaataccagccgctctcctggatggtaattactactgcaaacacgcaaaccacatggattttaaaagatgcatattcgatggggcggggatcttctctgacaacataacagaagttaagcattactttgtatttttcccccaactatccaaagattgatggcggggctggtggtgattcgggcacgttactgaccgcacaaaccatcacatctgagtccgtgtcaacaacgacaaccacacacatcaccaaggtaaagcaatgcaggggatcatatggagaggatggtacattacagacagaatcttttctgaattgtttctctcttcctgtacacacttccaagtaagatacagacagtgccagcggaatcaaaatgccttggtttaaagtatccaagaaattaggctccattgacaaatgcattcaagccaaattgcaattttgtgaagtacaagggggtaaaaatatgttacgaatagctatatgtaagatagctac

SEQ ID NO: 122860 - DNA, 4225 bp, Homo sapiens
agatcacctgaagtcaggagttagagaccagcctggccaacatggcaaaaccccgtctctactaaaaatataaaaattagctgggcatggtgctgcacgcctataatcccagctactggggaggctgaggcaggaaaatcacttaaacctgggaggtagaggttgcagtgagccgagatcgcggcacactgcactccagcctgagtgacagagcgagactccgtctcaaaaaaaaaaaaaaacctgaatagtggggtttattaggaattattctcacacttctgacatgagggggtgcttcatgatgactcttgaatattgacatttcaagtttctaaggacagttctgctgtccctcaggcaggttgggagccattgtttaagagccagacacagcaaagttaaatttgctttaatggtttaatttagggagaaataattttcacgttgctcattgagctttcaactctgagtttgtcttcctattttgaattgtttttctttacctgtttctttttgcaaaaaaaggggacagggtaatttactctgtggcatatttagcacgcctgagggaatgaatgtgggctgctgtcagaatgtttgttgtacagagagttaaggtggtattgaggagggagattgtaggagttggagtggtgagggaaggccttacagaaaatgcagactatgaagtgggcctcagggaggttagaaaactggaaaggcccagaatgtgcagataagggcaaagaagggccttggaggcaggagagggaggactgcccaagctgtaacacaggaataagcatttcaagtgtaggggccactgaagaggccattccgtgcagagaaaggccaaggaactacctcaagaatatatgaaatggcgtttgggtgggtcggttgtgctcagttggtgatcagccaagcagttttcactggtttctggaggtcgcaactatcaaagattctcaagcagggtggaaaagctggcgctcacaaacctcttcataagcctgctccagaatctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtcaaagaaaaaaaaaatctgcctaaattcagagaataatttaaatcattaagttccagagtctgggctgttaagcagagggaaaccctcaaccagatatgctttgcagagttgacattttcaaaaccccaaatttcaggcatcctctgatggcatgttatttttaaaattctgtttatatggaaaaaatctgaagtgcctcccatgctccatgacataattgcttttgaatgaccctaaggaattccctgaacttgggcagaacctatccagctaattgaggttaagatataacaataataataattcactgatctataataataatgaaatgtgtgtttcagaaatgttctggtcactggatatgtttattatatgtagtcatggttaaattttacctgcttatcaaaatagattgagagttttttcagtttaatatctagaaacctctgagttttcaataaaactggaaagatagctgtcttctgttagtaatgtgatttacatggtattaatttgggtcaatgaaaccatgcccttaccatgtgtttaagaataatagggcaggtccaagagagtttgtgagtagacgttgacagtgctgcagagacgtgtgtgtgtgatgttaggatcttcagctcatggttgtccaagtgtctgggagagatgaactcagccctgctgtctattagaggctccagtccagttagtaccttggcagcttcacaacaatatccagagggctcagtggtgtggtgcccttctccatccagaatggagtcactttcgtgaataaatagggctcctggctctagctgaattatttttaagttagatcataggcagtagtaccacctagaagtcaaaaagttggccatgcttgagttatatcattgtaaagcagactttttgtaagtgtgagaaaaatgtgaagctttaaaaacccctctgtacaaaaaggtttccaccctagttaataatatcataacatagtaatttgttcctaatgtattaagtcaacagatatttattgaacatttaggtgctatattactcaactggagtaaattactttactcccaagaagtagatgtctgaaggggataggagtgaacatgtcaaataataaacttgactgagtttagatttcaaagatgctagtagaggagctaaattgtaaaaggaaacacttggagtcaccattgacacccaccctattgtataatatagcctttgccaacctatgatacgaattggaaagttaataaccatttctggaatgaacattttcatgttaatagccttctgaggctaactataattttgccaattaaaactttttttttttttttaaagaaaaccagcaaaaaataaaagtgccatctccttggtgctgtgttcatttaagaatcagcgttccaggctagactttatagtctgattaaaaccaaaactgttactaggttttaaaagttaaatttttttctttaaaatgatgagtcagctttggtataattcaatttttgtaaactgttttaactacataggtagagcttataggtatatctataataaaagcattttacttctttgggaggatgctggctgtttttgtgtctttttgtaagctttttggcatttgtcttgattgtcctctatgtgaccttgagcagaggtttctgtagatgttgattcttgctgttttgtctttgcagtgtcagatgtttgtttcagtggttgttgaggtaaaactgtattgattttgtgtcctcggttgctttttgttctgcagacacgtgctcccgagtcagaagggccttgcactggagccagggatgctgttaaggttctcccctttttccatgttaacaccattgcctcacgtttctcattgccctcacgtttgccccgcttccctttcagtcagccatcataatcatctttgtttttctccatgacatgaatctgccatcggttaatttgggtttccgttgtttttatttattcatatatttttgttttccctcatccatctttttttgtacagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagaggtaaatgggagtcccaggtgggagccaaactctagagctgcttctcagatggggaactcctgcctttcttctcctgtcc

SEQ ID NO: 122861 - DNA, 1134 bp, Homo sapiens
acaaagtcatagtctgagtttcaaatccaggtactggaaggaagtgttattagccattttgatgatcagttccatgtcatctttctgataatgtaaataattattcctttaaaaatcctaaatagagaagaaatcagaaccctttaaaatgtaaatcattgaagaagtacgcattgactttattttcaaattttgatgaattcatgaacttactcatagataataatatggctttagagacttggcatttttcttgctttactatggttttttttttaatcgtaagtttgctttgtcttattttttggttttatttttgtcctactgggttttttccttttggatttttcccccctttgttacgttacatattgctaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaaggggtatgtcattagctatttgttggctctgtctcacttcagttgctcaataaaacttaaattgttaatctctatgttgagtctagggaagttacaaaatgttcccatttaattatttttatgtaattactaacaattttgtaaatactaaatattaacaatgtaatagttattggcctagttcttaggtaaattgcatgagtttcaaaatacttttgaaatagttttaggataatttcactattttactcaggtaaattgtagtaatgaattgttatataggacaatttagaaactaacatactgtatttaataagctttttagttactgatatctgaaatagggacatttacttagtataaataattaataaataaagaaatataggctatctttagagtggtttaaagttattactgtgaggaaaatgagtttaacttagctttaaagaccgatgagccctgttgaaagcttgaaaaatattatatataatatgacttagtattgaaacttccttataatgaaatgttagaattgtgttttaaaaacgttttttcaatcataacatttctcctcacttactctatttcttttcatggtttacttctccc

SEQ ID NO: 122862 - DNA, 2933 bp, Homo sapiens
aaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggttggtaacactggttcaccatttaagttcaaatacagcttctttgcactgatggtagagtttccactaatactccccttctttctggccgtttgctgtgtgacttttcaggcgaagatggaagaagaggaaacgcagctggaagaggtggctgagttttccctaaagttaaacatctcatgactgctgcctgccattagtattgtgtggggagggtccactctcagggtttatttgtgagttgtgtttgttgtggctttaagttcataagatttgtattcctcttttattttaatgtcttagactgtcgaactctgggtcattttggtgcttgctgattgatacacttatgtttatttgccttttcccccctgtgtgtgatttaatttcacagaaaaattccttgagagtagaaggggataatatttatgtcagacatagcaatttaatgttggaggtttgtataatctaagaaaacaactctgtcctaatggctgcccggctgctgtggacgggaggtcacgcctaggctggctggcaatgttcttcaagcacggtgcatgcagtgcatgggggaattcagctcgggagtgcatgttaccagcctgacggtgttcctttcaagtggcttaggcaggactgtatctactagaagttctcaaagtgacaagtgggaaaaaaaagtttagtcaaatgaatcaagtttttatccagtactcttgaagttgttctacaagtaaacctattctctcctaaagggttaactctagggcatcaacctgaggtaacacaatctcatccttaatatgtattaactagaacagagatttgtttattgatctggcattaaatcatgtgactcttgatcttgatctgtgcccactttttttgttttttttggttaaaatccatgattgggaatgtggtccactttcagtattctgtttgagaatatgctaattaaagaaattattttaattagaaagaacaagcaaaagtgagagagaaggaaaggagaaaaagaaagcccaatcacccaattatgaatgtaaagtgtaaaatatgttccccgtgtcacgtgagaacatttttttttcccttcttattttacagtagtatgtggcaatgtattcaatggagaactgcagctctcagtaatctgactaatctgtttggttgcttttggcagcttggtaactgatggaaatgtatttttgcttaacttactaaaatgctgtacagtgtaataagtaacattgctttgaaccaatgcaagaaatgtgcctgatctcaagccacagtcatttttccatgccatgcaaagatttttagattttcatgagtttttgcaaatggctatagaagctcatagatgagctactatgcttgtgcatgaatatggaatatctaattttattggttgcatgacctgttccttaaagtgggatgaaagctataatccacaggtggccctatgatttttgaaatataaataaatatttaaaatttggttaaaacaaatactatttatgagagccagtcgaaaaaaattccacaaataccatttatcagggcctgctcccatgaaaatggacctggtagtttttcttgtatatttgtctgtataaggacgatctggcagttgcggaggctagaccccacttttgtgcttggcaagtacatgagaccagtctgtggtttatttattctataaagaggctaaacagaagcagcctctggaa

SEQ ID NO: 122863 - DNA, 1542 bp, Homo sapiens
ctcttgttgcccaggctggagtgcaatggctcgatctcagctcactgcagcctctgcctcccaggttcaagtgattctcctgcctcagcctcccaagtagctgggattacaggcgcctgccaccacgtgcccggctaattttgtatttttagagagacggggtttcaccgtgttggtcaggctcatcttgaactcctgacctcaagtgatccacctgcctcagcttcccaaagtgctgggattacaggtatgagccactgagcccggccgtatagtgttttctaaattttaactttgaaaatttttaaaagacataaatgtataaagacatgctagatgaagtagctgccagtgcctcaggaattcctacactgatagcctctgaggcccagcatggagaaggtctcagggaccaccacatgggcccagtcttgtgccacaaggtcaagtgctacctgtatagcaagtgacatcaaatcatcgacattccatcgttaaagaatttgtgactgtcatatggaaaaattatttggtggggaattcagataaaaataacagaaattgtgaccaacaaggtttctttcaattgctgacaagttgtcaggatagttctttaaaaattttgctaacaaggcacccaggagagtgactgcttacatctgaaacagaagagctcagcatttcagaatatctctgttccattttgcctagttaacttgacatatctagttattttccttaaaaaatgaaaaagttcttttaaatttcaaaggaaatcctccttgtctgcggtgaacaactgggtacactggcatttttgctaatgctttgaatgtctgtcagcaaccaggtttaaaagtaaataatgctgtttgagtttcatgggatctatttgcaactagtttgaaaataattaaatgagtcatatgtataaattttatgtgacacaagtagtctagtcttttctctttaaaaatgggtcatttaattcatttctaactacactgtgttaatatggtccctcctttaaagtaaacgttttcactaactactcattttttcttttgtcctctttctctcttgcatctgtttttcctttgattgtatctgttgtgtaatttcatattcaatcatgggtttgcacttgagaatagactgtttccatgtgcccaccttcacctctcatccaccgtacttcatctttttccccaaacctattgcctgtccctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctt

SEQ ID NO: 122864 - DNA, 1051 bp, Homo sapiens
tattaatcatacttcatatttacaaagcactctttttctcctcagtggcttcctttatttaaatatttttctttattacaaaactaatacatgttcatcatagaaaatagaggcaaacagaaggaaataaagatcacttaaatctttttatgcagaaataagcattcttaataccttttttcttttctttttttttttttagacccctgggcagttgaattcacatgccttctaaaaatggggtcatactatgagcatcatttttgttagttttttttttttaacttactattataagatttttctgtcagtaagtagtctctggcagcatcatttttaaccactagatgctgtatgcccttaattttaaaaagtactttcataccatctcattttttacaagtataccatctcatttaaagtttgaatgttttttaattttacagctacataaaacagtgcagagaatgacttgtttaaagccatgtattgttaaatggtctatctgcctgataccgtctggtaaatcctagtaggaggtgaaacagattgtcttaacactccagtgtttttcagatcattttctatgtaatggggacaggctaggttagccaagaaacagaaatagggaggaaggaaaaaatatgtttgagaccaaaaagagctcccaaacctctcctcctctagaccctgccattcttaccacatgcaaatcttgcatctctactttgttgattgttagttagaaaccaattcttaaatggcaatgctgtatgtaaggtttcaggattcttgtttttaatgttgtctcttagaaaagtaagaaattgtggactctgttctaagtataatactctttcttgctgtgtagttaggagcagaacactaaaaaaattcaagataaccttcattctgtttatcatccgatagactccttaggtaatatttgataagcaagatatttgtggcttattgaaaagaatatatgtggcagtttaaaagaacttttcatatttcatgtcgtttaaagttttgtgtctttatttttcat

SEQ ID NO: 122865 - DNA, 1037 bp, Homo sapiens
gtattcctaggtatttttttctcttagtagcaattgtgaatgggagttcactcatcatttggctctctattattggtgtataggaatgcttgtgattttcgcacattgattttgtatcctgagactttgctgaagttgcttatcagcttaagtagattttgggctgagacaatggggttttctaaatatacaatcatgtcatctgcaaacagagacaatttgacttcctttcttcctatttgaataccctttatttgtttctcttgcctgattggcctggccagagctgccagcacagcagtctgagtaaagctttcttaaggagttccttgtgattgctacttccaacttagaatgaggttaagaagaaagaagggtgttatattaagaccaggaagggaaatattgtctccaacctgaccttacctctccttacaattatagagttggagggaaagggaggattaaggaggaggagtagttcgttttaggagttgagataattgtgttcgcttggtatgtatatacttttagccaacagtttcaattttcacactttatccttcatgactaggaatccattattgtccttgaagagctctcatttcagtgtctgcaggggctatttgttggcagttctacagaataagactgtgtgaagatatgtctcatcatttggaccattttagatgcaggagaatgaggcccatgggacccaccttaaaagcatgtgaatattttacttatagtacacacttaccacatttacacacatatgtccccaaggacaaagcaatacttagcccagtggaatgctgataggtgcaagttgctttgaataatactttattaaaatgtgtttacacttaaataattatgtgaactgtaaactgttctattttagactctagaatatttcttatgaattaatttttttccctcatgcagaactggttagatcctgctaaagaaataaagagacaactgagaagtaagtatataaataatcattctttgaagttaaggtgtcttgatat

SEQ ID NO: 122866 - DNA, 1029 bp, Homo sapiens
tttttttttcttttcaatttggcgccattcaatttcgtttttcttgctatggttgttccttgggtgaaaattccacccatttgcccctttctcacctctctcccagcctccaaccagtgtgggctagaggctgaatgatgtgttttttcattcctgtgcacttatcgaggctggccatttgtgagccagctgttgggtgggacagcagctgcagtgcatgcaaactgaatggcaggctctcttctgaaggggtaattagagctgctccctcacatggcactggaggcacccttagagaggcctgctgcccctcacgtcagtagtgcatgcagctgggacaccagtaatatgaaactagaccatgctctggtagttctttattgagaggtttgaatataaccagtgttagaacagagccatgtacaccttggatccttgctaccccgagtgcgggccatgaacagtagtgaaacccgaggggccatgcggctctgctttcacagcatcttactgttttactttttaatagtgtcagttaatgttccgttataccattttaatatggtattaagacagcaggttattttctgtgtactaataagcattttaattgtttgctttatatatctgaataaaattctgtttaagcacagatgttgtaatacagtggtccccaacctgtttggcaacagggaccggttttgtggaagacaatttttccacataccggggtgggggtgagggaatggttttggcatgaaactgctccacctgagatcatcaagcgttagtcagagtctcataaggagtgtgcagcctagatccctctcttgtgcagttcacaatagggtttgtgctcctctgagaatctaacgcgggtggtgatctgacaggaggcggtgctcaggtggtaatgcccacttacctgctgttcacgtcctgctgtgcagcccagttcctaataggccacgatcggtaccagtccgtgggatgggggttgaggacccctgttatattattttggacact

SEQ ID NO: 122867 - DNA, 1049 bp, Homo sapiens
ctgaagctgtcactttcctgagttccttccctggagaatgttttaggatgttctgggcagttgtccatggacaaagagctgtcttttaaaaaatttgccgggtggatttttaccatcggccaaactggataatactttaacatgtacatagaagctcttagactagtcatatagaaagggcttggttttcatgtcatctcgcctgtgaatacagtgaccctattttgtgaaccgaaagtctgatttattaactttttgtgggtagaaatattcatatagagattaaattctttaatgtatataacacatcacctatggatatataaaattatgtgaagaagatatatataccaaaagatgataatttagttttattattgcaaatagtgatctactaatgatgatctgctggggaaggtacttgtatgcatatttattcttcaggcttgaatattgtttgaaaagaactaccctatgaggtagatgttgtgatccccattttgtgtttgaggaaattgaggcttaaagaagccaaggaatgtgcccaagttagagttgatagaaaaccagaattttactgcgtgtatttctgattccacggtttatatatgtggccacagcagacaaatctttaagtctaaaacctggcaatgaatactgtagtgtatcatggggtgagggcggttgttgtatgttgtgcacacacaccctcatgcatttttctcattctctgatggcattttccatctttttgtgtctgcttcttggtctgctcaaccctcctccttaagtgtcaaaccaagaaattaatttttattatttactgtatttatttaaaagttttgtttgttatttctttgtaactggtaatgcagatcattaacttgtatttcttttaagtcatttaagtcattttttttttacttaggaatttatgatgctataccccacttaccatctaagtactcattagagatatgtattcaagtaaaaataaatgtaataaaagtaatataacgtgatcatttaagatgatcacagcgtggaga

SEQ ID NO: 122868 - DNA, 1050 bp, Homo sapiens
atcatggaacaaaaaatcaaacatgaaaccaaagtgttgataggataaattatgttaggatctactgaataatagggctaaatgattttcctggggagtagtgtactttatagatatgagccaccttgaggaattgatggaagcagtttgaacatttttgaaataagaaaatgaacagctaacatttcgcctttttcgtcctttttatgtctatattgagtagcagtaaagcagacggtgcttgcttatgcttttgtttcagattttatgctttgtatatgtgtgcagggtgggagggctaaagttaaaaaattaatcacttttatattgttagaaaatgagaaaacaaatatttaatgttaatttataataaatcatgtatctgatatgatgtcttaaatttatagcagtcttggaatctttagtacttgaaaagtaaagttattattttttctccagaaacatgccaagggacaagtgttatttgacaaagtgtgtgaacacctcaatctcttggagaaagactactttggacttttgtttcaggaaagccctgagcagaaagtaagtgatttcaagtttatttttatctttttagaacatattgtatttttttattaaccagtttatctcagtttaaaatttagctttaaaataacttaggtgtttattatgacttcactgtgaaatttggtaaatactgaaaaactatcttgtgtagagagaaaccacctgtagctttttggtgtatgtgtatttgtgtgtgtgcatgcatatgtgtacatgctttgcacttacatcatgagcagacagaatagaatgtcatcagtggaaaagtgatgttctggcataaagagaacacagaataaatggtattattttaatcacttttggctctcaatcactcagtctggcctttcggtactaaataagtaaagaagctggtcacatctgctcatattgtgcagtcacctgtatgctaggtattaaagcatacctgaaaggcagggaaggcggcacattggaacgattctgtctgaggataccaag

SEQ ID NO: 122869 - DNA, 1848 bp, Homo sapiens
gagaggcagatggaagcttaagtaatgtgtatgtgcaatcaggatctcatcaagcattgagaatatctgttccctggagagagaaggaaagaatagtagagaagcagctttagcatctagaaacattttggtgtttgttagatgtggactagtgaaggaatagttgacagtagagtactgctatggttggttgaggcatattccatctcactgggttaattttattctcacgtgagctctgaggtagctattaccctcattttacagacagggagacttaagtggttttactttgtcacactggtgcggtgcagtaatagtaaatgcttacaaaatgttgaatgatagaggaactaggtccgatagaggaactggtccagccatcatgctgatacctcatgtactgccaaattgtagtggtgagctgtgtggatgttttttcctcttaatcttgtaaggaaattctgcccatgagggcatgttcctatttttgaaatggaaaccaatgagaacatgtgaattattagtaagagttgacttgaagctagtgttggaattggaacgtgttttctccttgaactgaggtgtatttttgtagacatcagttgtcttaaatatcctttttaccctaatttcaaatagcatcataaccaattgttatgtactgcaactcttttagtactcaccgcacctcctgtggtatctgctatctgttatccccatttcacagatgagcagattaaggcaagcagacgttaagtgtcttgccatgggtcacatagcttgtaagtagtggaagtgtatttagaactttggtgtttgacatacagagcccaatactcttattctctatgctgtatttgtatatacttttaatatgtagacaaacaagcacatatctatcttaaacatgctcagtaatttaattgactattaaatcctcattgcaaacctgtaatatgtatgtgacacattgttttatttttaaattttttattatttatgtatttatttattgagacagggtctcactgtcacccagcctggattgcagtggcgtgaacacagctcactgcagcctcagcctcccaggcttaagcaatccttccaccccagcctccggagtagctgagactacaagcacacgccaccacacctggctaacgtttgtattttttgtagagatgaggtttcaccatgttgcccaggctgatcttgaactcctgagctcaagagatatgcctgcctcagcctcccaaagtgctgggattacaggcgtgagctaccatgccaggccttacactgcttattatgttgaaataatgttatctgtgtggcattctccttcttccctttacaatttgatgcaattctattcttttcagaaatgttaccataagaggcttaataataaaaataccagattctcctcctcaagatacatgtgtggggaacattaattttcacacactggatgagctagtacacattttgatagtgagagggcattcgttttgaggatggaaaagtctgatggctttttctttttcactagcagtgcattggtggcttttatcagtgcacctggggaggaggcgtgtgtctgacctgacctcacagttgggttgttccaggggtgtgcatcttaattggagatgagtcaccactctgcttatgttttgccattgaagagacaatgagcttttcttctatggctgtcaaaggctcttacatctctgttcacagcagcttcttaaatttatatatatatattcaaggtaaaaatatgttaagtccttaggggcagttgatttcttgtcccacttccattatcttgtatttttagaa

SEQ ID NO: 122870 - DNA, 1021 bp, Homo sapiens
ttcaaaatatttctttttgaagtgtatttggcaagttttattaacagttgcatggtttttattgtttaataaacttgatatcatattattagaatagagattgactcggattgtactttatgaagattctactgtaagaacagaaacaaagcaaaggcatgcttcagatagcaagaagaaatgacagcgaaagtgatgtcttagtggaggaatgtgcaagactaggaaaccccctgtcctttctgcataaagatgaggtatggcctactcttaagaggaaggggcagattggctttttccctctagttcccaaaatgtatttggaaatgccctagtttactaaggaagagtataagcataatgtagaattgtgaaaatgaagtgttggtctgtgctggtcttctcccagaaactagttggcagtgtgtgtttggtttaggtccttgaacattatgggttggtagtccatcagctaggtaaggaagattgtgtaagaaaccagcaggcctgaattctagactcaactctgccaactttttgactggccttatggcattgagccgttccatcagcagctatcttttggcctactagtcagctaattactcagtaggaggcattgaagtaagatgtcctctttcttaaagaactcagtatctgaaagtaataagtatcaaaaggagtagaatagaagaataagtgccatagatgtgaataatgctcttgaaggagaatgatgcaatattgagagattggaacaggcttcatagggaaggatattttggagatttgtatacaagtagaggtagttttgacacttgtaaataaatcagaggaaaaaaattagaatatgtcttgataagtcagtaagtggttctctttatctggggcaataccccaaaattgctgtgacaactaatgaagcaactacgtgtactggtatcttaggtgaaagttatgaagcaaaattatgtgtatattttgcttggttaacaaatgtatatttgtagtcctttttata

SEQ ID NO: 122871 - DNA, 1743 bp, Homo sapiens
ggtactgtttcattgttgtcactgataattacaatttacattctatactaatttatcatctattgatagtcaactgagatctcaaaaatttttcgaaaaaactttgaagattttttaatgaagaaactttataacttgatttttttggaaatgtttttatctcattgagatatttaaatggtatgtgccaaccttctttggttccagagttaaattgtagagaatttttgggtgtctcttggatcctgcatgtttacttcagggacttgactctagcactctttatgatgttgctgctaaggtcatttacatactcagtgtgttaaaacagcagagctctttcctctaagcgggggaaaaaaacaataaggtttagttgaagccatggatataaagtcaggcgatctatgtttacttttctttttactctttgggtatcttgggggagtcacttcctctcttctattctcagattgcaaagagaatgaaaatatttgcttcctccatttctagaattgagctggttttactacaactgataagtcggtatatgtgttttaaagtttgcaaataagtgtgaaagttcctgcaagactttggaagcttgagtgaatgtgcattctgagttagagttgctcacattttcctctggcatctcaaagttgttcccacatgttgattttgtctgagaatcaagggcattgtttctgcctacacaggaatgtcagtaccgttttttcttagttatgaataaggctaacaatgtaggctctcttcatcagtgttctgttgataaaagtatttctcagagagcagaatgtgtcgaggtctttttgcctttcttgtgttgagttcgggtctcggaaatccaatttgctatcattactttgagtgtgttttatttgcttgtttgtttattgttgtttcttttcaccctccaaggtggtatttcagacctatagtactgacacttactaagtttactagttaaacagtttcaactatctacatatttgtagaggatctggaagttatggcactctataagattccataaaaatagtggcagatttatatgtcattttgggaactaggaataatttaatgggcatgtattatgtgcaatttaaaattccagtgacattggtcaaggtggcatgtctttatccttttagcttaaaacaggatttagggtggtaattctattcaaaacttaatttgtatttactaaatgggaaaagactgccgtgccatgtaagtgatagaatattttggtccagcttgaagaacacaaggagctcacagcagcagagcctggcctcataatcaagtcactccttagctggacctcggcccccctccctcctccactcttggtcacgtataacctcaggctatcttttgacctctgttaccacttgattttctgagtcttcccttgtgtcaagttggtcctctaatcagacatatgctgagttgcctggccttccttccagtttctgaccctaccaactccacattttgctttccccatcacatgattcctgcctatcttagtttccaactcaaatccagctctcagaatgttcttttcttccttggaacttgtttgcaccattagtttggcaattaagcatgcactgccttgtgaaagactctcttgtattgctgtgttgaacaactgctaaactcttgtattgtttgatttttctcatgctgatgttgtttcttcacctggtttat

SEQ ID NO: 122872 - DNA, 2178 bp, Homo sapiens
catttatttttagtactactgagattagtgactctattttgccatttaattttggattgtctatttttcttcgtttacttgaatttgcttttttcccttttactgctgctcttttagaaattaagtatattacagacacacttgagttaataaagtctaatgctaatcactatgcctactcgcctctttccccatcttatttagtatgcatttcgtagatctcggatctcgttttggaatgatacaaaaacaacaatttcttatctgtgtaactagtccttctatgatctactacctgtagggaatcaacttactgtgttgcctgaagcagagttgagatagtatccaaagcgaaaagcagcagtttagtcttctaattcaccaagatttaaattgggaaagcataggagtcttcatttttatgactgtattaatttatagttagagtatcttttcatttaatagatgattacttaatattgccattataagaatgaactttggaggacaagacatgatgaaataagcttaaaaacagcatttgtgttgagtaatcctttctttttcttttgagttcatagcaaaatggagtttgaatagattttagtgatgctatcccacagcagatcttatgtaccagcagttcacttgaattctaagctgtgactttacatctcaacataggccataattcatcaatatcctaatagctattataacaatgcagaagttataaattatattccccattttattgcattttccttttatacaagttttcctcttattttgattttcccgttgcttgcttagtatcattagtttgggtctgttactcatcagacctgttcttgtttcctcctcaggagtggagcccagagtacagccatcatggggttgagcaggctaatgtttcccaattccagtgttgaccttaggcagattggatgatatgctgatgctgcttatcggtggttctgtatctctacaccggaaatcaccgtctgaggactatttggggaagtagatatgggaaactgtagctattaatgaacttttgagcactcaaggaaggagaatagaatatgggaaagaaatacttgtatttggtttgagagaatagatttgtttccatctgtttactctcagcaaatattgtatttctttatggctcttcagaggactgtagttattgtttgttctttttctttctatatgtacatgtgtctaattttcaattaaaccttgatataacatgcccactgaagaagacctaattgtcttcacttagggtgtttacaacaatggagagaagccactcaaagcatgggctgtgcaggaagtcatgaggtgatagcttggcttacagggatcttatagagagtagggtgaggttctaaaaggcctcaaatgccaggatgagaagattaaaactgatccatagcaaaaaggagctgcttagtaatggaccagaggttgtaaagtcattggtatacaggacctagcaaagtcaagggcgctgtttagattttggaacattgtagctagctatatggctgcagtaatttaaggggctggggggggggtcttctttattcagtgcattgcttatgatgcacatcagtggtctctatagataatttttttttgtgatgcgattagaacattgggtatgttaggcactttcctgttcttgttacctatcagtacctttggtcaacaaaagtaccccctttaaaccatttaatgtgaatattgctatatcaatggaataatttttttaaaatcaaaaaacataattcatgggggcatttttgtttgacatctgaacatcatctctgcttcctagcttactcactctatataattaatatattctgtataatctatattaacatgttgttatatatttatatgtattttatgtgtctatatccccatgtatctgttcatatcccttctttctcccctcatcctctactttttatggcttcctgtttccacattgtttttcctgtgggctatcaacctattctttatctcctaaacttcaggaattagataaagacaactgtccaaggaaccaatacagtactgtttttaaaaacaaatcgccatctttgaaatttgtgttcttttaaggaaagagggcatttgctaatattaagtggataaaaa

SEQ ID NO: 122873 - DNA, 1343 bp, Homo sapiens
gtagatttgtgtgtgcgcattttagttgcctaacaaagcctaggttttgccatggtataagattttaattggaaatgttattatttgagatgatacttaaattgtagttgctgggatgtagtttctttgattcatttaatgccaaataaccaacttggcaaaatgagaattttggccatgaaaagaggatgaggggaaatatcctttctattggaattttcaagtctttaaaaatctgaaagttacagtgtttaaagtaacgatcctaattcttatgaaagattttccttttagtatgttgtcatctgcaaggtggttgactatagtatgaatttatttttttttcctcaacagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggaggtgagatagggagctgagtgagagctagcttgatatgtggattgtggcatggcatgatgaatagatttttgtgttttattaagttcctgtaagccagttgattacagttttgcactaaaaaaaatacattgaagtgggtcatcatttctgtcacaaatatttcatgaccttgggataagcagggatgctattctgccagtctgcactagccgtgtttactggttcgtgtgttaatgactgggtgttaaatatttggaatattgcttttggctagaagatgtttttcttgaggaaaaatgatagcactaggctgacatttcagaataaagaagtttcagcagtaaacttagccccaagtgttttatcctgagacagatactggcttaacatctaatttatttactttcatttaattaaaaaacatctatgatttgcaaaacatacagttcattagcgctggtgctgacagaagtcactttaatcttttaacgcatctagtaccttataattttatgtcaatcagaagagtttgttgctttccacaaattatttacgtaacgtatactaatagctaatgtttgctgaagaactgtgtgaagtgctttgaatggattatcttgtttaatggattatcttgttttattgattaagaatcaataaaggtagatattatcattgctattttcagtgttacatgttacaacggggaacttagggcttagagaagttaaattccttgcccaaagttttagggctgggtgcggtggctcaagcct

SEQ ID NO: 122874 - DNA, 1139 bp, Homo sapiens
cacttaaaactgttttttctaatacctaacattttgatagattttgggtttaatgtatgaaattgtagtgaaatgtgtctcattgctttctagcactgttgataacatcttcctgttacagaataaagaataccaagtacagataaaagtaatttttcttaaaaaacttggattttagatatcaattattgtttataacaagttgaaaccaaataaaagtaatccctgtttcttgagttcttgatgattttaagttctagctatatggaactcagaacacacagagttctattgtgatgctagttttgggtctgtgatgctgatagagaattctaaaagttcgagcaacagtctccattttgtcttgtgcttttgaatcttctttcttgatgtgctttctccctgtcatctgttactcttcttctcatctttccttaccatgcccctcgcaaccaaactaaatttgagagaacttacaaaatgacattttatgatttttgttttgattacagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcaggtatgtttgggaataattgcctggaaatgaaaacctgatagcgtaaccacataataaaaagggtttgtttgttttggatcatttccagatttcttgtactgagatactgctttagcttaat
